United States Patent 6,783,961 (EXPRESSED SEQUENCE TAGS AND ENCODED HUMAN PROTEINS) - sequence listing, part 2

SEQ ID NO: 3659 - DNA, 454 bp, Homo sapiens
  CDS 276..452
  misc_feature 302: n=a, g, c or t
  misc_feature 303: n=a, g, c or t
  misc_feature 304: n=a, g, c or t
  misc_feature 415: s=g or c
  UNSURE 10: Xaa=Ala or Cys or Asp or Phe or Gly or His or Ile or Leu or Asn or Pro or Arg or Ser or Thr or Val or Tyr
  UNSURE 47: Xaa=Ser or Thr
aagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctcnnncggcgtctttggtgtggcctttctagccagagtcgccctggttttctatggcgtcttccaggaccggaccctgcacgtgaggtatacggacatcgactaccaggtcttcascgacgccgcgcgcttcgtcacggaggggcgctcgcctta

SEQ ID NO: 3660 - DNA, 453 bp, Homo sapiens
  CDS 62..451
gagggccccaggacagaagcagacagacacggctcctgctgtcgattccgatccagccagaatgcctccaactcaggccgaaagtgttataaggagtattatacgagaaataggacaagaatgtgcagcccatggagagattgtttctgaaactctgattgcttttatggtgaaagctgttgtcctggatccaagtaatggctttaacatggatagaaccctcatgaaaagtgatgtgcagaatcttgttaagctttgtatgactcggctattggatactaaaaatccatccctggacactattaagatgcaagtctacttcgatatgaattatacgaatcgagtggaatttctcgaagaacatcaccgggtcctagagtctagattaggctctgttacccgagaaattacagataacagagcatgtgctaaagaagaattggaaagcctcta

SEQ ID NO: 3661 - DNA, 366 bp, Homo sapiens
  CDS 81..365
  misc_feature 10: w=a or t
  misc_feature 64: w=a or t
  misc_feature 119: w=a or t
  misc_feature 200: h=a or c or t
  misc_feature 201: s=g or c
  misc_feature 215: h=a or c or t
  misc_feature 228: s=g or c
  misc_feature 331: m=a or c
  UNSURE 41: Xaa=Gly or Arg
  UNSURE 50: Xaa=Asp or His
  UNSURE 84: Xaa=Ala or Glu
tagttaagtwgcttttacagagttaacaggtctccaagaaattttaaaaaaggtcattattgcwgtggtttgagctcagcatggctgtagtcatccgtttactggggcttccttttatwgcggggcctgtggatattcgtcacttcttcacgggattgactattcctgatggaggagtgcatataattggaggggaaathsgggaggcttttathatttttgcaacasatgaagatgcaagacgtgccataagtcgttcaggagggtttatcaaggattcatctgtagagctctttcttagtagcaaggcagaaatgcagaagactatagmaatgaaaagaactgatcgtgtaggaagagggcgtc

SEQ ID NO: 3662 - DNA, 271 bp, Homo sapiens
  CDS 26..271
gcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaaaa

SEQ ID NO: 3663 - DNA, 313 bp, Homo sapiens
  CDS 126..311
  misc_feature 36: m=a or c
  misc_feature 44: m=a or c
ccaagtcctcccaagttattaactggtcaaaaaggmttaaaggmttagttcttaatagttaagatgccacccattcagggttttttgctttctaagagggaacttttacaggcataattgagagaatgcatacatgctctctaccttgtcttctctttgctcagctgctagaattttgtagctttcctccagatgtgcctcataactgtgcgcctattgtctcagtcaggccgcctaatattgtagcagcctttgaagggtgctctgtagccactgctctttttcctcccttgtgcatctccacagggaatga

SEQ ID NO: 3664 - DNA, 191 bp, Homo sapiens
  CDS 27..191
  misc_feature 19: s=g or c
gactggaggcgcgcgacgsgggcgcaatggcggggacccggggcttgatgctgcttgggcctggcccagtggcgggtcctagggacgtgggtacctgcagaggccggcagatggagattcagaaacataaggacaacaagaaacttccccaaggtatcattatagtctttagacttcagacacacacctcc

SEQ ID NO: 3665 - DNA, 422 bp, Homo sapiens
  CDS 52..420
  misc_feature 126: w=a or t
  misc_feature 127: k=g or t
  misc_feature 352: w=a or t
  misc_feature 393: m=a or c
  misc_feature 394: v=a or c or g
  UNSURE 26: Xaa=Gly or Trp
  UNSURE 101: Xaa= *  or Arg
  UNSURE 115: Xaa=Ile or Leu or Val
gtcggccgcttgcgacgctccggaagtgacgtgctttcccgagccggggccatggcacctgcaaggtgtttctcagcaagattgaggaccgtgtttcagggcgtggggcattgggctttgtccacwkgggctggcctgaagcccagccggctactgccacagcgggcttctcccaggctgctctcggtcagccgtgcggacctcgccaagcatcaggaactcccggggaagaagctgctctctgagaaaaagctgaaaaggtactttgtggactatcggagagtgcttgtctgtggaggaaacggaggcgctggggcaagctgcttccacagtgagccccgcaaggagtttwgaggccctgatggaggggacggaggcaacggtggacacgtmvttctgagagttgaccagcaagtcaagtc

SEQ ID NO: 3666 - DNA, 421 bp, Homo sapiens
  CDS 80..421
  misc_feature 33: s=g or c
  misc_feature 34: m=a or c
  misc_feature 35: k=g or t
actattgagactatgactttggaagggcaagcsmkcagaagcaagaacatgacaaggctattgcagttattcagtgttaatgtaccgcggtgaggctcttgaagatttcacaggcccggattgtcgttttgtgaattttaaaaaaggtgatcctgtatatgtttactataaactggcaagaggatggcctgaagtttgggctggaagtgttggacgcacttttggatattttccaaaagatttaatccaggtagttcatgaatataccaaagaagagctacaagttccaacagatgagacggattttgtttgttttgatggaggaagagatgattttcataattataatgtagaagaacttttagggtttttggaactgtacaattctgcagctacagattctgagaaagctgtagaaaaa

SEQ ID NO: 3667 - DNA, 419 bp, Homo sapiens
  CDS 21..419
  misc_feature 121: r=a or g
  misc_feature 126: r=a or g
  misc_feature 227: r=a or g
  misc_feature 228: r=a or g
  UNSURE 34: Xaa=Asn or Ser
  UNSURE 36: Xaa=Glu or Lys
  UNSURE 70: Xaa=Met or Val
ctttagatgacctcacttggatggatgccgagacaaaaaagagagctgaagaaaaggccttagcaattaaagaaaggatcggctatcctgatgacattgtttcaaatgataacaaactgartaatragtacctcgagttgaactacaaagaagatgaatacttcgagaacataattcaaaatttgaaattcagccaaagtaaacaactgaagaagctccgagaaaarrtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaat

SEQ ID NO: 3668 - DNA, 320 bp, Homo sapiens
  CDS 140..319
  misc_feature 19: s=g or c
  misc_feature 125: s=g or c
atcttggcaagaggcgaasggcagcggttcctgtcaagggggcagcaggtccagagctgctggtgctcccgttccccagaccctacccctatccccagtggagccggagtgcgggcgcgccccascaccggccctcaccatggtgctgttggcagcagcggtctgcacaaaagcaggaaaggctattgtttctcgacagtttgtggaaatgacccgaactcggattgagggcttattagcagcttttccaaagctcatgaacactggaaaacaacatacgtttgttgaaacagagagtgtaagatatgtctaccagcgtc

SEQ ID NO: 3669 - DNA, 446 bp, Homo sapiens
  CDS 61..444
  misc_feature 128: m=a or c
  misc_feature 141: w=a or t
  UNSURE 23: Xaa=Asn or Thr
  UNSURE 27: Xaa=Lys or Asn
tattagaaaaaaaccgagtagtaaggcaaaatcccggggaaaggaattatcacatattttatgcactgctggcagggctggaacatgaagaaagagaagaattttatttatctacgccagaaaactamcactactttgaawcagtctggatgtgtagaagacaagacaatcagtgaccaggaatcctttagggaagttattacggcaatggacgtgatgcagttcagcaaggaggaagtttgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttca

SEQ ID NO: 3670 - DNA, 483 bp, Homo sapiens
  CDS 296..481
  misc_feature 131: k=g or t
  misc_feature 141: k=g or t
  misc_feature 446: s=g or c
  UNSURE 51: Xaa=Glu or Gln
tgggagaataattgttagtgtaggtaagttgttggttttatccacctcaaacctgattgggacttcagaggaacctctttgggaagctaatgattcagggtattgaagacattagcatagaacattaagtkggtccttttkgtttcagaagttcattgttgtgattaaattgccatctgataatttttatagaacagatgcttaatttttagagcatttttctattttccagcctttgcaaaatgttagcacagtgctgcagaagcctaatcctctctataatcagaatacagatatggtccagaaatcagtcagcaaaaccttgccctctacttggtctgaccccagtgtaaacatcagcctagacaacttactacctggtatgcagccttccaaaccccagcagccatcactgaatacaatgattcagcaacagaatatgcagsagcctatgaatgtgatgactcaaagttttggagctgt

SEQ ID NO: 3671 - DNA, 445 bp, Homo sapiens
  CDS 59..445
  misc_feature 365: s=g or c
  misc_feature 366: r=a or g
  misc_feature 411: v=a or c or g
  UNSURE 103: Xaa=Asp or Gly or His or Arg
  UNSURE 118: Xaa=Ala or Glu or Gly
acaagctccacagagccgcgggaggacggttgcctggtattattagcaagcagcaaatatggcggtggcgcgcgtggacgcggctttgcctcccggagaaggatcagtggtcaattggtcaggacagggactacagaaattaggtccaaatttaccctgtgaagctgatattcacactttgattctggataaaaatcagattattaaattggaaaatctggagaaatgcaaacgattaatacagttatcagtagctaataatcggctggttcggatgatgggtgtggccaagctgacgttgcttcgtgtattaaatttgcctcataatagcattggctgtgtggaagggctaaaggaactagtasrtctggaatggctgaatttggcaggaaataatcttaaggccatggvacagatcaatagctgcacagctctacagcatctc

SEQ ID NO: 3672 - DNA, 343 bp, Homo sapiens
  CDS 47..343
  misc_feature 7: s=g or c
  misc_feature 9: m=a or c
  misc_feature 12: m=a or c
  misc_feature 36: m=a or c
  misc_feature 40: m=a or c
  misc_feature 41: m=a or c
  misc_feature 44: m=a or c
  misc_feature 59: s=g or c
  misc_feature 61: m=a or c
  misc_feature 77: v=a or c or g
  misc_feature 108: y=c or t
  misc_feature 114: m=a or c
  misc_feature 118: m=a or c
  misc_feature 130: s=g or c
  misc_feature 138: m=a or c
  misc_feature 225: s=g or c
  misc_feature 297: s=g or c
  UNSURE 5: Xaa=Asp or Glu or His or Gln
  UNSURE 11: Xaa=Ala or Pro or Thr
  UNSURE 21: Xaa=Leu or Ser
  UNSURE 23: Xaa=Asn or Thr
  UNSURE 31: Xaa=Lys or Thr
  UNSURE 60: Xaa=Pro or Arg
  UNSURE 84: Xaa=Ser or Thr
ttatttsamggmacgtatatcacagcttactttgcmaagmmggmagatggttgtctccsamgtggacatcgcaaaavctgatccagctgctgcatcccaccctctatyactgamtggmgatgctactgtsgcccagamaaatccaggctcggtggctgacaacaacctgtgcagccagtatgaggagaaggtgcgcccctgcatcgacctcattgactccctgcsggctctaggtgtggagcaggacctggccctgccagccatcgccgtcatcggggaccagagctcgggcaagasctccgtgttggaggcactgtcaggagttgcccttcccagaggcagc

SEQ ID NO: 3673 - DNA, 313 bp, Homo sapiens
  CDS 74..313
acttgaactccatttcatcttttttcataccatctctaagattgctgccgcatttgcttgttaaactgaaagcatgtttcttgcaaaggctctattggaaggagcagatcgaggtcttggagaagctcttggaggcctctttggaggaggtggtcagagaagagaaggaggaggaagaaatattggagggatagttggaggaattgtgaattttatcagtgaggctgcagcagctcagtatactccagaaccgcctcccactcagcagcatttcaccagtgtggaggcctcagaaagtgaggaagttaggcta

SEQ ID NO: 3674 - DNA, 196 bp, Homo sapiens
  CDS 43..195
cacttgaaagaaaaactattcaaataattaccaaggcatcacatgagcatgaagataaaagtcctgaaacagttttgcagtcggccaattaagttggaatatgcaaggttggttaagttggcccaagaagacaccccaccagaaaccgattatcgtttacatcatgtagtggtctactttatccagaaccagccac

SEQ ID NO: 3675 - DNA, 309 bp, Homo sapiens
  CDS 81..308
  misc_feature 291: d=a or g or t
  UNSURE 71: Xaa=Phe or Ile or Val
ttcaagacctggaacgaaaacttcgcttcaaggaggacctcctgaacaatggccagccgaggttaacatacgaagaaagaatggctcgtcgactgctaggtgctgacagtgcaactgtctttaatattcaggagccagaagaggaaacagctaatcaggaatacaaagtctccagctgtgaacagagactcatcagtgaaatagagtacaggctagaaaggtctcctgtggatgaatcaggtgatgaagttcagtatggagatgtgcctgtggaaaatggaatggcaccadtctttgagatgaagccga

SEQ ID NO: 3676 - DNA, 373 bp, Homo sapiens
  CDS 7..372
gtagccatgcagcgagccgattccgagcagccctccaagcgtccccgttgcgatgacagcccgagaaccccctcaaacaccccttccgcagaggcagactggtccccgggcctggaactccatcccgactacaagacatggggtccggagcaggtgtgctccttcctcaggcgcggtggctttgaagagccggtgctgctgaagaacatccgagaaaatgaaatcacaggcgcattactgccttgtcttgatgagtctcgttttgaaaatcttggagtaagttccttgggggagaggaagaagctgcttagttatatccagcgattggttcaaatccacgttgatacaatgaaggtaattaatgatcctatcc

SEQ ID NO: 3677 - DNA, 321 bp, Homo sapiens
  CDS 49..321
  misc_feature 95: r=a or g
  misc_feature 106: s=g or c
  misc_feature 108: k=g or t
  misc_feature 111: k=g or t
  misc_feature 117: r=a or g
  misc_feature 118: r=a or g
  misc_feature 119: s=g or c
  misc_feature 167: k=g or t
  misc_feature 168: y=c or t
  misc_feature 177: r=a or g
  misc_feature 228: r=a or g
  misc_feature 271: r=a or g
  misc_feature 272: w=a or t
  misc_feature 285: r=a or g
  misc_feature 319: s=g or c
  UNSURE 16: Xaa=Asp or Gly
  UNSURE 20: Xaa=Ala or Pro
  UNSURE 24: Xaa=Ala or Gly or Arg or Thr
  UNSURE 40: Xaa=Gly or Val
  UNSURE 75: Xaa=Asp or Ile or Asn or Val
  UNSURE 91: Xaa=Ala or Pro
gccattttgagctcctccgccgggcggggtaacaaaggcgccgccgccatgtccgaggccggcattttgtactcgcgactcagccacatggctgrtgccggccgcsckcckaccccrrsagcaccagggctttggaagtggtcccctcgctcccacagaatgcccgkycaccccaaraacacctcccgaaacgccgcacctaacagatgttccttcgtctgcctcgargcgtcccgctttcatccgcacaatacgctccctctcaactccrwcaacagctaccaratggcagccgccccgacagctccccaatccccasca

SEQ ID NO: 3678 - DNA, 361 bp, Homo sapiens
  CDS 145..360
  misc_feature 70: r=a or g
  misc_feature 90: r=a or g
  misc_feature 94: r=a or g
  misc_feature 103: r=a or g
  misc_feature 107: k=g or t
ctggcaaaccgaatccagcagcacatcaaaaagcttatccaccatgatcaagtgggcttcatccatgggrtgcaaggctggttcaacacrcgaraatcaataraagkaatccatcatataaacagaaccaaagacaaaacccacatgattatctcaatagatgcagaaaaggccttcaacaaaattcaacaatgcttcatgctaaaaactctcaataatttaggtattgatgggacgaatctcaaaataataagagctatttatgacaaacccacagccaatatcatactgaatgggcaaaaactggaagcattccctttgaaaactggcataagacaaggatgccatctctcaccactcc

SEQ ID NO: 3679 - DNA, 320 bp, Homo sapiens
  CDS 49..318
  misc_feature 302: n=a, g, c or t
  misc_feature 303: n=a, g, c or t
  UNSURE 85: Xaa=Ile or Lys or Met or Asn or Arg or Ser or Thr
ttacaagaattaggagcttatgttgatgaagaacttcctgattacattatggtgatggtggccaacaagaaaagtcaggaccaaatgacagaggatctgtccctgtttctagggaacaacacaattcgattcaccgtatggcttcatggtgtattagataaacttcgctctgttacaactgaaccctctagtctgaagtcttctgataccaacatctttgatagtaacgtgccttcaaacaagagcaatttcagtcggggagatgagaggaggcatgaagctgcagtgccaccacttgccanncctagcgcgagaccgtc

SEQ ID NO: 3680 - DNA, 349 bp, Homo sapiens
  CDS 163..348
  misc_feature 81: m=a or c
  misc_feature 136: s=g or c
  misc_feature 140: r=a or g
  misc_feature 144: m=a or c
  misc_feature 145: s=g or c
  misc_feature 150: m=a or c
  misc_feature 158: h=a or c or t
  misc_feature 162: r=a or g
  misc_feature 167: m=a or c
  misc_feature 274: w=a or t
  misc_feature 275: m=a or c
  UNSURE 2: Xaa=Ala or Asp
  UNSURE 38: Xaa=Asn or Ser or Thr or Tyr
ttggcaacaggaggtggagaggagatgcgccgagggatggaggtgtatgtcaccgaggaggctgctgcgctcctgccccamgccctgggcccttgaagggctctgcgagtgacccggcgggcgagctccgtgctgsatgraaamsgctgmagaaggchcaaratggmcaatcaggtgctgggctacaaggacctggctgccatccccaaggacaaggccatcctggacatcgagcggcccgacctcatgatctacgagcctcacttcacttatwmcctcctggaacacgtggagctgcctcgcagccgcgagcgctcgctgtcacccaaatccacatccccccctacac

SEQ ID NO: 3681 - DNA, 286 bp, Homo sapiens
  CDS 14..286
  misc_feature 112: d=a or g or t
  UNSURE 33: Xaa=His or Gln
tcgagatgtgaggatgatttctgacagaaattcaagacgttccaaaggaattgcttatgtggagttcgtcgatgttagctcagtgcctctagcaataggattaactggccadcgagttttaggcgtgccaatcatagtacaggcatcacaggtaatttttttgttggttaagagtttgattattggtggtgttgaaagcctcctgttgcatggtatagtgctgttgtgttctgtgactgctgctcattacgttgagtcggatgttttcaggacttttttttttttt

SEQ ID NO: 3682 - DNA, 443 bp, Homo sapiens
  CDS 214..441
  misc_feature 118: r=a or g
  misc_feature 144: k=g or t
  misc_feature 279: r=a or g
  misc_feature 354: m=a or c
  misc_feature 359: d=a or g or t
  misc_feature 360: s=g or c
  misc_feature 377: w=a or t
  UNSURE 49: Xaa=Asp or Glu or Gly or Val
  UNSURE 55: Xaa=Leu or Gln
tcgctgtcaatctcaagaactccctcaagcaactcaccgacccctactacctgtggaggaagagcaagctggactgttgcatctgggtagtgagcttcctctcctccttcttcctcargcctgccctatggtgtggcagtgggkgtcgccttctccgtcctggtcgtggtcttccagactcagtttcgaaatggctatgcactggcccaggtcatggacactgacatttatgtgaatcccaagacctataatagggcccaggatatccaggggattaaratcatcacgtactgctcccctctctactttgccaactcagagatcttcaggcaaaaggtcatcgccaagacaggmatggdsccccagaaagtattacwagccaagcaaaaaatacctcaagaagcaggagaagcggagaatgaggcccacacaacagaggaggt

SEQ ID NO: 3683 - DNA, 337 bp, Homo sapiens
  CDS 3..335
  misc_feature 334: r=a or g
  UNSURE 111: Xaa=Lys or Arg
atatgggaaagatcctccccgaatacctcagcaactggaccatgggaaaagtcagacgagagggggttaaggtgatgcccaatgctattgtgcaatccgttggagtcagcagtggcaagttacttatcaagctgaaagacggcaggaaggtagaaactgaccacatagtggcagctgtgggcctggagcccaatgttgagttggccaagactggtggcctggaaatagactcagattttggtggcttccgggtaaatgcagagctacaagcacgctctaacatctgggtggcaggagatgctgcatgcttctacgatataaagttgggaaggargac

SEQ ID NO: 3684 - DNA, 378 bp, Homo sapiens
  CDS 216..377
  misc_feature 164: k=g or t
tagtttagaaatattattaaatgtggcaatatggacaataaattattttgaggtaccacaaggcaccaaaatttaaaaagcaaccaaaacttcctcaaattactttctctacttaaagaggaggcttcaattaaaattattcctcattcagtgtgtccatttaktttgaaaaggcaaaaaggaaagcgtttaccttatgtttcgctgaatgctggatgagctctgtaattaacactttgtcctgttgcaaccttcgcttcataagcttggagcagttgatattaatggcttccaaaatgtgggatgtattgtattccacaaatggccggctatcaattagcagcactttttccgttccactttccagcagagccacca

SEQ ID NO: 3685 - DNA, 285 bp, Homo sapiens
  CDS 36..284
  misc_feature 117: m=a or c
  misc_feature 264: n=a, g, c or t
  UNSURE 28: Xaa=Pro or Thr
  UNSURE 77: Xaa=Ala or Pro or Ser or Thr
catttggaaaaatacaagaaagtgaaaaaactcttatgatgaacacattatataagcttcatgatcgattggcacagcttgcaggagatcatgaatgtggcagttctagtcaaagamcgctttctgttcaagaggcagctgcgtatttaaaagatttaggtcctgaatatgaaggtatatttaacacttcattgcagtggatcttagaaaatggaaaagatgttggaataaggtgtgttggttttggccctgaggaagaattgncaaatataactgatgtgcagt

SEQ ID NO: 3686 - DNA, 189 bp, Homo sapiens
  CDS 31..189
  misc_feature 112: k=g or t
  misc_feature 118: k=g or t
  misc_feature 172: n=a, g, c or t
  UNSURE 28: Xaa=Cys or Gly
  UNSURE 30: Xaa= *  or Glu
  UNSURE 48: Xaa=Cys or Gly or Arg or Ser
aacctttttactgttgcttgcacaggctaaatgctatcctgtctcaagcaacatccttgctgtgacctctacttgttacctcctctcccagatatttgcacagttcacttckgccctkaattcaggacttgctcaaatgttattttttctgacaggactttcctgaccagangtttaagaatagtctct

SEQ ID NO: 3687 - DNA, 398 bp, Homo sapiens
  CDS 151..396
  misc_feature 15: s=g or c
  misc_feature 16: r=a or g
aaagctacattaatsraaacagtgtatgactagcataaaaacagacgtctagacaaatggaacagaatagagagctcagaaataaacccacaatgatgaaaatatagtctcttcaataaatagtgttggaaaaattggatagccacatgaatgaaactggactcttatgttatactacatgcaaacattaactcaaaatggattaaagtcttaaacataaaacctgaagcaataaaacgtttagacaaaaacatgggggaaaatattctagacattgtgctggccaatgatttattggatatgacaccaaagtgggattataccaagtgggattacatcaaactaaaaacctcctgcactggccgggtgcggtggctcacgcctgtagtcccagcaca

SEQ ID NO: 3688 - DNA, 262 bp, Homo sapiens
  CDS 64..261
  misc_feature 63: b=c or g or t
  misc_feature 116: k=g or t
  misc_feature 172: k=g or t
  misc_feature 173: r=a or g
  misc_feature 217: k=g or t
  misc_feature 218: d=a or g or t
  misc_feature 235: k=g or t
  misc_feature 236: w=a or t
  UNSURE 18: Xaa=Met or Arg
  UNSURE 37: Xaa=Cys or Asp or Gly or Tyr
  UNSURE 52: Xaa= *  or Glu or Gly or Leu or Val or Trp
  UNSURE 58: Xaa= *  or Glu or Leu or Val
tctctctcgccggagacctccgttgcgccgagtccattcggcctctagcaccgggtcctgggbatgctttccccgggaaggaggcgcgcgggggctctgccgcacgtgaggggcakggccgcaggtcaaagcctagagccggtttctgttagcagcggtgtttggctgtttkrtcaggcatttccagcagtgaaggagacagccagaagcaagcttkdggagctgaaggaacctkwgacagaagctagtccctcctctgaat

SEQ ID NO: 3689 - DNA, 230 bp, Homo sapiens
  CDS 38..229
  misc_feature 134: n=a, g, c or t
  UNSURE 33: Xaa=Leu or Met or Val
taacgtatgcacagaagctgtttttttattattgggaatgctccgcagcatgctgacttcaccttggcaatcagaagaagagggatcttggctccgagaatatcctgtgaccctgatgcagttcttcagatatntgtatcacaacgtgccagaccttgcctccatgtggatgagccctgacttcctgtgtgcattagcagccaccgtcttccccttcaatattcgcccat

SEQ ID NO: 3690 - DNA, 411 bp, Homo sapiens
  CDS 120..410
  misc_feature 299: m=a or c
  misc_feature 335: k=g or t
  misc_feature 343: m=a or c
  misc_feature 366: m=a or c
  UNSURE 60: Xaa=His or Gln
  UNSURE 72: Xaa=Asp or Glu
  UNSURE 75: Xaa=Pro or Gln
  UNSURE 83: Xaa=Lys or Gln
actcacgtggcccttgcttcatccagcacagctctcaggtgggcactgcagggacactggtgtcttccatgtagcgtcccagctttgggctcctgtaacagacctctttttggttatggatggctcacaaaatagggcccccaatgctatttttttttttaagtttgtttaattatttgttaagattgtctaaggccaaaggcaattgcgaaatcaagtctgtcaagtacaataacatttttaaaagaaaatggatcccactgttcctctttgccacagagaaagcacccagacgccamaggctctgtcgcatttcaaaacaaaccatgatggaktggcggcmagtccagccttttaaagaacgtmaggtgaagcagccaggtgaaaggcctggcggggaggaaagtgaaa

SEQ ID NO: 3691 - DNA, 354 bp, Homo sapiens
  CDS 152..352
cagagtcccttggaaagatgccttgagcttgtctcaggtccctaaacttagaaagtcctattcttttccccaaattctgacatgtgctggatcagagtgttctcatttccaataggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcct

SEQ ID NO: 3692 - DNA, 208 bp, Homo sapiens
  CDS 40..207
  misc_feature 82: m=a or c
  UNSURE 15: Xaa=Leu or Met
ccctttcatcatgatcaactggatcggatatttagtgtcatggggtttcctgcagataaagactgggaagatattagaaagmtgccagaatatcccacacttcaaaaagactttagaagaacaacgtatgccaacagtagcctcataaagtacatggagaaacacaaggtcaagcctgacagcaaagtgttcctcttgcttcagaaac

SEQ ID NO: 3693 - DNA, 251 bp, Homo sapiens
  CDS 45..251
  misc_feature 70: k=g or t
  misc_feature 104: m=a or c
  misc_feature 105: k=g or t
  UNSURE 9: Xaa=Ile or Arg
  UNSURE 20: Xaa=Lys or Asn
  UNSURE 21: Xaa=Gly or Trp
ttaggacgggcgggtgcaatcctcgaaggggagtctcagcgaccatgggggacaccatccactgtaagakaacaacggcagggggcgtcagtataggatggaamkggcggggggtgtgcaggggggcgtgggctgcgccgcgctgggccctaccgtcggaagtctgcgagcggggaaccagaatgtaccaggtcgagaagcactgggctgaaccacaagaagccaataggaggggggaatcgggacgtcca

SEQ ID NO: 3694 - DNA, 260 bp, Homo sapiens
  CDS 77..259
  misc_feature 112: k=g or t
  misc_feature 113: r=a or g
  UNSURE 13: Xaa=Met or Val
tggttggaccaggtgtgtcatttacataacgtgcgaagaagatggctaccccaccctaatcttttattatgcagatatgtgccatattgcctgtttctttactgtacacgtkrtgacaaagaaaagggaagatggagcctccatgctgaacatgcctggtccccaggtagccttttcctattggcatagctgccagcattcatccatgcaagcttccagtttgcttatctatgtttgcagctcaacttttcaggccaccg

SEQ ID NO: 3695 - DNA, 318 bp, Homo sapiens
  CDS 34..318
  misc_feature 15: k=g or t
  misc_feature 16: w=a or t
acagcagcggcgcgkwagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggacaggg

SEQ ID NO: 3696 - DNA, 433 bp, Homo sapiens
  CDS 226..432
  misc_feature 138: v=a or c or g
gcgctttgttcaagatgtgggtctggcgctttcgtgactcaagaccctcttaggaacttcttcactgaactcaaggaggagatcaggcaagatctgtgctgtgcagatcctttggattgaggctgctgtgcacaggavtatggatggatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggt

SEQ ID NO: 3697 - DNA, 356 bp, Homo sapiens
  CDS 195..356
  misc_feature 343: n=a, g, c or t
  UNSURE 50: Xaa=Ile or Lys or Arg or Thr
ctaaaatttcaacttttcagggctgccccatcttccctgtggatggcccgtaatttatttaaccagtgccccttgttgatgtatttaggttattttagttctgatgaactaaaaattattcctttctcctatttaaaggaaaaaggctagccctgtggactccatgagctttttgcaccattgggtacatccatatggtggaacgtcatgcgggtttaaaaagcagcgtatgtgaggaatttgagattggagcaggatggtgtgctacagtaggaaatggaagaggtagagtgtgtgctgtgatcacagccttatttcctctgacttctaatttagagagcanaataaagatatat

SEQ ID NO: 3698 - DNA, 250 bp, Homo sapiens
  CDS 24..248
  misc_feature 146: y=c or t
  misc_feature 170: k=g or t
  misc_feature 171: d=a or g or t
  misc_feature 186: v=a or c or g
  UNSURE 50: Xaa= *  or Glu or Lys
  UNSURE 55: Xaa=Leu or Met or Val
aacggtgtttggtggagcccgcgatggccgaacctgcgtctgtcgcggctgaatctctcgcgggcagcagggcgcgcgctgcacgcacagtactaggtcaggtggtgctcccgggtgaggagctgctcctgccggaacaggaggaygcggaaggccctgggggtgcagtkdagcgaccgttgagcvtgaatgctagagcgtgctcgcgcgtgcgcgttgtatgcggtccgggccttcggcgctgtggggt

SEQ ID NO: 3699 - DNA, 461 bp, Homo sapiens
  CDS 302..460
  misc_feature 318: r=a or g
  misc_feature 374: n=a, g, c or t
  misc_feature 376: w=a or t
  misc_feature 424: w=a or t
  UNSURE 6: Xaa=His or Arg
  UNSURE 25: Xaa= *  or Asp or Glu or His or Lys or Asn or Gln or Tyr
  UNSURE 41: Xaa=His or Gln
tgatacttagcttcagcgacttgacaacagtaacctttagtcttttaatacttacctgacagtatttgtgcattactgtaaataactaatgagacttatattttataaactaaatatatttttacatagctatcaaacaaaaaaatcccttcggttgtgattccatagtgtatcctctggtgaattacttttaaaaaatttttctttttttatagagaaaaggtctcactatgttgctcaggctggtcttaacctcctggcctcaaacactcctccagctttggcttcccaaagtgctgggatgacagatctgagccrccatgcctggcctgtgaattacttttataaagtggaaatgtctttcttttgtgtgnawtatcttagttgtttcttcagatataaaatactgtgtgtatgtatgcawgtgtgtgtacacaccacacacatattaagtgcaagca

SEQ ID NO: 3700 - DNA, 385 bp, Homo sapiens
  CDS 144..383
  misc_feature 300: n=a, g, c or t
  misc_feature 301: b=c or g or t
  misc_feature 315: b=c or g or t
  UNSURE 53: Xaa=Ala or Cys or Phe or Gly or Ile or Leu or Pro or Arg or Ser or Thr or Val
  UNSURE 58: Xaa=Ala or Pro or Ser
gatttttctagcgatttccagtgtgcatgctcaagagttattttaaagtagacgcaagtgtttctcatgccacagacattttgttaaaaacctaacttgaaatatacaagtgagttcaccaaactcataaaaatgtccttaaaatgataaaatggagaactttggggtcccaacaaagaggaattaaggcctggatcatgattacctctgttttccatgtgactttgaaagcagcagggctggagccaagttggccctgctccctcctagggacagcagggttgatgtccacctccattnbcatttgcttctgtbcagccggcaggccttggcggcccctcctggctctggagctttacatactttcttattctatccgcatcca

SEQ ID NO: 3701 - DNA, 307 bp, Homo sapiens
  CDS 62..307
  misc_feature 29: w=a or t
  misc_feature 31: k=g or t
  misc_feature 88: k=g or t
  misc_feature 120: s=g or c
  misc_feature 121: y=c or t
  misc_feature 126: r=a or g
  misc_feature 137: k=g or t
  misc_feature 138: b=c or g or t
  misc_feature 206: k=g or t
  misc_feature 217: k=g or t
  UNSURE 9: Xaa= *  or Tyr
  UNSURE 20: Xaa=Ala or Gly
  UNSURE 22: Xaa=Glu or Gly
  UNSURE 26: Xaa=Ala or Gly or Leu or Ser or Val or Trp
  UNSURE 49: Xaa=Phe or Val
ccttcctgcacagcatcaccagaatgttwtkctttcttttcattcacctctgtcatcatccatgctatggtgtttatggaggatgtaktctgcagcaggaagtgtgatgggcactgacgsygcagraagactcctgkbgtccacctcgggagctgacacgataaatgcgggtaaatctcaatcctttaatatctttatgacttctktctctttcgcktcaatttctattttctcatgttcaaggctgacattcaaaactaaacacctttctctaacatgttgctttaattatttaagcattctgcct

SEQ ID NO: 3702 - DNA, 297 bp, Homo sapiens
  CDS 112..297
  misc_feature 17: w=a or t
  misc_feature 121: w=a or t
  misc_feature 134: h=a or c or t
  misc_feature 136: d=a or g or t
  misc_feature 141: m=a or c
  UNSURE 4: Xaa=Phe or Ile
  UNSURE 8: Xaa=Leu or Pro or Gln
  UNSURE 9: Xaa=Phe or Ile or Val
  UNSURE 10: Xaa=Phe or Leu
gaggtgagtctggagawgagagtttccacgttgtcatcataggatctggactcaagtgaccaaaaccttgcttggatttttacctgatgaagtttgtcttgaaaagtgaaaatggttccawttccattttccchgdtcttmaagggtaattcagctttctttgtgtgtgagtgtgtgagtgtgtgcaagtgtgtgtgcgtgcagtctccccagcatagaacacccacacatgcacccacccacatgcagacacgcacatactcatgcatggattcttgttcacgaagtacccaccgc

SEQ ID NO: 3703 - DNA, 363 bp, Homo sapiens
  CDS 208..363
taaaggactaagagtaaaaacaaaaccagcaaggaaactggaagaaaatagaggtttttaaaagtaatttgagagaatgagtaaaacagtgggatctttcttaccccctaataaaatgaaaaagtgagggaatttaagaaattagttttttgttgttatcatctgttttacagattattgtggatatttgcaatggtaggctgaataatgtacccctccaaagatactcatgttttaatccctaaaacctgtgcatatgttgcgttagatggtaaattggattttgcaaatttgattaaggatcttgcaatggggaggctgtcctggataactggattggcccagtgtgatcacaaaggttcc

SEQ ID NO: 3704 - DNA, 206 bp, Homo sapiens
  CDS 2..205
  misc_feature 16: n=a, g, c or t
  misc_feature 38: m=a or c
  misc_feature 158: s=g or c
  misc_feature 184: n=a, g, c or t
  UNSURE 13: Xaa=Pro or Thr
  UNSURE 53: Xaa=Ala or Pro
  UNSURE 61: Xaa=Asp or Glu
aatggtggcgggtcgncggagctctgatcgccgggaamccttgccgctgctgtcctgcgaccccaagcaaggtatagacacgtgtggccgtttacgctgtaggatcctcattcccactggctttgaacattttggggacttacaatgccgccacccgscggacatcgtcaaggtggccatagantggccgggcgcctaccccaaac

SEQ ID NO: 3705 - DNA, 247 bp, Homo sapiens
  CDS 68..247
  misc_feature 114: k=g or t
  misc_feature 115: k=g or t
  UNSURE 16: Xaa=Cys or Phe or Leu or Trp
catttgccttttgattttgtttaatttctttatggtacttattttactaactgaggtttgaatgtaaatggtatacataaccatcttttcctctgtggtttcttccattacctkkatgcttagaaattcttgcctatctgagatcagatattcaccagtattttcttttggaatttgtttgtttatttactatttgtcttttcccctcagggttagcagactaagtctatggggcaaatctggccac

SEQ ID NO: 3706 - DNA, 235 bp, Homo sapiens
  CDS 75..233
  misc_feature 38: y=c or t
  misc_feature 115: r=a or g
  misc_feature 125: y=c or t
  misc_feature 128: y=c or t
  misc_feature 129: m=a or c
  misc_feature 146: r=a or g
  UNSURE 14: Xaa=Lys or Arg
  UNSURE 19: Xaa=Lys or Gln
atcagacctgcaagttgccctcttgctttttccgtaaycctcatcactttaatcatccctttgaggactcagcaatgaccagagggtgctgggaagggcgagcactacttcgcargcacgggatyctymagcaccaggggaacacrgtagttccaggaagttctgggtgttcctggggagagagcggcttgtcatttcggaggccagggaaaggggcctcctgccaccgcctgcc

SEQ ID NO: 3707 - DNA, 259 bp, Homo sapiens
  CDS 11..259
  misc_feature 133: y=c or t
aatacttttaatgcttatagtatatattgtgatgggccttgctgggggatactggactaaacagcccctccccccctttttttttctgaggcggagtctcagtctgtccaggctggagtgcattggcgcaatytcttctcactgcaacctctgccgcccaggttcaagcgattttcttgcctcagcctcccaagtagctggtattacaggcgcctgccactgtgcccggctaatttttgtatttttagtagagacggga

SEQ ID NO: 3708 - DNA, 440 bp, Homo sapiens
  CDS 180..440
  misc_feature 151: m=a or c
  misc_feature 155: s=g or c
  misc_feature 162: k=g or t
  misc_feature 184: n=a, g, c or t
  misc_feature 323: w=a or t
  misc_feature 343: n=a, g, c or t
  misc_feature 397: m=a or c
  misc_feature 400: m=a or c
  UNSURE 2: Xaa=Lys or Met or Arg or Thr
  UNSURE 55: Xaa=Ala or Asp or Gly or Val
  UNSURE 73: Xaa=Ala or Asp
  UNSURE 74: Xaa=Lys or Thr
attgaagatcgatttgacaaatatcttgatccgtccttttttcaacatcggattcattggttttcaattttcaactccttcatgatggtgatcttcttggtgggcttagtttcaatgattttaatgagaacattaagaaaagaattaatgmctcsggtacaktaaagaggaagaaatggatgangatggatagagacctaggagatgaatatggatggaaacaggtgcatggagatgtatttagaccatcaagtcacccactgatattttcctctctgattggttctggatgtcagatatttgctgtgtctctcatcgttatwattgttgcaatgatagaagntttatatactgagaggggatcaatgctcagtacagccatatttgtctatgctgmtamgtctcccagtgaatggttattttggaggaagtctgtatgc

SEQ ID NO: 3709 - DNA, 277 bp, Homo sapiens
  CDS 112..276
  misc_feature 126: d=a or g or t
  misc_feature 127: m=a or c
  UNSURE 5: Xaa= *  or Cys or Trp
  UNSURE 6: Xaa=His or Asn
ctgattttctttgacagtttttattgcccatgtatttttttcagctttgttgaggtataattgataaatccaaaatatatatttaaggtatgcaatgtgatgctttgatgtatgtatggattgtgdmatgattaccacagtgaagctaatcaatatgttcgtcagctcacctcagtacccgtttttttgtgtgtgtttgtgtgtgtggtgagaaaacctgtgatttactctcagcagatttcaagtacacaatctattgtcattaactaccgtcccc

SEQ ID NO: 3710 - DNA, 335 bp, Homo sapiens
  CDS 100..333
  misc_feature 7: m=a or c
  misc_feature 34: w=a or t
  misc_feature 69: w=a or t
  misc_feature 112: k=g or t
  misc_feature 260: n=a, g, c or t
  misc_feature 278: r=a or g
  misc_feature 296: w=a or t
  misc_feature 319: n=a, g, c or t
  UNSURE 5: Xaa=Phe or Val
  UNSURE 54: Xaa= *  or Leu or Ser or Trp
  UNSURE 60: Xaa=Asp or Gly
  UNSURE 66: Xaa=Asp or Val
  UNSURE 74: Xaa=Asp or His or Asn or Tyr
ttacggmatggcggccacctgcatataaaaatawaacttagtggagagatcactataaatactgatgawattgatttggctggtgatatcatccagtcaatggcatcatttkttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagttngctggtcggagctgaggrtgctcgtctgatgagggwcatgaaaacaatgaagagtcgtnatatggaactctatga

SEQ ID NO: 3711 - DNA, 375 bp, Homo sapiens
  CDS 121..375
  misc_feature 129: n=a, g, c or t
  misc_feature 133: k=g or t
  misc_feature 136: m=a or c
  misc_feature 139: m=a or c
  misc_feature 143: h=a or c or t
  misc_feature 150: d=a or g or t
  misc_feature 158: w=a or t
  misc_feature 159: k=g or t
  misc_feature 160: h=a or c or t
  misc_feature 248: m=a or c
  misc_feature 321: m=a or c
  misc_feature 323: m=a or c
  misc_feature 334: m=a or c
  misc_feature 335: w=a or t
  misc_feature 343: w=a or t
  UNSURE 3: Xaa=Asp or Glu
  UNSURE 5: Xaa=Cys or Gly
  UNSURE 6: Xaa=Lys or Gln
  UNSURE 7: Xaa=Pro or Thr
  UNSURE 8: Xaa=Leu or Pro or Gln
  UNSURE 10: Xaa=Lys or Asn
  UNSURE 13: Xaa=Asp or Glu or Val
  UNSURE 14: Xaa=His or Asn or Tyr
  UNSURE 43: Xaa=Ala or Asp
  UNSURE 67: Xaa=Asp or Glu
  UNSURE 68: Xaa=Pro or Gln
  UNSURE 72: Xaa=Lys or Leu or Met or Gln
  UNSURE 75: Xaa=Leu or Met
gaggactacaccagtttggcaaaatcattgctcttcgtgaccacctccagtttccagctggcttcctgatcaaaggttcctgatgttattagcagcataaggcaattatctaaagcggccatgaaaganggakgcmaamccchggcaaadataaatgwkhacgccttttacaactctcagaagttcgaagtcctgtactgtggaaaggtgaccgtgacccacaagaaggccccctcaagcctcatcgmtgactgcatggagaagttcagcctgcacgaacagcagcgcctgaagatccaaggcgagcagcgcggtccggamcmaggagaggacmwggctgacwtggaggtggtggtgcccgggtcccccggaaga

SEQ ID NO: 3712 - DNA, 401 bp, Homo sapiens
  CDS 119..400
  misc_feature 131: k=g or t
  misc_feature 155: s=g or c
  misc_feature 302: y=c or t
  misc_feature 315: n=a, g, c or t
  misc_feature 316: n=a, g, c or t
  misc_feature 374: h=a or c or t
  misc_feature 380: m=a or c
  UNSURE 5: Xaa=Cys or Gly
  UNSURE 13: Xaa=Ala or Pro
  UNSURE 62: Xaa=Phe or Leu
  UNSURE 66: Xaa=Ile or Lys or Met or Asn or Arg or Ser or Thr
  UNSURE 86: Xaa=Leu or Met
  UNSURE 88: Xaa=Lys or Gln
cccttctttttcctccctcccctccaaccgcgccccccctcccggatggggaaaaaaaaagatgtcagctcctccgctgtagtattgctccttaaaaacccctctctctgaaaatgacatgccctcgcaakgtaactccgaactcgtacgcggasccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcytcgccctcaacanntatccgtcctacctctcgcagctggactcctggggcgaccccaaagccgcctatcgchtggaamaacctgttggcaggccgctgt

SEQ ID NO: 3713 - DNA, 314 bp, Homo sapiens
  CDS 114..314
  misc_feature 100: r=a or g
  misc_feature 178: n=a, g, c or t
  misc_feature 241: d=a or g or t
  misc_feature 242: w=a or t
  misc_feature 264: r=a or g
  misc_feature 265: n=a, g, c or t
  misc_feature 266: y=c or t
  misc_feature 303: d=a or g or t
  UNSURE 22: Xaa=Ala or Glu or Gly or Val
  UNSURE 43: Xaa=His or Leu or Gln or Arg
  UNSURE 51: Xaa=Ala or Asp or Gly or Ile or Asn or Ser or Thr or Val
  UNSURE 64: Xaa=Phe or Ile or Val
gtagagggtttcatcatgttggccaggatggtctcaatctcttgacctcatgatccgcccgcctcggcctcccaaggtgctgggattgcaggcgtgagcraccatacccggccatgtgtgatttagttctatgcaatattatcacctgtgtcaattcctctgaacactacagtcaagnatatagagtagttccatcacaggaattcctcatgctacccttctacagccaaaccacctcacdwttctaccctcaccaccatcaarnycccatgaaaccactcgtctggtctccatctccttttdtccccctccac

SEQ ID NO: 3714 - DNA, 239 bp, Homo sapiens
  CDS 66..239
  misc_feature 135: m=a or c
  UNSURE 24: Xaa=Arg or Ser
tccacaccaaaaccccatctgcatgtcaccatcatcaaagaccaaaggtagataaaaccacaaagatggggaaaaaacagaacagaaaaactgaaaattctaaaaatcagagaacctcttcttctccaaaggaamgcagctcctcaccagcagcggaacaaagctggatggagaatgactttgatgagttgagagaagaaggcttcagacgatcaaacttctccgagctaaaggaggag

SEQ ID NO: 3715 - DNA, 207 bp, Homo sapiens
  CDS 7..207
  misc_feature 190: s=g or c
  UNSURE 62: Xaa=Leu or Val
ttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccstgcaactcaggacccca

SEQ ID NO: 3716 - DNA, 457 bp, Homo sapiens
  CDS 15..455
  misc_feature 128: m=a or c
  misc_feature 138: r=a or g
  misc_feature 144: m=a or c
  misc_feature 151: d=a or g or t
  misc_feature 152: s=g or c
  misc_feature 159: h=a or c or t
  misc_feature 170: k=g or t
  misc_feature 171: h=a or c or t
  misc_feature 221: k=g or t
  misc_feature 222: v=a or c or g
  misc_feature 440: r=a or g
  UNSURE 38: Xaa= *  or Tyr
  UNSURE 42: Xaa=Met or Val
  UNSURE 44: Xaa=Pro or Thr
  UNSURE 46: Xaa=His or Leu or Gln or Arg
  UNSURE 49: Xaa=Phe or Ile or Leu
  UNSURE 53: Xaa=His or Asn or Tyr
  UNSURE 70: Xaa=Glu or Lys or Gln
atttcagcctggcgatgtccagcaaccgcccggtggaaattgtcgaagatccccgggtcgtcgggatctggaccaaaaacaaggagctggagctgtcggtgcccaaattcaagatcgatgagttctamgtgggcccgrtgcctmcgaagcdsgtgacahttgccaagctkhatgataacatccgtgaaaacttcctgagggacatgtgcaagaagtatggkvaggtggaggaggtggagattttgtacaaccccaagaccaagaagcacctgggcattgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccaraccctcccagtgggcga

SEQ ID NO: 3717 - DNA, 244 bp, Homo sapiens
  CDS 56..244
  misc_feature 123: n=a, g, c or t
  misc_feature 124: n=a, g, c or t
  misc_feature 181: w=a or t
  UNSURE 23: Xaa=Ala or Asp or Glu or Gly or Val
  UNSURE 42: Xaa=Phe or Leu
aatctcacggatatcctctgttgggggagaagagtcttgctctgtcgcccccaggatggtgtttagtggcatgatctcggctcactgcaacatacccctcctgggttcaagtgattcttctgnntcagcctcccaagtagctgggattacaggtgtgcaccaccacacctggctaattttwgtatttttagtagagatgggctttcgccatgttggccaggctggtctcaaactccggacctca

SEQ ID NO: 3718 - DNA, 257 bp, Homo sapiens
  CDS 92..256
  misc_feature 194: b=c or g or t
  UNSURE 35: Xaa= *  or Glu or Gln
aactgaatggcgttgaaaccctgccggggacctcgtggcattccatgaaacgacctcatcacaggggaatgaactttatcttgaaggctagatgagaatctgtctatgttgcccaggctggtctccaactcctgacttcaagcaatcctcctgcctcagcctcccaaagtgctgggattacaggcatgagccabagtgcccagccccactcccattttctgaatctttcagaatttcagattgccttaaactgccca

SEQ ID NO: 3719 - DNA, 244 bp, Homo sapiens
  CDS 80..244
agaaaacaccactaaagccccagcacaggagagaaccacccagcccagaagttccagggaaggaactctccggtccaccatggagtacctctcagctctgaaccccagtgacttactcaggtcagtatctaatataagctcggagtttggacggagggtctggacctcagctccaccaccccagcgacctttccgtgtctgtgatcacaagcggaccatccggaaaggcctgacagctgccttc

SEQ ID NO: 3720 - DNA, 404 bp, Homo sapiens
  CDS 160..402
  misc_feature 238: k=g or t
  misc_feature 239: n=a, g, c or t
  misc_feature 368: w=a or t
  misc_feature 369: n=a, g, c or t
  UNSURE 27: Xaa= *  or Ala or Glu or Gly or Leu or Ser or Val
  UNSURE 70: Xaa=His or Leu or Gln
aacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatknagctgcttataactgtactcttcgcccagtttcaaaaaaaaagatttacatgacgtgccctgactgcccaagctccatacccactgactcttccaatcaccaagtgctggaggctgccaccgagtctcwngcgaaatacaacaatgagaacacatccaagcagta

SEQ ID NO: 3721 - DNA, 526 bp, Homo sapiens
  CDS 132..464
  sig_peptide 132..176: score 9.3 seq ALVLLLCIGALLG/HS
  misc_feature 342: w=a or t
  misc_feature 422: s=g or c
  UNSURE 56: Xaa=Cys or Ser
  UNSURE 82: Xaa=Asp or Glu
aatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccwgcacgagccccacgaccaacgtgctcctgtctcctctcagtgtggccacggccctctcggccctctcgctgggagcggasagcgaacagaatccatcattcaccgggctctctactatgacttgatcagcagcccagacatccatggtacctataaggagctccttgacacggtcaccgccccc

SEQ ID NO: 3722 - DNA, 660 bp, Homo sapiens
  CDS 244..588
  sig_peptide 244..297: score 5.1 seq VFLLFLCFHLRFC/KV
  misc_feature 547: n=a, g, c or t
  misc_feature 548: r=a or g
  misc_feature 613: n=a, g, c or t
  misc_feature 614: n=a, g, c or t
  misc_feature 644: w=a or t
  UNSURE 84: Xaa=Cys or Asp or Gly or His or Asn or Arg or Ser or Tyr
gtggaaacaagttcctattggtcacctccctcagctctttaatgggaaggccattttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttanrtaacggaacatgcacagccgaagaaagtttagtgtttccttgaagcatggaaatacagattcagnnggaatagttgaagtaaaacttgtggaccawgataagacaatgttca

SEQ ID NO: 3723 - DNA, 507 bp, Homo sapiens
  CDS 43..477
  sig_peptide 43..99: score 9.8 seq GIFLFLCSTPAWA/KE
  misc_feature 254: k=g or t
  misc_feature 255: k=g or t
  misc_feature 338: y=c or t
  UNSURE 52: Xaa=Leu or Arg
  UNSURE 80: Xaa=Ala or Val
attttacttcatttcttctcaggctccaagaaggggaaaaaaatgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccckktatcttcagtacacagatgaaacctttaggacaactatagaaaaaccggtctggcttgggtttttaggccctattatcaaagytgaaactggagataaagtttatgtacacttaaaaaaccttgcctctaggccctacacctttcattcacatggaatacttactataaggaacatgagggggccatctaccctgataacaccacagattttcaagagcagatgacaaagtatatcaggagagcagtataca

SEQ ID NO: 3724 - DNA, 442 bp, Homo sapiens
  CDS 58..423
  sig_peptide 58..114: score 10.8 seq ILFLVAAATGAHS/QV
  misc_feature 124: y=c or t
  misc_feature 184: r=a or g
  misc_feature 218: n=a, g, c or t
  misc_feature 272: s=g or c
  misc_feature 289: r=a or g
  misc_feature 301: r=a or g
  misc_feature 304: y=c or t
  misc_feature 327: n=a, g, c or t
  misc_feature 355: w=a or t
  misc_feature 360: n=a, g, c or t
  misc_feature 369: n=a, g, c or t
  misc_feature 376: y=c or t
  UNSURE 24: Xaa=Ala or Thr
  UNSURE 35: Xaa=Ile or Asn or Ser or Thr
  UNSURE 53: Xaa=Ala or Gly
  UNSURE 59: Xaa=Asp or Asn
  UNSURE 63: Xaa=Glu or Lys
  UNSURE 64: Xaa=Phe or Leu
  UNSURE 81: Xaa=Leu or Met
  UNSURE 82: Xaa=Asp or Glu
  UNSURE 85: Xaa=Arg or Ser
  UNSURE 88: Xaa=Pro or Ser
atcacccaaaaaccacacccctccttgggagaatcccctagatcacagctcctcaccatggactggacctggagcatccttttcttggtggcagcagcaacaggtgcccactcccaggttcagytggtgcagtctggagctgaggtgaagaagcctggggcctcagtgaaggtctcctgcaagrcttctggttacacctttaccagctatggtatcanctgggtgcgacaggcccctggacaagggcttgagtggatgggatggatcagcgsttacaatggtaacacaractatgcacagragytccagggcagagtcaccatgacnacagacacatccacgaacacagcctacwtgganctgaggagnctgagayctgacgacacggccgtgtattactgtgcgagaccgatgggattactttgagagtcgtggtagatga

SEQ ID NO: 3725 - DNA, 458 bp, Homo sapiens
  CDS 83..442
  sig_peptide 83..139: score 11.9 seq LSLVLAVLQGVFA/EV
  misc_feature 33: y=c or t
  misc_feature 38: y=c or t
  misc_feature 39: r=a or g
  misc_feature 57: k=g or t
  misc_feature 62: y=c or t
  misc_feature 63: m=a or c
  misc_feature 434: n=a, g, c or t
  UNSURE 99: Xaa=Gly or Arg or Trp
aaacccagggctcccctccacagtgagtctccytcacyrcccagctgggatctcagkgcttymttttctgtcctcctccaggatggggtcaaccgtcatcctttccctcgtcctggctgttctccaaggtgtctttgccgaggtgcagctgttgcagtctgcagcagaggtgaaaagacccggggagtctctgaggatctcctgtaagacttctggatacagctttaccagctactggatccactgggtgcgccagatgcccgggaaagaactggagtggatggggagcatctatcctgggaactctgataccagatacagcccatccttccaaggccacgtcaccatctcagccgacagctccagcagcaccgcctacctgcagtggagcagcctgaaggcctcggacgccgccatgtattattgtgtgaganggaccatctaaaaccttccgcggt

SEQ ID NO: 3726 - DNA, 438 bp, Homo sapiens
  CDS 62..379
  sig_peptide 62..118: score 9.9 seq FLFVVAAATGVQS/QV
  misc_feature 188: r=a or g
  misc_feature 213: m=a or c
  misc_feature 273: y=c or t
  misc_feature 274: n=a, g, c or t
  misc_feature 277: w=a or t
  misc_feature 278: n=a, g, c or t
  misc_feature 281: w=a or t
  misc_feature 290: r=a or g
  misc_feature 304: s=g or c
  misc_feature 319: s=g or c
  UNSURE 24: Xaa=Ala or Thr
  UNSURE 32: Xaa=Ser or Tyr
  UNSURE 52: Xaa=Ile or Met or Thr
  UNSURE 54: Xaa=Phe or Ile or Leu or Val
  UNSURE 55: Xaa=Phe or Ile
  UNSURE 58: Xaa=Asp or Asn
  UNSURE 62: Xaa=Lys or Asn
agcatcacataacaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaagrcttctggaggcaccttcagcagctmtgctatcagctgggtgcgacaggcccctggacaagggcttgagtggatgggagggatcaynccwntcwttacagcaractacgcacagaasttccagggcagagtstccgattaccgcggacgaatccacgagcacaacctacatggaattgagcagcctgagatctgaggacacggccgtctattactgtgcgagagaggcgcgggaatggcagtggctggtgt

SEQ ID NO: 3727 - DNA, 470 bp, Homo sapiens
  CDS 62..382
  sig_peptide 62..118: score 9.9 seq FLFVVAAATGVQS/QV
  misc_feature 127: r=a or g
  misc_feature 210: n=a, g, c or t
  misc_feature 217: k=g or t
  misc_feature 222: r=a or g
  misc_feature 271: m=a or c
  misc_feature 273: y=c or t
  misc_feature 277: w=a or t
  misc_feature 278: w=a or t
  misc_feature 286: n=a, g, c or t
  misc_feature 290: s=g or c
  misc_feature 303: m=a or c
  misc_feature 315: r=a or g
  misc_feature 325: s=g or c
  misc_feature 353: n=a, g, c or t
  misc_feature 354: n=a, g, c or t
  misc_feature 355: n=a, g, c or t
  misc_feature 356: n=a, g, c or t
  misc_feature 394: m=a or c
  misc_feature 414: n=a, g, c or t
  misc_feature 416: y=c or t
  misc_feature 428: r=a or g
  misc_feature 449: n=a, g, c or t
  misc_feature 450: r=a or g
  misc_feature 451: n=a, g, c or t
  UNSURE 31: Xaa=Ile or Asn or Ser or Thr
  UNSURE 35: Xaa=Asn or Ser
  UNSURE 52: Xaa=Ile or Thr
  UNSURE 54: Xaa=Phe or Ile
  UNSURE 58: Xaa=Ala or Pro
  UNSURE 62: Xaa=Pro or Gln
  UNSURE 66: Xaa=Asp or Gly
  UNSURE 79: Xaa=any one of the twenty amino acids
  UNSURE 80: Xaa=Ile or Leu or Val
agcatcacataacaaccacattcctcctctaaagaagcccctgggagcacagctcatcaccatggactggacctggaggttcctctttgtggtggcagcagctacaggtgtccagtcccaggtgcarctggtgcagtctggggctgaggtgaagaagcctgggtcctcggtgaaggtctcctgcaaggcttctggaggcaccttcagcanctatgckatcarctgggtgcgacaggcccctggacaagggcttgagtggatgggagggatmaycccwwtctttggnacascaaactacgcacmgaagttccaggrcagagtcacsattaccgcggacgaatccacgaacaccnnnntatatgggactgaccagcctgacatctgaggacacggmcatttactactgtgcgagangyccggcgccttcrgtgactacatatcgtccttanrnttactactacggtatggac

SEQ ID NO: 3728 - DNA, 378 bp, Homo sapiens
  CDS 50..370
  sig_peptide 50..106: score 9.9 seq FLFVVAAATGVQS/QV
  misc_feature 19: r=a or g
  misc_feature 39: r=a or g
  misc_feature 113: m=a or c
  misc_feature 120: w=a or t
  misc_feature 132: m=a or c
  misc_feature 137: n=a, g, c or t
  misc_feature 139: n=a, g, c or t
  misc_feature 141: s=g or c
  misc_feature 233: m=a or c
  misc_feature 321: m=a or c
  misc_feature 322: n=a, g, c or t
  misc_feature 323: n=a, g, c or t
  misc_feature 339: y=c or t
  UNSURE 3: Xaa=Lys or Gln
  UNSURE 5: Xaa=Glu or Val
  UNSURE 9: Xaa=Lys or Thr
  UNSURE 11: Xaa=Phe or Ile or Leu or Met or Val
  UNSURE 12: Xaa=Arg or Thr
  UNSURE 43: Xaa=Lys or Gln
  UNSURE 72: Xaa=Ala or Asp or Glu
  UNSURE 73: Xaa=Asp or His or Asn or Tyr
  UNSURE 78: Xaa=Ile or Thr
tacaaccattcctcctctraagaagcccctgggagcacrgctcatcaccatggactggacctggaggttcctctttgtggtggcagcagctacaggtgtccagtcccaggtgmagctggwacagtctgggamagggntnasgaagcctgggtcctcagtgaagatctcctgcaaggtttctggagactccttcgccaactatggtatccactgggtgcgacaggcccctggamaagggctggagtggatgggaggcatcgtccctctctttggtacagcagacaacgcacagaggttccagagcaaagtcacgattaccgmnnacagatccacgaccayagtcttcatggaggtgaagcagcctgagatctgacgaca

SEQ ID NO: 3729 - DNA, 495 bp, Homo sapiens
  CDS 1..453
  sig_peptide 1..75: score 3.9 seq RVGLLLGGGGVYG/SR
  misc_feature 356: n=a, g, c or t
  misc_feature 357: m=a or c
  misc_feature 382: r=a or g
  misc_feature 461: r=a or g
  UNSURE 94: Xaa=Ile or Lys or Asn or Arg or Ser or Thr
  UNSURE 103: Xaa=Glu or Lys
atgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaaganmatagagagacaagaagagaaactgragaataacaacagagatctatcaatggttcgaatgaaatccatgtttgctattggcttttgttttactgcctaatgggratgttcaattccatatttgatggtagagtggtgg

SEQ ID NO: 3730 - DNA, 462 bp, Homo sapiens
  CDS 34..375
  sig_peptide 34..93: score 9 seq VVIFATFVTLCNA/SC
agtacctgtctataaggagtcctgcttatcacaatgaatgttctcctgggcagcgttgtgatctttgccaccttcgtgactttatgcaatgcatcatgctatttcatacctaatgagggagttccaggagattcaaccaggaaatgcatggatctcaaaggaaacaaacacccaataaactcggagtggcagactgacaactgtgagacatgcacttgctacgaaacagaaatttcatgttgcacccttgtttctacacctgtgggttatgacaaagacaactgccaaagaatcttcaagaaggaggactgcaagtatatcgtggtggagaagaaggacccaaaaaagacctgttctgtcagtgaatggataatctaatgtgcttctagtaggcacagggctcccaggccaggcctcattctcctctggcctctaatagtcaatgattgtgtagcatgcact

SEQ ID NO: 3731 - DNA, 435 bp, Homo sapiens
  CDS 30..338
  sig_peptide 30..128: score 5 seq LAAARLLSRXSSC/RR
  misc_feature 118: s=g or c
  misc_feature 375: n=a, g, c or t
  UNSURE -4: Xaa=Ser or Thr
tcatcggcaaatacgccagtcattggcgtatgaccgcaacccttgccgctgccgctgacatcgctaccatggtctccggcagcagcggcctcgccgccgcccgtctcctgtcgcgcasttcctcctgccgcagaatggaattcggcattgttcctacacagcttctcggcaacatctctatgttgataaaaatacaaagattatttgccagggtttcactggcaaacagggcacctttcacagccagcaggcattggaatatggcaccaaactcgttggaggaaccactccagggaaaggaggccagacacatctgggcttacctgtctttaatactgtgaaggaggccaaagaacagacaggagcaacggcttntgtcatttatgttcctccgccttttgctgctgctgccattaatgaagctattgaggcaga

SEQ ID NO: 3732 - DNA, 444 bp, Homo sapiens
  CDS 90..419
  sig_peptide 90..185: score 7 seq ITFLLQAIRNTTA/AE
  misc_feature 43: s=g or c
  misc_feature 129: n=a, g, c or t
  misc_feature 364: s=g or c
  UNSURE -19: Xaa=Phe or Ile or Leu or Val
  UNSURE 60: Xaa=Ala or Gly
cttctctctcacgcctagcgcaatggcggcggccgcggcggascagcaacagttctacctgctcctgggaaacctgctcagccccgacaatgtggtccggaaacaggcagaggaaacctatgagaatantcccaggccagtcaaagatcacattcctcttacaagccatcagaaatacaacagctgctgaagaggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggsagaactggccaggaatttaatagatgaggatggcaataaccagtggcccgaagtttgaagttcctttttgattcagtcag

SEQ ID NO: 3733 - DNA, 713 bp, Homo sapiens
  CDS 240..641
  sig_peptide 240..278: score 5.3 seq MLSRVVLSAAATA/AP
  misc_feature 91: k=g or t
  misc_feature 92: k=g or t
  misc_feature 653: r=a or g
  misc_feature 655: s=g or c
  misc_feature 670: m=a or c
  misc_feature 696: r=a or g
  misc_feature 701: r=a or g
gaattgcttctatggctccatcctgctttccggctgtcgccctcatgcgataggctctcagcgttacttgactcttctcgcgataattttkktttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataactcaatgagcaaaaacttgcccaactagaagaggcgrasaggcttccatccaamcatccagaatgcaattgatacggagragtcrcaacaggcactg

SEQ ID NO: 3734 - DNA, 516 bp, Homo sapiens
  CDS 43..408
  sig_peptide 43..87: score 9.4 seq LLTGLVFCSLVLX/VS
  misc_feature 85: r=a or g
  UNSURE -1: Xaa=Gly or Ser
aagacagggacccgcagctcagctacagcacagatcagcaccatgaagcttctcacgggcctggttttctgctccttggtcctgrgtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 3735 - DNA, 583 bp, Homo sapiens
  CDS 124..576
  sig_peptide 124..180: score 12.1 seq TFLLLALSTAAQA/EP
agctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcaatattcagtctaaaagcagcaaggccgtggtgcatggcatcctgatgggcgtcccagttccctttcccattcctgagcctgatggttgtaagagtggaattaactgccctatccaaaaagacaagacctatagctacctgaataaactaccagtgaaaagcgaatatccctctataaaactggtggtggagtggcaacttcaggatgacaaaaaccaaagtctcttctgctgggaaatcccagtacagatcgtttctcatctctaagtgc

SEQ ID NO: 3736 - DNA, 1443 bp, Homo sapiens
  CDS 603..1433
  sig_peptide 603..710: score 4.2 seq LCFFGVALFCGCG/HE
  misc_feature 248: w=a or t
  misc_feature 252: n=a, g, c or t
  misc_feature 253: n=a, g, c or t
  misc_feature 254: n=a, g, c or t
  misc_feature 261: n=a, g, c or t
  misc_feature 335: n=a, g, c or t
  misc_feature 422: k=g or t
  misc_feature 433: k=g or t
  misc_feature 438: s=g or c
aaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggwggcnnngttcttnggctgtggacatgaagccctcactggcacagaaaagctaattgagacctatttctccaaaaaaaaacccccccntaccaagactatgagtatctcatcaatgtgatccatgccttccagtaatgtcatctatggaactgcctctttcttcttcctttttakggggttgctgkcaatsagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacggtaacagggggccagaaggggaggggttccagaggccaacatcaagctcattctttggagcgggtgtgtcattgtttgggaaaatggctaggacatcccgacaagtttgtgggcatcacctatgccctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccg

SEQ ID NO: 3737 - DNA, 521 bp, Homo sapiens
  CDS 85..396
  sig_peptide 85..132: score 6 seq SRLTAVSASWVQA/HP
  misc_feature 111: v=a or c or g
  misc_feature 348: y=c or t
  misc_feature 506: m=a or c
aatcgaaaaactatctcccgggtgaacggagctttcgcagctggagaagacggagtcttgctctgttgcccaggctggagtgcaatggtgcgatctcggctcactgcagtvtccgcctcttgggttcaggctcatccacctgcagacatggggcgcagaaagtcaaaacgaaagccgcctcccaagaagaagatgacaggcaccctcgagacccagttcacctgccccttctgcaaccacgagaaatcctgtgatgtgaaaatggaccgtgcccgcaacaccggagtcatctcttgtaccgtgtgcctagaggaattccagacgcccataacgtatctgtcagaaccygtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtmcagccgtgtgtgtgt

SEQ ID NO: 3738 - DNA, 1066 bp, Homo sapiens
  CDS 43..744
  sig_peptide 43..93: score 9.2 seq VVFLTLSVTWIGA/AP
  misc_feature 307: m=a or c
  misc_feature 341: m=a or c
  UNSURE 72: Xaa=Ile or Leu
  UNSURE 83: Xaa=Asn or Thr
aagccccaagcttaccacctgcacccggagagctgtgtcaccatgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagmtcacggatgctgtgaaggtcatggacctgcccamccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgatctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctgagcacccctatcaactccctattgtagtaaacttggaaccttggaaatgaccaggccaagactcaagcctccccagttctactgacctttgtccttaggtgtgaggtccagggttgctaggaaaagaaatcagcagacacaggtgtagaccagagtgtttcttaaatggtgtaattttgtcctctctgtgtcctggggaatactggccatgcctggagacatatcactcaatttctctgaggacacagataggatggggtgtctgtgttatttgtggggtacagagatgaaagaggggtgggatccacactgagagagtggagagtgacatgtgctggacactgtccatgaagcactgagcagaagctg

SEQ ID NO: 3739 - DNA, 528 bp, Homo sapiens
  CDS 64..408
  sig_peptide 64..147: score 7.8 seq FSLVVFSCGGCWS/VT
tcttttgctctctatggttaggagcgcaacctctcttcggcccggaaagatttaagttcgtgaatgcatacgcaagactcggaggtagttccggttccggcgtggccattttcgttggtggtgttcagttgtggcggttgctggtcagtaacagccaagatgctgcggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactg

SEQ ID NO: 3740 - DNA, 661 bp, Homo sapiens
  CDS 306..629
  sig_peptide 306..353: score 3.9 seq CAKLACTPSLIRA/GS
  misc_feature 63: r=a or g
  misc_feature 622: n=a, g, c or t
  misc_feature 624: n=a, g, c or t
  misc_feature 625: n=a, g, c or t
  UNSURE 90: Xaa=Ile or Asn or Ser or Thr
  UNSURE 91: Xaa=Ala or Cys or Asp or Phe or Gly or His or Ile or Leu or Asn or Pro or Arg or Ser or Thr or Val or Tyr
gtgaaaagcggcccgacctgcttggggtgtagtgggcggaccgcgcggctggaggtgtgaggrtccgaacccaggggtggggggtggaggcggctcctgcgatcgaagaggacttgagactcaccggccgcacgccatgagggccctgtgggtgctgggcctctgctgcgtcctgtgagtcccactccttcgacctctgctgcagcccgtgccgccgccgcctcctgggaagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagcttatcattggttatgccagaaantnntcgctgaagcagcagctgttctcatatgctatcctg

SEQ ID NO: 3741 - DNA, 525 bp, Homo sapiens
  CDS 191..511
  sig_peptide 191..292: score 5.1 seq ASLLNFWNPPTTA/QV
  misc_feature 127: r=a or g
  misc_feature 137: y=c or t
  misc_feature 154: y=c or t
  misc_feature 223: s=g or c
  misc_feature 225: k=g or t
  misc_feature 242: s=g or c
  misc_feature 277: y=c or t
  misc_feature 286: m=a or c
  misc_feature 328: y=c or t
  UNSURE -24: Xaa=His or Gln
  UNSURE -23: Xaa=Leu or Arg
  UNSURE -17: Xaa=Leu or Val
agaactgagagaggaggggacagagaggtgtcctgggcctgaccccgcccatgagcctgagaagtgctcctgccccgggaagaggctcagcacagaaggaggaaggacagcacagctgacagccgtrctcaggaagyttctggatcctaggctyatctccacagaggagaacacacaagcagcagagaccatggggcccctctcagcccctccctgcacacasckcatcacttggaaggggstcctgctcacagcatcacttttaaacttctggaayccgcccacmactgcccaagtcacgattgaagcccagccacccaaagtttcygaggggaaggatgttcttctacttgtccacaatttgccccagaatcttgctggctacatttggtacaaagggcaaatgacatacctctaccattacattacatcatatgtagtagacggtcaaagaattatatatgggcctgcatacagtggaagagaaagagtatattccaatgcatcctgctgatccagaatgtc

SEQ ID NO: 3742 - DNA, 575 bp, Homo sapiens
  CDS 73..546
  sig_peptide 73..141: score 8.6 seq LVLALALILVLES/SV
  misc_feature 164: r=a or g
  UNSURE 8: Xaa=Gln or Arg
acagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcrgagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacacca

SEQ ID NO: 3743 - DNA, 860 bp, Homo sapiens
  CDS 139..741
  sig_peptide 139..192: score 10.5 seq VLTVLSLLPLLEA/QI
  misc_feature 12: s=g or c
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttgggggccatcctgcccctccaacccgacatgtgtacctcagctttttccctcacttgcatcaataaagcttctgtgtttggaac

SEQ ID NO: 3744 - DNA, 562 bp, Homo sapiens
  CDS 132..536
  sig_peptide 132..203: score 10.9 seq LAGLCCLVPVSLA/ED
aatgccttaaacttatgagtaaggaaaataacgattcggggtgacgcccgaatcctcactgctaatgtgagacgaatttttgagctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctcgtaccctcaaccagccagacagccagctccagctgaccaccggcaatggcctgttcctc

SEQ ID NO: 3745 - DNA, 474 bp, Homo sapiens
  CDS 48..413
  sig_peptide 48..116: score 6.2 seq ILYFYALLFLSST/CV
  misc_feature 447: w=a or t
  misc_feature 453: w=a or t
gacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattattgaaatatgaagcatcgatttttaacacatgactcaagtawtcgatwtttgcagggaatatataattc

SEQ ID NO: 3746 - DNA, 489 bp, Homo sapiens
  CDS 126..455
  sig_peptide 126..233: score 9.7 seq LWTVLILFSCCCA/FX
  misc_feature 237: n=a, g, c or t
  misc_feature 281: s=g or c
  misc_feature 361: s=g or c
  misc_feature 378: n=a, g, c or t
  misc_feature 406: m=a or c
  misc_feature 410: n=a, g, c or t
  misc_feature 411: n=a, g, c or t
  misc_feature 422: m=a or c
  UNSURE 2: Xaa=Cys or Gly or Arg or Ser
  UNSURE 16: Xaa=His or Gln
  UNSURE 43: Xaa=Ala or Gly
  UNSURE 49: Xaa=Cys or Gly or Arg or Ser
  UNSURE 58: Xaa=Asn or Thr
  UNSURE 60: Xaa= *  or Glu or Lys or Gln
  UNSURE 63: Xaa=His or Gln
aaccatttctagtcccctttcctcgcaggacctcatgagtaagctgtggcggcgtgggagcacctctggggctatggaggcccctgagccgggagaagccctggagttgagcctggcgggtgcccatggccatggagtgcacaagaaaaaacacaagaagcacctactactatgagctctggtggttctggctgctctggactgtcctcatcctctttagctgctgttgcgccttcngccaccgacgagctaaactcaggctgcaacaacagcagcggcasgtgaaatcaacttgttggcctatcatggggcatgccatggggctggtcctttccctaccggttcactgcttgaccttcgsttcctcagcaccttcangcccccagcctacgaggatgtggttcamcgcnnaggcacaccamcccccccttatactgtggccccaggccgccccttgactgcttccagtgaacaaacctgctgttcctc

SEQ ID NO: 3747 - DNA, 556 bp, Homo sapiens
  CDS 119..457
  sig_peptide 119..241: score 4.6 seq AYLLYILLTGALQ/FG
  misc_feature 451: w=a or t
  misc_feature 452: r=a or g
  UNSURE 70: Xaa=Phe or Leu
  UNSURE 71: Xaa=Ile or Val
aacaccggggagggcggagttaggtcacgagggtgcgcatgcgcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaacttwrttggctgactcattctcatttacttaattgaggagtaggagactaaaagaatgttcactctttgaatttcctggataagagtctggagatggcagcttattgga

SEQ ID NO: 3748 - DNA, 568 bp, Homo sapiens
  CDS 74..520
  sig_peptide 74..151: score 10.8 seq MLPLLWLLPHSWA/VP
  misc_feature 476: w=a or t
  misc_feature 483: k=g or t
  misc_feature 513: w=a or t
  misc_feature 516: r=a or g
  misc_feature 517: w=a or t
  misc_feature 551: m=a or c
  misc_feature 552: w=a or t
  UNSURE 109: Xaa= *  or Lys
  UNSURE 111: Xaa=Leu or Trp
  UNSURE 121: Xaa=Phe or Tyr
  UNSURE 122: Xaa= *  or Cys or Tyr
actctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagtgtactgccaggatgggagtcccagtgtgggactctctgaggcctacgacgaggaccagcttttcttcttcgacttttcccagaacactcgggtgcctcgcctgcccgaatttgctgactgggctcaggaacagggagatgctcctgccattttatttgacaaagagttctgcgagtggatgatccagcaaatagggccaaaacttgatgggaaaatcccggtgtccagagggtttcctatcgctgaagtgttcacgctgwagccctkgagtttggcaagccaacactttggtctgtwttrwcagtaatctcttcccacccatgctgacagtgaamwggcagcatcattccgt

SEQ ID NO: 3749 - DNA, 491 bp, Homo sapiens
  CDS 108..455
  sig_peptide 108..161: score 6.3 seq LLFVGLLLTWESG/QV
  misc_feature 459: n=a, g, c or t
atataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtagccctgcctganacagacctgcatgggtttctacgcacgcgtct

SEQ ID NO: 3750 - DNA, 732 bp, Homo sapiens
  CDS 124..690
  sig_peptide 124..207: score 12.5 seq ILLVLGWVQPSLG/KE
  misc_feature 601: s=g or c
  UNSURE 132: Xaa=Ala or Pro
aaacccctttgtaatctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccagtaccccaactgtgcataccggaccagcccgaaggagagacacatcattgtggcctgtgaagggagcccatatgtgccagtccactttgatgcttctgtggaggactctacctaaggtcagascagcgagataccccacctccctcaacctcatcctctccacagctgcctcttccctcttccttccctgctgtgaaagaagtaactacagttagggctcctattcacacacacatgcttccctttcctgactc

SEQ ID NO: 3751 - DNA, 811 bp, Homo sapiens
  CDS 203..769
  sig_peptide 203..286: score 12.5 seq ILLVLGWVQPSLG/KE
  misc_feature 359: k=g or t
  misc_feature 680: s=g or c
  UNSURE 25: Xaa=Asp or Tyr
  UNSURE 132: Xaa=Ala or Pro
tgatgtttcgatgagccatttgagcactgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacckactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccagtaccccaactgtgcataccggaccagcccgaaggagagacacatcattgtggcctgtgaagggagcccatatgtgccagtccactttgatgcttctgtggaggactctacctaaggtcagascagcgagataccccacctccctcaacctcatcctctccacagctgcctcttccctcttccttccctgctgtgaaagaagtaactacagttagggctcctattcacacacacatgcttccctttcctgactc

SEQ ID NO: 3752 - DNA, 813 bp, Homo sapiens
  CDS 207..671
  sig_peptide 207..290: score 12.5 seq ILLVLGWVQPSLG/KE
  misc_feature 497: n=a, g, c or t
  misc_feature 514: r=a or g
  misc_feature 682: s=g or c
  UNSURE 69: Xaa=Arg or Ser
  UNSURE 75: Xaa=Gln or Arg
aaacccctttgtaatctgtataaggtccacaccccgggagctgagtgattgcagaaactggccttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggagncaactgctacaagagcractccagcatgcacatcacagactgccgcctgacaaacggctccagtaccccaactgtgcataccggaccagcccgaaggagagacacatcattgtggcctgtgaagggagcccatatgtgccagtccactttgatgcttctgtggaggactctacctaaggtcagascagcgagataccccacctccctcaacctcatcctctccacagctgcctcttccctcttccttccctgctgtgaaagaagtaactacagttagggctcctattcacacacacatgcttccctttcctgactc

SEQ ID NO: 3753 - DNA, 473 bp, Homo sapiens
  CDS 22..438
  sig_peptide 22..105: score 9.4 seq ASLVLAFLGVCLG/IT
  misc_feature 473: m=a or c
aaggagcaaactctgcacaagatggcggcggtagcggcagtggcggcgcgtaggaggcggtcttgggcgtctttggtactggcttttttaggggtctgcctggggattacccttgctgtggatagaagcaactttaagacctgtgaagagagttctttctgcaagcgacagagaagcatacggccaggcctctctccataccgagccttgctggactctctacagcttggtcctgattccctcacggtccatctgatccatgaggtcaccaaggtgttgctggtgctagagcttcaggggcttcaaaagaacatgactcggttcaggattgatgagctggagcctcggcgaccccgataccgtgtaccagatgttttggtggctgatccaccaatagccggctttctgtctctggtcgtgatgagaacagtgtggagttaacatggctgagggacctacaagatcatcttgam

SEQ ID NO: 3754 - DNA, 606 bp, Homo sapiens
  CDS 168..548
  sig_peptide 168..257: score 9.3 seq LFWLCGILILALA/IW
  misc_feature 314: s=g or c
  misc_feature 377: m=a or c
  misc_feature 385: s=g or c
  misc_feature 480: n=a, g, c or t
  misc_feature 539: n=a, g, c or t
  misc_feature 540: s=g or c
  UNSURE 43: Xaa=Ala or Gly
  UNSURE 75: Xaa=Ile or Leu or Val
  UNSURE 94: Xaa=Lys or Asn
  UNSURE 95: Xaa=Glu or Gln
agtttaataactttttattcctccctctacttctttgctttctctttctgctctgaagccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggstctagctcctacgttgctgtggacatattgattgctgtaggtgccatcatcatgattctgggmttcctggsatgctgcggtgctataaaagaaagtcgctgcatgcttctgttgtttttcataggcttgcttctgatcctgctcctgcaggtggcgacaggtatcntaggagctgttttcaaatctaagtctgatcgcattgtgaatgaaactctctatgaaaansaaagcttttgagcgccacaggggaaagtgaaaaacaattccaggaagccataattgtgtttcaaga

SEQ ID NO: 3755 - DNA, 618 bp, Homo sapiens
  CDS 180..560
  sig_peptide 180..269: score 9.3 seq LFWLCGILILALA/IW
  misc_feature 326: s=g or c
  misc_feature 397: s=g or c
  misc_feature 492: n=a, g, c or t
  misc_feature 551: n=a, g, c or t
  misc_feature 552: s=g or c
  UNSURE 43: Xaa=Ala or Gly
  UNSURE 75: Xaa=Ile or Leu or Val
  UNSURE 94: Xaa=Lys or Asn
  UNSURE 95: Xaa=Glu or Gln
agtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggstctagctcctacgttgctgtggacatattgattgctgtaggtgccatcatcatgattctgggcttcctggsatgctgcggtgctataaaagaaagtcgctgcatgcttctgttgtttttcataggcttgcttctgatcctgctcctgcaggtggcgacaggtatcntaggagctgttttcaaatctaagtctgatcgcattgtgaatgaaactctctatgaaaansaaagcttttgagcgccacaggggaaagtgaaaaacaattccaggaagccataattgtgtttcaaga

SEQ ID NO: 3756 - DNA, 476 bp, Homo sapiens
  CDS 102..464
  sig_peptide 102..197: score 5.3 seq VIFTVLLQSLCVA/VT
  misc_feature 145: m=a or c
  UNSURE -18: Xaa=Asn or Thr
tttttttttcatttcctcactgactataaaagaatagagaaggaagggcttcagtgaccggctgcctggctgacttacagcagtcagactctgacaggatcatggctatgatggaggtccaggggggacccagcctgggacagamctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtctcagagagtagcagctcaca

SEQ ID NO: 3757 - DNA, 463 bp, Homo sapiens
  CDS 89..454
  sig_peptide 89..223: score 7.2 seq SFALCMFVAAAGA/YV
  misc_feature 154: r=a or g
gtcagagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcracgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgcctggagttttgtattgctgtcaaccccagcatccttcccactgctttcatgggcacagcaatgatcttta

SEQ ID NO: 3758 - DNA, 509 bp, Homo sapiens
  CDS 106..492
  sig_peptide 106..180: score 8.9 seq IIAVLMSAQESWA/IK
  misc_feature 87: m=a or c
aatggtcagactctattacaccccacattctcttttcttttattcttgtctgttctgcctcactcccgagctctactgactcccaamagagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccttaggctgaggcaggagaatggc

SEQ ID NO: 3759 - DNA, 498 bp, Homo sapiens
  CDS 162..491
  sig_peptide 162..233: score 4.7 seq LLMIRSTAAATRS/SR
tgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaggcgccctggtggctcttgatgatcaggtccacggcggctgccacacgctcctctaggcccttcagcggcagcagcgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgct

SEQ ID NO: 3760 - DNA, 500 bp, Homo sapiens
  CDS 70..378
  sig_peptide 70..129: score 6.9 seq AAFLSPLLPLLLG/FL
cacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagcgaacatggagctgagtgagaaatacaagctggacaaagagagctacccagtcttctacctcttccgggatggggactttgagaaccagtcccatacactggggcagttaaaggttggagccatccagcgctgg

SEQ ID NO: 3761 - DNA, 526 bp, Homo sapiens
  CDS 116..418
  sig_peptide 116..166: score 10.4 seq LLPALFLVLLVLG/FE
  misc_feature 430: n=a, g, c or t
  misc_feature 431: n=a, g, c or t
  misc_feature 432: m=a or c
aaaaggatgggggttgtggctgtggagcggaagtgggtctcaaccactataaagcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagannmccccatcagtggacaaggggagagtcccctactcccctgatcccccaggttcagactgagctcccccttcccagtagctcttgcatcctccccc

SEQ ID NO: 3762 - DNA, 445 bp, Homo sapiens
  CDS 74..385
  sig_peptide 74..145: score 6.5 seq LSICLSAVATATG/AE
  misc_feature 11: w=a or t
  misc_feature 13: k=g or t
  misc_feature 348: n=a, g, c or t
  misc_feature 349: n=a, g, c or t
  misc_feature 380: r=a or g
  misc_feature 381: r=a or g
  misc_feature 421: s=g or c
  UNSURE 68: Xaa=Ala or Asp or Glu or Gly or Val
  UNSURE 79: Xaa=Asp or Gly or Asn or Ser
agcgacgaggwckcgcctgcgcagaggcggcagcaccaccggggttgactccgggggcgcggcgaggagagacatgaggctgagctggttccgggtcctgacagtactgtccatctgcctgagcgccgtggccacggccacgggggccgagggcaaaaggaagctgcagatcggggtcaagaagcgggtggaccactgtcccatcaaatcgcgcaaaggggatgtcctgcacatgcactacacggggaagctggaagatgggacagagtttgacagcagcctgccccagaaccagccctttgtcttctcccttggcacaggccaggtcatcaagggctgggaccaggnnctgctggggatgtgtgagggggaaaagcgcrrctggtgatcccatccgagctagggtatggagagcggggastcccccaaagattccaggcggtgc

SEQ ID NO: 3763 - DNA, 651 bp, Homo sapiens
  CDS 1..345
  sig_peptide 1..51: score 4.4 seq AWATALFSSNVFP/LP
  misc_feature 112: w=a or t
  misc_feature 260: k=g or t
  misc_feature 268: w=a or t
  misc_feature 523: s=g or c
  misc_feature 524: m=a or c
  UNSURE 21: Xaa=Cys or Ser
  UNSURE 70: Xaa=Leu or Arg
  UNSURE 73: Xaa= *  or Lys
atgccactccccgcctgggccactgctttgttttcttctaatgtttttcctctacctgggttggctgtttcttcattcatatttgagaagaatcacctcctaattaaatgtwgcaacttcgctctctccctacatgaaggctgtcttggttacccgactaggcaacgcgcattggtatcaaattaccgaaagtctacaccggagcagtcctcatatttacatacaaataactcaggggcttgcatttatgtcaccattckgtcctgcwagaggcttgccagaggagtttttaatccaatcagaaggagctttaaaaggatgtctgcgaagtggtcaaaaggatcttaacctcaattaagtggggttttttaaaaagattttttggggggcctgaaattttgaaaatcttcgaactctgagtggggaaagatgtataattcctcaattgcctacgaggatatcaagatgctgagaggaattcagcggtggtgaagagagtggatacaaaccagggattggtttsmttgagctgttttggaggttgattctaaatcactgcttaaggaattcctggaaacatcaggaaaacatttgatcatccaagcctagtggaaatggctttaccgcagagtgaagatgcaatgaccgggc

SEQ ID NO: 3764 - DNA, 584 bp, Homo sapiens
  CDS 84..434
  sig_peptide 84..164: score 3.6 seq ACLLCSLVKTIDQ/FE
  misc_feature 18: w=a or t
  misc_feature 472: m=a or c
  misc_feature 510: n=a, g, c or t
  misc_feature 516: m=a or c
  misc_feature 560: r=a or g
  misc_feature 571: m=a or c
attctgggtaacgagctwtttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccamctcctgcctctgcttatttcttgttctggactaaatgnacagamttcaaatacttcctaccctccaattcagactcagctgactgttragagagcagcmcatcattttatca

SEQ ID NO: 3765 - DNA, 448 bp, Homo sapiens
  CDS 94..426
  sig_peptide 94..219: score 7.4 seq SLSVLVLLLTIIA/VT
  misc_feature 320: m=a or c
  misc_feature 414: r=a or g
  UNSURE 34: Xaa=Asn or Thr
  UNSURE 65: Xaa= *  or Trp
gagatgtgcaagtggcgaacttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccamcactgagccttgtacagactttttcaaatatgcttgcggaggctggttgaaacgtaatgtcattcccgagaccagctcccgttacggcctttgrcattttaagagatgaactagaagtcgttttgaaa

SEQ ID NO: 3766 - DNA, 447 bp, Homo sapiens
  CDS 69..398
  sig_peptide 69..131: score 9.1 seq LLSGALALTETWA/GS
  misc_feature 40: r=a or g
  misc_feature 87: m=a or c
  misc_feature 104: r=a or g
  misc_feature 161: m=a or c
  misc_feature 162: k=g or t
  misc_feature 185: r=a or g
  misc_feature 201: k=g or t
  misc_feature 263: k=g or t
  misc_feature 275: m=a or c
  misc_feature 283: r=a or g
  misc_feature 285: r=a or g
  misc_feature 314: r=a or g
  UNSURE -15: Xaa=Ile or Leu
  UNSURE 11: Xaa=Ala or Ser
  UNSURE 24: Xaa=Ala or Ser
  UNSURE 44: Xaa=Asp or Glu
  UNSURE 51: Xaa=Asp or Gly
  UNSURE 52: Xaa=Gly or Arg
agtcccggttctaaagtccccagtcacccacccggactcrgattctccccagacgccgagatgcggtcatggcgccccgaaccctcmtcctgctgctctcgggrgccctggccctgaccgagacctgggccggctcccactccatgaggtatttctacacmkccgtgtcccggcccggccgcggrgagccccgcttcatckcagtgggctacgtggacgacacgcagttcgtgcggttcgacagcgacgccgcgagccaagakggagccgcgggmgccgtggrtrgagcaggaggggccggagtattgggaccrggagacacagaagtacaagcgccaggcacaggcggtttggaccccaccactgttgccatggtgaccaaactctggagtccgaggtaacagaacacctgtccccctaggcttctccgttgtccacaaggaaaag

SEQ ID NO: 3767 - DNA, 480 bp, Homo sapiens
  CDS 61..468
  sig_peptide 61..132: score 9.4 seq LLSGALALTETWA/XS
  misc_feature 49: y=c or t
  misc_feature 88: m=a or c
  misc_feature 105: r=a or g
  misc_feature 133: k=g or t
  misc_feature 157: k=g or t
  misc_feature 186: r=a or g
  misc_feature 202: k=g or t
  misc_feature 266: r=a or g
  misc_feature 286: r=a or g
  misc_feature 288: r=a or g
  misc_feature 306: r=a or g
  misc_feature 319: r=a or g
  misc_feature 321: s=g or c
  misc_feature 398: r=a or g
  misc_feature 399: s=g or c
  UNSURE -15: Xaa=Ile or Leu
  UNSURE 1: Xaa=Cys or Gly
  UNSURE 9: Xaa=Asp or Tyr
  UNSURE 24: Xaa=Ala or Ser
  UNSURE 45: Xaa=Glu or Gly
  UNSURE 52: Xaa=Ile or Met or Val
  UNSURE 63: Xaa=Asp or Glu or Lys or Asn
  UNSURE 89: Xaa=Lys or Asn or Arg or Ser
agtcccggttctaaagtccccagtcacccacccggactcggattctccycagacgccgagatgcgggtcatggcgccccgaaccctcmtcctgctgctctcgggrgccctggccctgaccgagacctgggcckgctcccactccatgaggtatttckacaccgccgtgtcccggcccggccgcggrgagccccgcttcatckcagtgggctacgtggacgacacgcagttcgtgcggttcgacagcgacgccgcgagtccgagagrggagccgcgggcgccgtggrtrgagcaggaggggccggartattgggaccggrasacacagaagtacaagccactgaggaagagtggttttcctaagaagacattgctggagttgactttcttctgtccaarsaaacaaacaaaaactaaacacacacacaaacccccagaaacccacaatatgtacacgctaaggaaaaactagcacccttct

SEQ ID NO: 3768 - DNA, 492 bp, Homo sapiens
  CDS 129..473
  sig_peptide 129..188: score 10.4 seq VLFGLLLVLAVFC/HS
  misc_feature 52: y=c or t
gaaagaatgcgggggctgagcgcagaagcggctcgaggctggaagaggatcytgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagaaaaacagttcttctgctggtgactccatttctggcagc

SEQ ID NO: 3769 - DNA, 418 bp, Homo sapiens
  CDS 55..399
  sig_peptide 55..114: score 10.4 seq VLFGLLLVLAVFC/HS
attatacttcttacagtgaggagccagagcttccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagaaaaacagttcttctgctggtgactccatttctggcagc

SEQ ID NO: 3770 - DNA, 447 bp, Homo sapiens
  CDS 84..428
  sig_peptide 84..143: score 10.4 seq VLFGLLLVLAVFC/HS
  misc_feature 386: r=a or g
gaaagaatgcgggggctgagcgcagaagcggctcgaggctggaagaggatcctgggcgccgccaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaraatggtgggacatccttatcagaaaaacagttcttctgctggtgactccatttctggcagc

SEQ ID NO: 3771 - DNA, 806 bp, Homo sapiens
  CDS 115..708
  sig_peptide 115..258: score 5.1 seq SAPLCLLCSGSSS/PA
actccgcagagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggtt

SEQ ID NO: 3772 - DNA, 509 bp, Homo sapiens
  CDS 36..500
  sig_peptide 36..92: score 3.5 seq RLLRASVARHVSA/IP
ctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggcacatgaacatcg

SEQ ID NO: 3773 - DNA, 398 bp, Homo sapiens
  CDS 75..377
  sig_peptide 75..155: score 10.9 seq LFLGXLLLPLVVA/FA
  misc_feature 101: y=c or t
  misc_feature 129: k=g or t
  UNSURE -9: Xaa=Leu or Val
attggccacagagacccagcccgagtttcccatcgcactgagcactgagatcctgctggaagctctgccgcagcatgagctccgcagccgggttctgcgcytcacgccccgggctgctgttcctggggktgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtg

SEQ ID NO: 3774 - DNA, 362 bp, Homo sapiens
  CDS 26..343
  sig_peptide 26..115: score 5.9 seq LGVNLVVMPPTXA/RS
  misc_feature 111: r=a or g
  misc_feature 336: s=g or c
  UNSURE -2: Xaa=Gln or Arg
  UNSURE 74: Xaa=Arg or Thr
gtttgctgcatagattacaacggtgatggcgggcaagcggtccggctggagccgggcggctctcctccagctccttctcggcgtgaacctggtggtgatgccgcccacccrggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaasagacctttgaccggactctcatgagt

SEQ ID NO: 3775 - DNA, 687 bp, Homo sapiens
  CDS 92..682
  sig_peptide 92..148: score 5.1 seq SLLWAATCLGVLC/VL
  misc_feature 613: n=a, g, c or t
  misc_feature 622: n=a, g, c or t
  misc_feature 648: n=a, g, c or t
  misc_feature 657: s=g or c
  UNSURE 155: Xaa=Phe or Leu
  UNSURE 158: Xaa=His or Gln
  UNSURE 167: Xaa=Cys or Phe or Ser or Tyr
  UNSURE 170: Xaa=Cys or Ser
gtagtctcggaggcggcgccgcaggggattgaggggttgactgagcgttgcgagccttagctttctcccgaacgccagcgctgaggacacgatgtcgcggctctcccgctcactgctttgggccgccacctgcctgggcgtgctctgcgtgctgtccgcggacaagaacacgacccagcacccgaacgtgacgactttagcgcccatctccaacgtaacctcggcgccggtgacgtccctcccgctggtcaccactccggcaccagaaacctgtgaaggtcgaaacagctgcgtttcctgttttaatgttagcgttgttaatactacctgcttttggatagaatgtaaagatgagagctattgttcacataactcaacagttagtgattgtcaagtggggaacacgacagacttctgttccgtttccacggccactccagtgccaacagccaattctacagctaaacccacagttcagccctccccttctacaacttccaagacagttactacatcaggtacaacaaataacactgtgactccaacctcacaacctgtgcgaaagtctacctttgatgcagccagtttcattggaggaattgtcctggtcttnggtgtgcangctgtaattttctttctttataaatnctgcaaatstaaagaacgaaattaccacactctgtaaac

SEQ ID NO: 3776 - DNA, 449 bp, Homo sapiens
  CDS 32..412
  sig_peptide 32..109: score 10.4 seq LCLCVLVLACIGA/CQ
  misc_feature 138: y=c or t
  misc_feature 231: n=a, g, c or t
  misc_feature 232: n=a, g, c or t
  misc_feature 403: n=a, g, c or t
  UNSURE 10: Xaa=Leu or Pro
  UNSURE 41: Xaa=Ala or Asp or Glu or Gly or Val
  UNSURE 98: Xaa=Lys or Asn
acagagggacagaggcacggaacccccagaaatgtccctcctcagaaacaggctccaggccctgcctgccctgtgcctctgcgtgctggtcctggcctgcattggggcatgccagccagaggcccaggaaggaacccygagccccccaccaaagctaaagatgagtcgctggagcctggtgaggggcaggatgaaggagctgctggagacagtggtgaacaggaccagagnngggtggcaatggttctggagcccgagcaccttccggggcttcatgcagacctactatgacgaccacctgagggacctgggtccgcgcaccaaggcctggttcctcgaatccaaagacagcctcttgaagaagacccacagcctgtgccccaggcttgtctgtggggacaangaccagggttaaaatgttcataaaagccaggtgtggttgtggcggg

SEQ ID NO: 3777 - DNA, 577 bp, Homo sapiens
  CDS 73..474
  sig_peptide 73..123: score 9.3 seq LALSLLILVLAFG/IP
acacagacccccaacttgcagctgcccacctcaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaagggctccaaaggctgcaagaggactaagcggtcacagacccctaaagggccatagcccagtgagcagcctggagccctggagaccccaccagcctcaccagcgcttgaagcctgaacccaagatgcaagaaggaggctatgctcaggggccctgg

SEQ ID NO: 3778 - DNA, 506 bp, Homo sapiens
  CDS 133..480
  sig_peptide 133..213: score 8.6 seq IVLALGCVTGAPS/DP
aaaaaacagagggagacggttgagagcacacaagccgctttaggagcgaggttcggagccatcgctgctgcctgctgatccgcgcctagagtttgaccagccactctccagctcggctttcgcggcgccgagatgctgtcctgccgcctccagtgcgcgctggctgcgctgtccatcgtcctggccctgggctgtgtcaccggcgctccctcggaccccagactccgtcagtttctgcagaagtccctggctgctgccgcggggaagcaggaactggccaagtacttcttggcagagctgctgtctgaacccaaccagacggagaatgatgccctggaacctgaagatctgtcccaggctgctgagcaggatgaaatgaggcttgagctgcagagatctgctaactcaaacccggctatggcaccccgagaacgcaaagctggctgcaagaatttcttctggaagactttcacatcctgttagctttcttaactagtattgtccat

SEQ ID NO: 3779 - DNA, 429 bp, Homo sapiens
  CDS 39..404
  sig_peptide 39..83: score 4.2 seq LSHLQGISGPILG/QP
  misc_feature 377: m=a or c
  misc_feature 410: n=a, g, c or t
  misc_feature 428: s=g or c
ttccaagtttgctccaaactggtgtgcttcctcctgggatggacttgagtcatttacagggaatatctggccccatcctgggtcagcccttttaccctttacctgctgctagtcaccctctcttaaaccctcgtcctggaacacctctgcatctggcaatggtgcaacagcagctacagcgctcagttctgcatcctccaggctctggttcccatgcagcagctgtcagcgttcagacaacccctcagaacgtgcccagccggtcaggcctgccccacatgcactcccagctggagcatcgccagccagaggagcagctcccctgtgggccttgccaaatggtttggctcagatgtgctacagcaacccctgccctmcatgcccgccaaagttatcagtgtagatgaatnggaataccgacagtgagsa

SEQ ID NO: 3780 - DNA, 444 bp, Homo sapiens
  CDS 5..430
  sig_peptide 5..133: score 5.1 seq PTLGAFWLAVLLA/DM
  misc_feature 178: n=a, g, c or t
  misc_feature 310: n=a, g, c or t
gagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctcctngtggccctgctgtttccaggatcgtctcaagccagacatgtgaaccactcagccactgaggctctcggagaactcagggaaagagcccctgggcaaggcacaaacgggtttcagctgctacgccacgcagtncaaatgggacctcttaccaccgcgcaccccaccttaccaaggggatgttccactgggaatgagaaataccatctgccgtatgcagcaagggatctgcagactttttttctgccattctggtgagaaaaagcgtg

SEQ ID NO: 3781 - DNA, 637 bp, Homo sapiens
  CDS 6..446
  sig_peptide 6..125: score 4.6 seq ITGVILLAVGVWG/KL
  misc_feature 445: s=g or c
  UNSURE 107: Xaa=Ser or Thr
gtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcasctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagact

SEQ ID NO: 3782 - DNA, 436 bp, Homo sapiens
  CDS 16..369
  sig_peptide 16..78: score 9.3 seq GLLAALAVCGSWG/LN
  misc_feature 287: n=a, g, c or t
  misc_feature 316: y=c or t
  misc_feature 317: w=a or t
  UNSURE 70: Xaa=Ile or Asn or Ser or Thr
  UNSURE 80: Xaa= *  or Leu or Gln
agtcagagggatgggatggaggggccggtgctgacactggggctgctggctgccctggcggtgtgtggcagctgggggctgaacgaggaggagcggctgatccggcacctgtttcaagagaagggctacaacaaggagctccggcccgtggcacacaaagaggagagtgtggacgttgccctggccctcacactctccaacctcatctccctgaaagaagttgaggagaccctcactaccaatgtgtggatagagcacggctggacagacaaccggctgaagtggantgctgaagaatttggaaacatcagtgtcywgcgcctccccccggacatggtgtggctcagagattgtgctggagaacaacaatgacggctccttccagatctcctactcctgcaacgtgcttgtctaccactacggcttcgtgtactgg

SEQ ID NO: 3783 - DNA, 547 bp, Homo sapiens
  CDS 133..498
  sig_peptide 133..213: score 5.7 seq LVSLFCSCFLADP/LN
  misc_feature 466: s=g or c
  UNSURE 85: Xaa=Leu or Val
accactaattgagggagtgaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaagcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaaggagcgaaggaagtaccaggaagcggastcctgaaacacctagcagagaaaacgggaacatgagagagaggtgatccaaaaggccattgaggaaaacaacaacttcatc

SEQ ID NO: 3784 - DNA, 443 bp, Homo sapiens
  CDS 96..437
  sig_peptide 96..239: score 4.6 seq VFGSFLLLLFSLT/QF
  misc_feature 305: n=a, g, c or t
  misc_feature 323: n=a, g, c or t
  misc_feature 335: s=g or c
  misc_feature 360: n=a, g, c or t
  UNSURE 22: Xaa=Phe or Leu
  UNSURE 41: Xaa= *  or Gly or Arg
cactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttncgcatctacaagtctgtnttacaagcagtscagataaccgacgaaggccaccgtngaaggcctacttggagcttgagatcaccctttctcaggagcagattcagaagtacacggactgcctgcagttctacgtgaaca

SEQ ID NO: 3785 - DNA, 528 bp, Homo sapiens
  CDS 55..510
  sig_peptide 55..153: score 9.5 seq LLLGLVMPLAIIA/QV
atcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagatggcaaagagttaaaagaattgtccagag

SEQ ID NO: 3786 - DNA, 484 bp, Homo sapiens
  CDS 30..431
  sig_peptide 30..170: score 4.9 seq LSDGLSLAAPGWG/VP
agaattagttctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcacggattgcagcttctgggaacggctgttggctcggcaatgtcgaatctatgagcttcgaaataaggaacgcatctctgtagcagctgcctccaaactgcttgccaacatggtgtatcagtacaaaggcatg

SEQ ID NO: 3787 - DNA, 515 bp, Homo sapiens
  CDS 57..428
  sig_peptide 57..146: score 9.9 seq LLFGFTLVSGTGA/EK
aaaatccccgcacctgagcatcggctcacacctgcaccccgcccgggcatagcaccatgcctgcttgtcgcctaggcccgctagccgccgccctcctcctcagcctgctgctgttcggcttcaccctagtctcaggcacaggagcagagaagactggcgtgtgccccgagctccaggctgaccagaactgcacgcaagagtgcgtctcggacagcgaatgcgccgacaacctcaagtgctgcagcgcgggctgtgccaccttctgctctctgcccaatgataaggagggttcctgcccccaggtgaacattaactttccccagctcggcctctgtcgggaccagtgccaggtggacagccagtgtcctggccagatgaaatgctgccgcaatggctgtgggaaggtgtcctgtgtcactcccaatttctgagctccagccaccaccaggctgagcagtgaggagagaaagtttctgcctggccctgcatctggttccagcccacctgccctcccc

SEQ ID NO: 3788 - DNA, 912 bp, Homo sapiens
  CDS 22..450
  sig_peptide 22..132: score 4.2 seq LADVCLDTPLCNG/HT
  misc_feature 10: k=g or t
  misc_feature 437: n=a, g, c or t
  misc_feature 845: y=c or t
  UNSURE 102: Xaa=Ile or Asn or Ser or Thr
attcaacagkatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcancaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagaaacaaaagatgggaaactgcttttccacaaggaatctccgtagaaattttgcggcgaccagatggtgcataggtctggaaggtctgatctcccttggtcttccatgggatggttagtgtggaggggagatatagattgtccggccgctttgtgattccatggattgattcagtcttctggattttttyttctttatattttgggtactggagcttttaaaaatgtttggtttcaggtatttttattcatgtgaag

SEQ ID NO: 3789 - DNA, 458 bp, Homo sapiens
  CDS 100..444
  sig_peptide 100..216: score 4.3 seq IHISWLSLSRVNC/SQ
agtgagctaagctgcggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactctgacatagccagctgctgt

SEQ ID NO: 3790 - DNA, 438 bp, Homo sapiens
  CDS 20..376
  sig_peptide 20..67: score 6.5 seq VLXLFVCLFETES/XS
  misc_feature 35: y=c or t
  misc_feature 36: w=a or t
  misc_feature 68: s=g or c
  misc_feature 438: d=a or g or t
  UNSURE -11: Xaa=Phe or His or Leu or Tyr
  UNSURE 1: Xaa=Gly or Arg
taccagtggaatcaatcatatgatatttgtccttywtttgtttgtttgtttgtttgagacggagtctsgctctgttgcccgggctggagtgcagtggcacggtcttgtctcactgcgacctctgcctcctgggttcaagcgattctcatgcctcagccttctgagtagctgggattacaggcgtgtgccaccacgcttagctaatttttgtatttttagtagagatggcgttatgccatttgaccaggctggtcttgagctcctgacctcaagcgatcctcccgccttggccttccagggtgctgggatcgcaggtgtgagccatgaagcctggcctggtatttgtctttttgtgattggcttatttctgttagcataacgtccccaaggttcactcatgtggcatgtatcggaatttcttttctttttgaggctgad

SEQ ID NO: 3791 - DNA, 417 bp, Homo sapiens
  CDS 47..364
  sig_peptide 47..193: score 5.9 seq FVFIFVXLRESLA/LL
  misc_feature 174: k=g or t
  misc_feature 175: s=g or c
  misc_feature 308: h=a or c or t
  UNSURE -7: Xaa=Cys or Phe or Leu or Trp
  UNSURE 39: Xaa=Cys or Arg or Ser
ttgtgactttgattgcctactggctaatgttgccaactattttttcatgattttattggacattcacacatatttgctgaagaaatatctatttataagctttacctattatttaattgggttaaatttctttttcttattcagttgttggttttttgtttttatttttgtttksttgagggagagtctcgctctgctgcccaggctggagtgcagtggcgtgatctctgctcactgcaagctctgcctcctgggttcacaccattctcctgcctcagcctcccaagtagctgggactacaggcgcchgccactacgcgtggctaattttttgtatttttagtagagatggggtttcactgtgttagccaggatggtctcgaactcctgacctcgtgatctgcccacctcggcctga

SEQ ID NO: 3792 - DNA, 447 bp, Homo sapiens
  CDS 51..443
  sig_peptide 51..161: score 10.1 seq LLGLCVCLSGCST/ET
  misc_feature 198: w=a or t
  misc_feature 401: d=a or g or t
  misc_feature 402: b=c or g or t
  misc_feature 426: r=a or g
  misc_feature 429: m=a or c
  UNSURE 13: Xaa=Arg or Trp
  UNSURE 80: Xaa=Arg or Ser
  UNSURE 81: Xaa=Cys or Gly or Arg
  UNSURE 89: Xaa=Gly or Arg
  UNSURE 90: Xaa=Pro or Thr
agaacaatgctgcttggctccctgaattcagcacccttcctagggaatgtatgggtggatcttttgccttgcaggattctttttcatctttgcagggacttctggggccggagtatgtaaaactcctgggtctctgtgtgtgcctgagtggctgctctactgagactctgcatacacagctctgtatatcggacccawggccctggtggcatgggctcacgaggagatcccctgatctgtgggttgcaaagatctgtgggagaagtgtggtttcctggatggggtcacacaatcactcactgcttcccttggctggaggtggggctttttttttggctccatgctgctcctgggcgggcgattgccctaccccatttttcttcattctctgtgggtcaagdbgttcacttggtcagtccattgtgrgamctggatatttcagttgaa

SEQ ID NO: 3793 - DNA, 381 bp, Homo sapiens
  CDS 12..347
  sig_peptide 12..158: score 7.7 seq LCLLGSSDSPASA/SQ
  misc_feature 322: s=g or c
  misc_feature 370: k=g or t
  misc_feature 376: r=a or g
  UNSURE 55: Xaa=Ser or Thr
tggactgttttatgcatgttgttgttgttgttgttgttgttgttgttgttgttttgagacagagtcttgctctgttgcccaggctggagtgcagtggcacaatcttggctcactgcagcctctgcctcctgggttcaagtgattctcctgcctcagcctcccaagtagctagaactacaggcatgtgccaccatacccagctaatttttgtatttttaatagagacaggatttctccatattggccaggctgctcttgaactcctgacctcaggtgatccacctgcctcagcctcccaaagtgctgggattacaggcgtgascaccacacctggccgcctttcaaattagtaaccagtgcttcctatctktttacrtatac

SEQ ID NO: 3794 - DNA, 352 bp, Homo sapiens
  CDS 28..330
  sig_peptide 28..96: score 4.6 seq LFFYFILWRRSLA/LS
  misc_feature 10: d=a or g or t
  misc_feature 11: n=a, g, c or t
  misc_feature 12: r=a or g
  misc_feature 32: r=a or g
  misc_feature 33: s=g or c
  misc_feature 312: y=c or t
  misc_feature 348: s=g or c
  UNSURE -22: Xaa=Asp or Glu or Gly
tgttctcacdnrgtctttcctttgtgcatggrsatgtctgtgtccaaatttccttttctttttttttattttattttatggagacggagtctcgctctgtctcccaggctggagtgcagtggcccgatcttggctcactgcaacctccgcctcctgggttcaagcaattctcctaccttagcctcccgagtagctgggactacaggtgcacgctgccacgcctggctaattttttgtatttttagtagagacgggttttcaccatgttgcccaggctggtctggaactcctgagctcaggcaatccacccayctcggcctcccaaggtactaggattacaagcatgasccac

SEQ ID NO: 3795 - DNA, 421 bp, Homo sapiens
  CDS 8..415
  sig_peptide 8..121: score 7 seq LVMVWLGLLPLFS/GP
  misc_feature 371: k=g or t
  misc_feature 375: y=c or t
  misc_feature 381: k=g or t
  misc_feature 393: s=g or c
  misc_feature 394: r=a or g
  misc_feature 409: k=g or t
  misc_feature 412: y=c or t
  UNSURE 84: Xaa=Phe or Val
  UNSURE 85: Xaa=Phe or Ser
  UNSURE 87: Xaa=Cys or Phe
  UNSURE 91: Xaa= *  or Ser or Trp
  UNSURE 96: Xaa=Ile or Met
cctcctaatggcaaatgcaataattaagaagccttgtgcaatgccggcacagcctcacacagggaatctcctgtggccacctcttgtcatggtgtggctcgggctgttgcctcttttctctgggccccacttgcaagccgttcagcatctggcccttgcctacctccctctgaactctgtggttcttgcacataatagtccagccatactgaatgtatggttaactctgagatgccctctcccttacaggatctgcctctggccctttgaacatgcttttccgtctattagaaacacacactcctgcctgtcttcctcctgctgctgccctgcttcagcccctcttttagttgattacctcttcttttacktttytggttkttttaaatcatsrgcttctctgagaatkaayaattgatta

SEQ ID NO: 3796 - DNA, 505 bp, Homo sapiens
  CDS 141..497
  sig_peptide 141..182: score 4.2 seq VIFAPLFAIFAFA/TC
  misc_feature 46: w=a or t
  misc_feature 137: r=a or g
  misc_feature 138: w=a or t
cttcttctcctcctttgcttcataaaaagagggacaagtggctggwgctgtggacagagaagctttatttttagtatgagacaacctctattttctttcaggagagggaagttggattatcaattcttttgtaaatrwgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaccggggcccactcattgacttcattgtcactgtagtcttt

SEQ ID NO: 3797 - DNA, 389 bp, Homo sapiens
  CDS 18..380
  sig_peptide 18..65: score 4.1 seq VFFLTEAGSVAQA/GV
  misc_feature 72: m=a or c
  misc_feature 311: s=g or c
  misc_feature 354: r=a or g
  misc_feature 364: k=g or t
  misc_feature 385: k=g or t
  UNSURE 3: Xaa=Lys or Gln
  UNSURE 82: Xaa=His or Gln
  UNSURE 97: Xaa=Ala or Thr
  UNSURE 100: Xaa= *  or Leu
cactgttttttctactaatgttctgggttttttttttgacggaggctggctctgtagcccaggctggagtgmagtggtgtgatctcggctcactgcaacctccgcctcccaggatcaagcaattcccctgcctcagcctacctagtagctgggactacaggtgcacaccaccacgaccagctaatttttgtatttttttagtagagacggggtttctccgtgttggccgggctgatcttgaactccagacctcaagtgatgcacccacctgggcctctcaaagtactgggattgcgggtgtgaaccaccasgcccggccctttgctaatgtccttttactatcccgcgatccarcattatattkattcatcctgtttccatagtkgcca

SEQ ID NO: 3798 - DNA, 437 bp, Homo sapiens
  CDS 58..423
  sig_peptide 58..120: score 5.8 seq ACVRVCLVWTSFC/QP
  misc_feature 296: n=a, g, c or t
  misc_feature 297: n=a, g, c or t
  UNSURE 59: Xaa= *  or Cys or Phe or Leu or Ser or Trp or Tyr
ctgcaccgactaggctgaggtgctggtacttgccccaacccctacttttgtatttatatgtgtgtgtgtgtgtgcgtgcgtgcgtgcgtgcgtgtatgtttggtctggaccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctnnggagctgatgccacctctttgtcttcccctaaaggagaacatggggataacatgggtgtgtgcccacaacactctaggtgcagagcccctgtggcaaagtattacagggtgtgggtggggattacctgaatcggggtctc

SEQ ID NO: 3799 - DNA, 444 bp, Homo sapiens
  CDS 82..429
  sig_peptide 82..138: score 5.8 seq HLMSLVTSTSASA/SA
  misc_feature 324: v=a or c or g
  misc_feature 374: k=g or t
  misc_feature 381: w=a or t
  UNSURE 62: Xaa= *  or Cys or Trp
  UNSURE 79: Xaa=Leu or Trp
  UNSURE 81: Xaa=Arg or Ser
attttgtaagctgcgcttcacctgctactaatcttgctgttacttctgctatcccatctttaaatttttatcacaatttgaatgattggcaactatgatcatcttatgtctttagtaacatctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttgvtggcatagtcaagttcctagatcttcatcaatggtacttggatcattttkggacagwcttaatgagagagaggagagatttggagagaagaacagattcctctattagtaatcttatgga

SEQ ID NO: 3800 - DNA, 436 bp, Homo sapiens
  CDS 30..374
  sig_peptide 30..74: score 8.6 seq PLLIICLLPAIEG/KN
  misc_feature 393: r=a or g
actggggcacagtaggaggaacccagaagatgctgcctctcctgatcatctgtctcctgcctgccattgaagggaagaactgcctccgctgctggccagaactgtctgccttgatagactatgacctgcagatcctctgggtgaccccagggccacccacagaactttctcaaagtattcactccttgttcctagaggataataattttctcaaaccctggtaccttgatcgtgaccatttggaagaagaaacagccaaattcttcactcaagtacaccaagccattaaaacgttacgagatgataaaacagtacttctggaagagatctacacgcacaagaatctctttactgagaggctgaataagataatctgatgggctgaaggagaargacatacagtccacactgaaggtcaccagctgtgctgactgca

SEQ ID NO: 3801 - DNA, 424 bp, Homo sapiens
  CDS 54..377
  sig_peptide 54..104: score 5.7 seq VVCCSCSWFFLFC/FV
  misc_feature 270: k=g or t
  misc_feature 272: w=a or t
  misc_feature 281: w=a or t
  misc_feature 285: r=a or g
  misc_feature 288: r=a or g
  misc_feature 289: n=a, g, c or t
  misc_feature 295: w=a or t
  misc_feature 300: w=a or t
  misc_feature 305: s=g or c
  misc_feature 315: y=c or t
  misc_feature 379: r=a or g
  misc_feature 382: m=a or c
  misc_feature 385: s=g or c
  misc_feature 398: k=g or t
  misc_feature 402: k=g or t
  UNSURE 56: Xaa= *  or Cys or Gly
  UNSURE 59: Xaa=Arg or Ser
  UNSURE 61: Xaa=Asp or Asn
  UNSURE 62: Xaa=Ala or Glu or Gly or Lys or Met or Arg or Thr or Val
  UNSURE 64: Xaa= *  or Leu
  UNSURE 66: Xaa=Asn or Tyr
  UNSURE 67: Xaa= *  or Tyr
  UNSURE 71: Xaa=Pro or Ser
ttcttacaggagtaaggtagtgtctcactgtagttttaatttgcatttccctgatgattagtgatgttgtatgttgtagttgctcctggttttttttgttttgttttgtttttgagatggagtctcactctgtcacccaggctggagtgcagtggcgcgatcttggctcactgcaagctctgcctcccgggttctcgccattctgcctaagcctcccgagtagctgggactacaggtgcctgccaccaagctcggctaattttttttttkgwatttttagwagtracrnggtttwaccgwattasccaggatggyctcaatctcctgacctcatgatccgcccacctcggcctcccaaagtgctgggaatacaggcgtracmacsgcgcctggccaaktttkgcttttttgcccagactggagt

SEQ ID NO: 3802 - DNA, 370 bp, Homo sapiens
  CDS 25..345
  sig_peptide 25..87: score 4.9 seq GVVAHACCPGTLG/CR
  misc_feature 256: r=a or g
  misc_feature 257: r=a or g
  misc_feature 304: h=a or c or t
  misc_feature 333: r=a or g
  UNSURE 57: Xaa=Asp or Gly or Asn or Ser
  UNSURE 73: Xaa= *  or Arg
cacaaagttgtatataattaaaacatgaaacttgatacatctcggcctggtgtggtggctcacgcctgttgtcccggcactttgggatgccgaggcgggtggatcacgaggtcaggagatcgagaccagcctggccaacgtggtgaagccccatctctactaaaaatgctaaaaaaattggccgggcgtggcggtccacgcctgtggtcccagctacttgggaggctgaggcagaagaatcgcttgaacctgggarrcggaggttgcggtgagctgagatcacgccactgcactccagcctgghgacagagcgagactctgtctcaaaatcaraaaaaagaaacttgatacatctcttactttatatcca

SEQ ID NO: 3803 - DNA, 453 bp, Homo sapiens
  CDS 46..450
  sig_peptide 46..105: score 4.5 seq GTLVFTVITAVLG/SF
acactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagggctaatttcaggcctggttcctatgtatatcggtga

SEQ ID NO: 3804 - DNA, 458 bp, Homo sapiens
  CDS 115..423
  sig_peptide 115..186: score 4.5 seq CVLKCVCLPLILS/PP
tagtttgatctaaagaaccagcttatataacttgctgttgccatgtacatttgtatgtctttgctgtgtcaaataactggatctgattttagctctttttaagtggtgaaagcaatgcatttttattcttcaaattcagacattgaatgtgtattaaaatgtgtgtgcttacctttaatcctctccccaccgacaattaggaacacgtttctccaattactgttggcaagactaccaagaaaaattgttgaattagaatcccagcaccgggcacggtggctcacgcctgtgatcctagcactttgggaggccaaagcaggcggatcacctgaggtcaggagttcgagaccagcagggccaacatggcgaaaccccgactctactaaaaatacaaaaattagccaggcatggtggtgggcgctgtaatcccaactactcaggaggctgaggcaggagaa

SEQ ID NO: 3805 - DNA, 371 bp, Homo sapiens
  CDS 24..338
  sig_peptide 24..125: score 8.2 seq TLFLLTLSSSTLS/FL
  misc_feature 333: s=g or c
  UNSURE 70: Xaa=Ala or Pro
caagaggtttgtggtgattcgttatggcagcacaggaaactcatgcagcacatttatattttttaccaaatttgagaaattttcagacattatttcttctgacactttccagttccaccctctctttcctctttttctttaacttcagtgatttgaatcttagctctttttattttttatttttatttttattgcgatggagtcatgctcttgtcgcccaggctggagtgcagtggtgtgatcttggctcactgcaacctctgtctccagggttcaggctatcatcctgcccaactcccgagtggctgggattgcaggcatgcacctcctcasccagctagtttttttgtatttttgtagagacagggata

SEQ ID NO: 3806 - DNA, 453 bp, Homo sapiens
  CDS 66..395
  sig_peptide 66..149: score 4.5 seq LMSPALAAHVTRS/SQ
  misc_feature 131: s=g or c
caagaactcactttcaggattgagtattgatgaaattgtccaaagagtgacagaacacattctagatgaacagaaaaagaaaaagccaaacccaggaaaggacaagaggacttatgagcccagctctggcsgcccacgtgaccaggtcctcccagggcccacccttggcggttgttgcaccatcacccaaaaccaaggggcagaaagcagaagatgtccctgtgagggttgcactgggtgcaagttcctgtgaaatatgtcacgaggtgttcaaatcaaaaaacgtgcgtgtgctcaaatgtgggcacaagtatcacaaagggtgttttaagcagtggcttaaagggcagagcgcttgcccagcctgccagacttgtgatctcctgtcagaagagtagcctgcaccttctggaagaggctggcccagtgagaatcgggagccgccttcctgct

SEQ ID NO: 3807 - DNA, 380 bp, Homo sapiens
  CDS 61..363
  sig_peptide 61..198: score 3.6 seq MWLLLFRLWDGLA/ME
ggctgcccttgaactcttgacctcaagtgatcctcctgccttggcctccagcgtgctgggatgacaggaatgaatccttttaatatgctgcttcaggcagcagtgcagcaggttggaagctacacacggcacctggaaagatcccacagctctgtgtggatgtggctgctgctcttcaggctgtgggatggtttggcgatggaaccaagcgggttcagtgctcacgacgtctgttcatgttctctctcaagcttagaggtgactttagttgagggaggtgagttagggaatatggaggtgaccaaaaccatgaggaacagggtcagcctgaagggagcgggcttccctctgtgtccggctgtgtagtaatggccgcttct

SEQ ID NO: 3808 - DNA, 377 bp, Homo sapiens
  CDS 54..371
  sig_peptide 54..140: score 3.9 seq LVHSTVSVSLLEA/DS
caaaatcccaaaaggtatgagaagtcttcttagtgaatatcaaagaaaaagaaatgaagaaaaagctttacaggagaagattcctgcctccttatgtggaactcgttcattccacagttagcgtttccctgcttgaggccgacagtggctccctggcccctgtgcctgggtccgtacccaaggtgggtccttgctggtcctgctggtgtctccatcggtggccctttgggctgctctctggttctggattttctcttctgactttcttccagaaagagggaaagaagttgccattttctaagaaaagagcaatccatcctaagaacacctctgacctcactgggctcttactactcacttggctgaagcactaactc

SEQ ID NO: 3809 - DNA, 408 bp, Homo sapiens
  CDS 67..381
  sig_peptide 67..186: score 5 seq LTLFISAXFXSET/WQ
  misc_feature 170: k=g or t
  misc_feature 171: s=g or c
  misc_feature 175: r=a or g
  misc_feature 176: m=a or c
  misc_feature 298: r=a or g
  misc_feature 299: w=a or t
  misc_feature 331: n=a, g, c or t
  misc_feature 332: s=g or c
  misc_feature 334: m=a or c
  UNSURE -6: Xaa=Cys or Phe or Leu or Trp
  UNSURE -4: Xaa=Ala or Asp or Asn or Thr
  UNSURE 38: Xaa=Glu or Lys or Met or Val
  UNSURE 49: Xaa=Ala or Gly or Pro or Arg or Ser or Thr or Trp
ctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcatkstttrmttctgaaacttggcagaaactcgttagccagtccactgcctttctgacaatgtgtggagtcacgtatgcttggtatatgcctttactacttttaaagttctacagtttattacttgcccaarwgttactaaatccttttcttatgtgtactggansgmgaaaaaattatagccagcactttgagaggaagttttcagaacaatattaactggcactactaactgaaggcacg

SEQ ID NO: 3810 - DNA, 442 bp, Homo sapiens
  CDS 19..345
  sig_peptide 19..141: score 6.1 seq VLLALSLRMECSG/MI
  misc_feature 325: h=a or c or t
  misc_feature 326: s=g or c
  UNSURE 62: Xaa=Cys or Pro or Arg or Ser or Thr
agaagctagcagagaggtatggaacagattcttcttcacaacctcagagggaaaaccctgctgatacctggatttcaaactcctggcctccagaacgacaaagtcttgcttgctctgtcgctcaggatggagtgtagtggtatgatcttagctcactacaacctctgcctcccaggttcaagtgattctcctgccttacgctcccaagtaactgggactacaggcacacaccaccacacccagctaatttttgtattttttgtagagacggggttttaccacgttagccgggctggtcttgaactcctgacctcaggtgatccahscgcctcgatcgcccattattaacaatcaaatggctgttcttcatggtactggtacaaaaacagatatatacaccaatggaacagaacagaggcctcagaaacaacaccacacatct

SEQ ID NO: 3811 - DNA, 423 bp, Homo sapiens
  CDS 12..320
  sig_peptide 12..140: score 9.1 seq CLFVCLFFXWSLA/LS
  misc_feature 15: y=c or t
  misc_feature 16: y=c or t
  misc_feature 127: w=a or t
  misc_feature 379: r=a or g
  misc_feature 401: y=c or t
  UNSURE -42: Xaa=Leu or Pro or Ser
  UNSURE -5: Xaa= *  or Leu
aaaatcccaaaatgyyacctagtgacaactgctgttatttatatttcttctccctccctttctcctgcccgcaactgtatatagtgttttttgttgttttttgtttgtttgtttgtttgtttttttwatggagtcttgctctgtctcccaggctggagtgcagtggcgcgatctcagctcactgcaacctccacctcccgggttcaagcgattctcctacctcagcctcccgagtagctgggattatagacatggcatcaccatgcctggctaatttttctatttttagtagggacggggttttgccatgttggcgaggctgatcgtgaactcctgacctcagatgatctgccagcctcggcctcccaaagtgctgggratttacaggcgtgcgccatcgyacccggcctaatagttttgctt

SEQ ID NO: 3812 - DNA, 487 bp, Homo sapiens
  CDS 52..435
tctttgcgtctgcgtagttcgctcacctccctttctaactccgctgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatttatctggaaaattttgtatgagttcttgaataaaacttggg

SEQ ID NO: 3813 - DNA, 454 bp, Homo sapiens
  CDS 99..419
gccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaaatattaagtcagcttggtgctgacagtttaacaagccttaggaagttagctgaac

SEQ ID NO: 3814 - DNA, 621 bp, Homo sapiens
  CDS 118..612
atatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaa

SEQ ID NO: 3815 - DNA, 464 bp, Homo sapiens
  CDS 61..369
  misc_feature 456: r=a or g
acttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataraataagat

SEQ ID NO: 3816 - DNA, 485 bp, Homo sapiens
  CDS 76..426
  misc_feature 40: w=a or t
atattctatttgacctttgaactggcaaaggcttttttcwtcctcttccggggacgttgtctgcaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtgtggggatccact

SEQ ID NO: 3817 - DNA, 543 bp, Homo sapiens
  CDS 134..484
agttgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctgtgtggggatccact

SEQ ID NO: 3818 - DNA, 610 bp, Homo sapiens
  CDS 92..514
ggatgtgggggccagccctcggaaacggaagtgagcggcggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaaatagtgtgctgttcatggaaaccgagggctgcatcttgtttatagtcatctttgtactgtaatttgatgtacacaacattaaaagtactgaca

SEQ ID NO: 3819 - DNA, 458 bp, Homo sapiens
  CDS 49..354
  misc_feature 379: n=a, g, c or t
  misc_feature 396: n=a, g, c or t
attcgctgcggaccggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcatagtgtgttgattattgcatggaagttcagagnaaacacagtgcgagttnccaaacaggagttcatggatggcatgacagaattagatgtgacagcatagaaaaactaaagg

SEQ ID NO: 3820 - DNA, 665 bp, Homo sapiens
  CDS 106..648
  misc_feature 565: w=a or t
  UNSURE 154: Xaa=Asn or Tyr
agccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgatcctctacaagcttaagctgggtgagatcgtgaccaccattcccaccataggcttcaacgtggaaaccgtggagtacaagaacatcagcttcactgtgtgggacgtgggtggccaggacaagatccggcccctgtggcgccactacttccagaacacacaaggcctgatcttcgtggtggacagcaatgacagagagcgtgtgaacgaggcccgtgaggagctcatgaggatgctggccgaggacgagctccgggatgctgtcctcctggtgttcgccaacaagcaggacctccccaacgccatgaatgcggccgagatcacagacaagctggggctgcactcactacgccacaggaactggwacattcaggccacctgcgccaccagcggcgacgggctctatgaaggactggactggctgtccaatcagctccggaaccagaagtgaacgcgacccccctc

SEQ ID NO: 3821 - DNA, 497 bp, Homo sapiens
  CDS 62..481
aaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtcataccgtagaaaagatggcgtgtttctttattttgaagataatgcaggagtcatagtgaacaataaaggcgagatgaaaggttctgccattacaggaccagtagcaaaggagtgtgcagacttgtggccccggattgcatccaatgctggcagcattgcatgattctccagtatat

SEQ ID NO: 3822 - DNA, 453 bp, Homo sapiens
  CDS 37..360
gcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttaactggggtgaaccgatgcactggcacctagacatgtacaacaggaaccgtgtggatacatcccccacacctgtttcttggcatgtcatgtgtatgcagctcttcggtttcctggctttca

SEQ ID NO: 3823 - DNA, 572 bp, Homo sapiens
  CDS 46..540
  misc_feature 426: n=a, g, c or t
attctcgcctggcgcggctggggaaggtgaacagtgtggcccgccatgttcttctccgcggcgctccgggcccgggcggctggcctcaccgcccactggggaagacatgtaaggaatttgcataagacagctatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagtnggaaagtatcacattcaggtctgcactactacaccctgcatgcttcgaaactctgacagcatactggaggccattcagaaaaagcttggaaataaaggttggggagactacacctgacaaacttttcactcttatagaagtggaat

SEQ ID NO: 3824 - DNA, 522 bp, Homo sapiens
  CDS 85..444
  misc_feature 198: k=g or t
  misc_feature 269: k=g or t
  misc_feature 441: n=a, g, c or t
  misc_feature 443: n=a, g, c or t
  UNSURE 38: Xaa=Cys or Trp
  UNSURE 62: Xaa=Gly or Val
  UNSURE 119: Xaa=Ile or Met
  UNSURE 120: Xaa=Ala or Glu or Gly or Val
ggcatcttgctttttcttccccctcctcctgtgtgccccgcgccgctccctctttcccttttattcccggccccacacgccaaaatgaacagctcggacgaagagaagcagctgcagctcattaccagtctgaaggagcaagcaataggcgaatatgaagaccttagagcagagaaccagaaaacaaaggagaagtgkgacaaaattaggcaagaacgagatgaagccgttaaaaaactggaagaatttcagaaaatttctcacatggkcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacatngnatgatgaagattcgactacagacacagacggtgccgccgagacttgtgtctcagtacagtgtcagaagcaaattaaaga

SEQ ID NO: 3825 - DNA, 462 bp, Homo sapiens
  CDS 42..344
aacgcgtgcgcacagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggcctaactacctgacggcctgtgcgggacccccatcgcggccccagcgccccttctgtgctgtctgtggcttcccatccccctacacctgtgtcagctgcggtgcccggtactgcactgtgcgctgtct

SEQ ID NO: 3826 - DNA, 344 bp, Homo sapiens
  CDS 23..325
atgctctgcagagaaatcaaagatggcggttgtatctgctgttcgctggctgggcctccgcagcaggcttggccagccgctgacgggtcggcgggcgggtttgtgtgaacaggcacgcagctgcagattttattctggtagtgcaaccctctcaaaggttgaaggaactgatgtaacagggattgaagaagtagtaattccaaaaaagaaaacttgggataaagtagccgttcttcaggcacttgcatccacagtaaacagggataccacagctgtgccttatgtgtttcaagatgatccttaccttatgccagcgaaacacatataataaatgcattcacaca

SEQ ID NO: 3827 - DNA, 492 bp, Homo sapiens
  CDS 162..464
  misc_feature 468: r=a or g
gagagtaatgttacagagcggagagagtgaggaggctgcgtctggctcccgctctcacagccattgcagtacattgagctccatagagacagcgccggggcaagtgagagccggacgggcactgggcgactctgtgcctcgctgaggaaaaataactaaacatgggcaaaggagatcctaagaagccgagaggcaaaatgtcatcatatgcattttttgtgcaaacttgtcgggaggagcataagaagaagcacccagatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctcactgctgttgargtggtggtggtcacaaatctcctc

SEQ ID NO: 3828 - DNA, 485 bp, Homo sapiens
  CDS 72..419
  misc_feature 444: r=a or g
  misc_feature 451: r=a or g
  misc_feature 473: r=a or g
acatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattctggaattgaaccacgacctgccaattaagaratagaarattaaatagcagttctattaaraaataaaaagtt

SEQ ID NO: 3829 - DNA, 598 bp, Homo sapiens
  CDS 226..543
  misc_feature 437: k=g or t
  misc_feature 439: r=a or g
  misc_feature 440: r=a or g
  misc_feature 500: k=g or t
  misc_feature 501: r=a or g
  UNSURE 71: Xaa=Met or Arg
  UNSURE 72: Xaa=Glu or Gly or Lys or Arg
  UNSURE 92: Xaa=Gly or Val
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacakgrragaagcagaaaagaatttgacggacctaggaaaattctgcgggctttgtgtgtgtcctgkracaagcttaaatcaagtgatgcttacaaaaagcctggggcaataatcaggacggagtggtggccagccagcctgctcgtgtagtggacgaacgggag

SEQ ID NO: 3830 - DNA, 658 bp, Homo sapiens
  CDS 286..603
  misc_feature 497: k=g or t
  misc_feature 499: r=a or g
  misc_feature 500: r=a or g
  misc_feature 560: k=g or t
  misc_feature 561: r=a or g
  UNSURE 71: Xaa=Met or Arg
  UNSURE 72: Xaa=Glu or Gly or Lys or Arg
  UNSURE 92: Xaa=Gly or Val
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggactttgcagacccctcagttccctgggattgagacagcacttcctgactgttaccttgggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacakgrragaagcagaaaagaatttgacggacctaggaaaattctgcgggctttgtgtgtgtcctgkracaagcttaaatcaagtgatgcttacaaaaagcctggggcaataatcaggacggagtggtggccagccagcctgctcgtgtagtggacgaacgggag

SEQ ID NO: 3831 - DNA, 449 bp, Homo sapiens
  CDS 52..408
  misc_feature 123: s=g or c
  misc_feature 325: s=g or c
  misc_feature 338: r=a or g
  misc_feature 396: r=a or g
  misc_feature 406: m=a or c
  UNSURE 24: Xaa=Asp or Glu
  UNSURE 92: Xaa=Gly or Arg
  UNSURE 96: Xaa=Glu or Gly
  UNSURE 119: Xaa=Pro or Thr
gacggaagtgctctatcttgttgccggaagtgggaagagagaaaggttgtgatggcggctatagctgcatccgaggtgctggtggacagcgcggaggaggggtccctcgctgcggcggcggasctggccgctcagaagcgcgaacagagactgcgcaaattccgggagctgcacctgatgcggaatgaagctcgtaaattaaatcaccaggaagttgtggaagaagataaaagactaaaattacctgcaaattgggaagccaaaaaagctcgtttggagtgggaactaaaggaagaggaaaagaaaaaggaatgtgcggcaagasgagaagactatgrgaaagtgaagttgctggagatcagtgcagaagatgcagaaagatgggagaggaaaagragaggaaaamcctgatctgggatttcagattatgctgctgccagttacgccag

SEQ ID NO: 3832 - DNA, 487 bp, Homo sapiens
  CDS 95..406
  misc_feature 335: r=a or g
  misc_feature 372: r=a or g
  misc_feature 465: s=g or c
  UNSURE 81: Xaa=Glu or Lys
  UNSURE 93: Xaa=Lys or Arg
acttgcgtccgctacagtatgtcaatcgcttgccccagcacagaagagcttctcctcatcaactggggatgattacagttcttcctaaaaaaggatggctgctctttttctaaagaggttaacactacaaactgtaaagtctgaaaatagttgcattagatgttttggtaaacacatcctgcaaaagacagcaccagcacagttgtcccctattgcttctgccccaagactctccttcctaattcatgcaaaagcctttagtaccgctgaagacacccagaatgaaggaaaaaagacaaaaaagaataaaacagcttttagtaacgttggaagaraaattagtcagcgagttattcacttatttgatgagarggcaatgatttgggaaacatgcaccgagcaaatgtgattagacttatggatgagcgagacctgcgactggttcaaaggaacaccagcacagasctgcagagtatcagctcatgac

SEQ ID NO: 3833 - DNA, 461 bp, Homo sapiens
  CDS 47..409
  misc_feature 377: s=g or c
  misc_feature 382: r=a or g
  misc_feature 384: w=a or t
  misc_feature 389: m=a or c
  UNSURE 111: Xaa=Asp or His
  UNSURE 113: Xaa=Leu or Gln
  UNSURE 115: Xaa=Lys or Gln
ttttttttcttttcgccatcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcaggsacctrcwaaggmagcacctaagcaaaagattgtgaagcctgtgaaagtttcagctccccgagttggtggaaaacgctaaactgg

SEQ ID NO: 3834 - DNA, 409 bp, Homo sapiens
  CDS 75..398
  misc_feature 364: n=a, g, c or t
  misc_feature 382: s=g or c
  misc_feature 386: n=a, g, c or t
  misc_feature 387: s=g or c
  UNSURE 97: Xaa=Ala or Glu or Gly or Val
  UNSURE 103: Xaa=Ser or Thr
  UNSURE 104: Xaa=Lys or Asn
  UNSURE 105: Xaa=Ala or Pro
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagggtcagcctgcttttgttatcaagccttcccagcggaacctaggggngagagacacagccaggascaansccaggttccagtaggaaggcca

SEQ ID NO: 3835 - DNA, 739 bp, Homo sapiens
  CDS 75..569
  misc_feature 361: k=g or t
  misc_feature 606: w=a or t
  UNSURE 96: Xaa=Gly or Val
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctgkcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcwttccttctgtagctcaggagagcacccctccaccccatttgctcgcagtatcctagaatctttgtgctctcgctgcagttccctttgggttccatgttttccttgttccctcccatgcctagctggattgcag

SEQ ID NO: 3836 - DNA, 564 bp, Homo sapiens
  CDS 58..504
actcttgaaggcttccgggacggagaaggatcagggtcgtggaggtggtgaaaagggatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcg

SEQ ID NO: 3837 - DNA, 460 bp, Homo sapiens
  CDS 44..418
  misc_feature 104: n=a, g, c or t
  misc_feature 439: m=a or c
  misc_feature 440: r=a or g
  misc_feature 443: w=a or t
  misc_feature 453: r=a or g
  misc_feature 459: m=a or c
  UNSURE 21: Xaa=Ile or Leu or Val
cacaatccttcgcgctcttcctttccaacttggacgctgcagaatggctcccgcaaagaagggtggcgagaagaaaaagggccgttctgccatcaacgaagtgntaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcmratwaagttataarattgcma

SEQ ID NO: 3838 - DNA, 417 bp, Homo sapiens
  CDS 44..346
  misc_feature 104: n=a, g, c or t
  UNSURE 21: Xaa=Ile or Leu or Val
cacaatccttcgcgctcttcctttccaacttggacgctgcagaatggctcccgcaaagaagggtggcgagaagaaaaagggccgttctgccatcaacgaagtgntaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgagggcctttctattctatgaacctacagtccctttcatactgtccccaggctatgataacacttgccaatcccacctcctgccccagt

SEQ ID NO: 3839 - DNA, 648 bp, Homo sapiens
  CDS 52..414
agtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagca

SEQ ID NO: 3840 - DNA, 540 bp, Homo sapiens
  CDS 222..536
  misc_feature 13: s=g or c
  misc_feature 42: n=a, g, c or t
  misc_feature 43: k=g or t
agtggaaccttcsggctccttttctagacgccccagtggagnkgtttgctcttagacctcctccccttacgtcgaaatgaccgctgggtcttgcactcggaggatcttgggagccgacgtcccgacgcctcccgcccccgcagttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacagctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaagctgctgac

SEQ ID NO: 3841 - DNA, 738 bp, Homo sapiens
  CDS 149..625
  misc_feature 695: n=a, g, c or t
accttaaaggactttcatttctctccccttccttcatctctcctccttcacttaccttcatttattattctaggcatgacaagtgtcagatgtctgatttgaagactaatatgaatatatctagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttangcatatttattaccaatgaatttgaaaccagggcttttttttt

SEQ ID NO: 3842 - DNA, 727 bp, Homo sapiens
  CDS 138..614
  misc_feature 684: n=a, g, c or t
gattgtttttagtttgttagctgcctggagtgttattttaagaaagcagaagcaccatcatttgcacactccttatagataacacaccttaaccctgactttttttgctccagtttttcagaagaagtgaagtcaagatgaagaaccatttgcttttctggggagtcctggcggtttttattaaggctgttcatgtgaaagcccaagaagatgaaaggattgttcttgttgacaacaaatgtaagtgtgcccggattacttccaggatcatccgttcttccgaagatcctaatgaggacattgtggagagaaacatccgaattattgttcctctgaacaacagggagaatatctctgatcccacctcaccattgagaaccagatttgtgtaccatttgtctgacctctgtaaaaaatgtgatcctacagaagtggagctggataatcagatagttactgctacccagagcaatatctgtgatgaagacagtgctacagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttangcatatttattaccaatgaatttgaaaccagggcttttttttt

SEQ ID NO: 3843 - DNA, 504 bp, Homo sapiens
  CDS 60..491
  misc_feature 17: n=a, g, c or t
  misc_feature 18: r=a or g
  misc_feature 411: r=a or g
  misc_feature 453: n=a, g, c or t
  UNSURE 118: Xaa=Glu or Lys
  UNSURE 132: Xaa= *  or Glu or Lys or Gln
tttttttttttcctccnrtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagaragaatctgatggtgaatatgatgagtttggacgtaaaaaganaaaatacagagggaaagcagttggtcctgcatctatattaaaggaagttga

SEQ ID NO: 3844 - DNA, 501 bp, Homo sapiens
  CDS 45..392
tttgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgat

SEQ ID NO: 3845 - DNA, 449 bp, Homo sapiens
  CDS 125..436
ctacgcggggcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagccgtgtcagcggccggagcggcagctcagcaagtggtggaccaggccacagaggcggggcagaaagccatggaccagctggccaagaccacccaggaaaccatcgacaagactgctaaccaggcctctgacaccttctctgggatcgggaaaaaattcggcctggagcttcccttgctccctgagggaaggcctagaggcctcatccttgtggggccccaaggtcctagcatgaggctggacttcgtatggtggtgaagaacagagt

SEQ ID NO: 3846 - DNA, 602 bp, Homo sapiens
  CDS 34..495
  misc_feature 538: n=a, g, c or t
  misc_feature 598: s=g or c
  misc_feature 601: s=g or c
gcattctggggaaggagcagcaccaaatccaagatggcggccagcaggaggctgatgaaggagcttgaagaaatccgcaaatgtgggatgaaaaacttccgtaacatccaggttgatgaagctaatttattgacttggcaagggcttattgttcctgacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagacngcgtgcagtgcattcagacaccccgcaaagcaggactctgtggaaattgacacgtgccascgsc

SEQ ID NO: 3847 - DNA, 506 bp, Homo sapiens
  CDS 34..399
  misc_feature 442: n=a, g, c or t
  misc_feature 502: s=g or c
  misc_feature 505: s=g or c
gcattctggggaaggagcagcaccaaatccaagatggcggccagcaggaggctgacgaaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagacngcgtgcagtgcattcagacaccccgcaaagcaggactctgtggaaattgacacgtgccascgsc

SEQ ID NO: 3848 - DNA, 720 bp, Homo sapiens
  CDS 61..687
  misc_feature 593: r=a or g
  misc_feature 607: r=a or g
  misc_feature 616: n=a, g, c or t
  misc_feature 617: n=a, g, c or t
  misc_feature 698: y=c or t
  UNSURE 178: Xaa=Gln or Arg
  UNSURE 183: Xaa=Gly or Arg
  UNSURE 186: Xaa= *  or Ala or Glu or Gly or Ile or Lys or Leu or Pro or Gln or Arg or Ser or Thr or Val
agataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccrgggccaagaaggarggagatcannaagactttatccaaggaggaagagaccaagaaataaaacctcccactttgtctgtacatactggcctctgtgattatattyatcagccattaaaataaaacaa

SEQ ID NO: 3849 - DNA, 367 bp, Homo sapiens
  CDS 6..332
  misc_feature 58: s=g or c
  misc_feature 322: r=a or g
  misc_feature 351: s=g or c
  UNSURE 18: Xaa=Ser or Thr
  UNSURE 106: Xaa=His or Arg
agataatgggaggagccgggcccgagcgagctctttcctttcgctgctgcggccgcascatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccrcccctccggctagctcgctggctcccggstcctcccgacgtctcc

SEQ ID NO: 3850 - DNA, 361 bp, Homo sapiens
  CDS 5..346
aacaatggcccaagttttgttcagcaggaatatgagattgaatgtagctttaactttctggagaaagagaagtataagtgaacttgtagcttatttgttgaggatagaagatcttggcgttgtggtagattgccttcctgtgctcaccaattgtttacaggaagaaaaacaatatatctcacttggctgctgtgttgacttgttgcctctagtaaagtcactacttaaaagcaaatttgaagaatatgttatagttggtttaaactggcttcaagcagtcattaaaaggtggtggtcagaactatcatccaaaacagaaattataaatgatggaaatattcaaatttaaaacaacaattaa

SEQ ID NO: 3851 - DNA, 493 bp, Homo sapiens
  CDS 120..470
  misc_feature 449: r=a or g
  misc_feature 472: r=a or g
gggtctctgtaagagtcacacgctttgggcatccttgaaaagaatcttctgaggcctcagcattttatctgagtcttctgaatcccacttagaactgtgttgagctctcacccatcacgatgagcaacaaattcctgggcacctggaaacttgtctctagtgagaactttgacgattacatgaaagctctgggtgtggggttagccaccagaaaactgggaaatttggccaaacccactgtgatcatcagcaagaaaggagatattataactatacgaactgaaagtacctttaaaaatacagaaatctccttcaagctaggccaggaatttgaagaaaccacagctgacaatagaaagaccaagagcatcgtaaccctgcagagaggatcactgaatcaagtgcagagatgggatggcaaagagacaaccataaagagagctagtgartgggaaaatggtagcggaatgtraaatgaagggcgtggtgtgca

SEQ ID NO: 3852 - DNA, 478 bp, Homo sapiens
  CDS 84..416
  misc_feature 394: n=a, g, c or t
  misc_feature 442: n=a, g, c or t
  misc_feature 444: n=a, g, c or t
  UNSURE 104: Xaa=Leu or Pro or Gln or Arg
tagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcataaaaactttaaaaagaagcgcaatcctcgcaaagttaggtggaccaaagcattccggaaagcagctggtaaagagcttacagtggataattcatttgaatttgaaaaacgtagaaatgaacctatcaaataccagcgagagctatggaataaaactattgatgcgatgaagagagttgaagaaatcaaacagaagcgccnagctaaatttataatgaacagatgaagaaaattaaagagctacaggangngttcaggatatcaaagaagtcaagcaaacatcca

SEQ ID NO: 3853 - DNA, 518 bp, Homo sapiens
  CDS 66..458
  misc_feature 11: n=a, g, c or t
  misc_feature 18: r=a or g
gatatgattgncggcgartcgtggttctcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagaagtgagctggagattggatcacagccgaaggagtaaaggtgctgcaatgatgttagctgtgg

SEQ ID NO: 3854 - DNA, 716 bp, Homo sapiens
  CDS 26..706
  misc_feature 464: r=a or g
  misc_feature 494: r=a or g
  misc_feature 540: w=a or t
  misc_feature 683: n=a, g, c or t
  misc_feature 684: n=a, g, c or t
  UNSURE 147: Xaa=Glu or Lys
  UNSURE 157: Xaa=Ala or Thr
  UNSURE 172: Xaa=Lys or Met
  UNSURE 220: Xaa=Ala or Cys or Asp or Phe or Gly or His or Ile or Leu or Asn or Pro or Arg or Ser or Thr or Val or Tyr
ggaagttgctttgttttgcttcgagatggctgcggggatgtatttggaacattatctggacagtattgaaaaccttccctttgaattacagagaaactttcagctcatgagggacctagaccaaagaacagaggacctgaaggctgaaattgacaagttggccactgagtatatgagtagtgcccgcagcctgagctccgaggaaaaattggcccttctcaaacagatccaggaagcctatggcaagtgcaaggaatttggtgacgacaaggtgcagcttgccatgcagacctatgagatggtggacaaacacattcggcggctggacacagacctggcccgttttgaggctgatctcaaggagaaacagattgagtcaagtgactatgacagctcttccagcaaaggcaaaaagagccggactcaaaaggagaagaaagctgctcgtgctcgttccaaagggraaaactcggatgaagaagcccccaagactrcccagaagaagttaaagctcgtgcgcacaagtcctgagtatgggawgccctcagtgacctttggcagtgtccacccctctgatgtgttggatatgcctgtggatcccaacgaacccacctattgcctttgtcaccaggtctcctatggagagatgattggctgtgacaccctgattgttccattgagtnnttccattttgcctgtgtggggctgacaaccaa

SEQ ID NO: 3855 - DNA, 602 bp, Homo sapiens
  CDS 212..514
attgtgggaagtatagggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttcctctgcatcctatgatgtcacaaatgctgagagactgcgaaggaaacgggcacgtgaagtcctgttagcttctcagaaaacagatgcagaagctacagat

SEQ ID NO: 3856 - DNA, 401 bp, Homo sapiens
  CDS 18..392
actagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcaattctgcagcagattgaattagatctaaaagccacccaggccttggtcctagcacccactcgagaattggctcagcagatacagaaggtggtcatggcactcttgtggtaagaagtg

SEQ ID NO: 3857 - DNA, 425 bp, Homo sapiens
  CDS 18..341
  misc_feature 324: n=a, g, c or t
  UNSURE 103: Xaa=Ala or Pro or Ser or Thr
actagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcctatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccagnctttctcaggtcatttttaataatagaagagtctaggattaatattgttataaacatcaagcttaatagttgttttttttataaagaaatgtttccattag

SEQ ID NO: 3858 - DNA, 443 bp, Homo sapiens
  CDS 114..434
gccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaactggaaacctgatgatct

SEQ ID NO: 3859 - DNA, 446 bp, Homo sapiens
  CDS 83..400
  misc_feature 250: r=a or g
  UNSURE 56: Xaa=Ile or Met
aaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccagcactgcctcctaaaccaccaaaacctactactgtagccaacaacggtatgaataacaatatrtccttacaagatgctgaatggtactggggagatatctcgagggaagaagtgaatgaaaaacttcgagatacagcagacgggacctttttggtacgagatgcgtctactaaaatgcatggtgattatactcttacactaggaaaggggaaataacaaattaatcaaaatatttcatcgagatgggaaatatggcttc

SEQ ID NO: 3860 - DNA, 377 bp, Homo sapiens
  CDS 66..374
  misc_feature 312: k=g or t
  UNSURE 83: Xaa=Leu or Val
ttgagattgccgcagaaaaactttttaaccccaatactaacttatactttggggacttctactgtatgtacactgcttatcattatgtgattcttgttattgctcctgtgggatcaccaggagatgaattttgtaagcagcgccttcctcaactaaattctaaggataataaatttttgacctgtacagaagaagatggggtgctggtttaccaccatgcccaggatgtcattttagaagtcatttacactgaccctgtggatctttctctgggcaccgtggcagaaatcactggtcatcagctcatgagtktgtctactgcaaatgcaaagaaagatcccagctgcaaaacctgtaatatcagtgttggacgttaa

SEQ ID NO: 3861 - DNA, 741 bp, Homo sapiens
  CDS 62..412
  misc_feature 482: m=a or c
  misc_feature 484: n=a, g, c or t
ccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgamcntcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccc

SEQ ID NO: 3862 - DNA, 655 bp, Homo sapiens
  CDS 196..513
  misc_feature 395: r=a or g
  misc_feature 396: m=a or c
  misc_feature 398: n=a, g, c or t
  UNSURE 67: Xaa=Asp or Glu or Gly
  UNSURE 68: Xaa=His or Leu or Pro or Arg
atctctgggactcagtgctgcaccgcgtgtacaaagacaaagagatgaatctggggtagatttaggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctgagctggaggggggtctcattctacaaagagagaggtggcccccctttcttgrmcntcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccc

SEQ ID NO: 3863 - DNA, 697 bp, Homo sapiens
  CDS 62..412
  misc_feature 511: s=g or c
  misc_feature 516: s=g or c
  misc_feature 528: r=a or g
ccccgtcccggcccccctgggttccctcagcccagccctgtccagcccggttcccgggaggatgaagttcgtgtacaaagaagagcatccgttcgagaagcgccgctctgagggcgagaagatccgaaagaaatacccggaccgggtgccggtgatagtagaaaaggctcccaaagctcggataggagacctggacaaaaagaaatacctggtgccttctgatctcacagttggtcagttctacttcttgatccggaagcgaattcatctccgagctgaggatgccttgtttttctttgtcaacaatgtcattccacccaccagtgccacaatgggtcagctgtaccaggaacaccatgaagaagacttctttctctacattgcctacagtgacgaaagtgtctacggtctgtgaagctgctgcccctttcttgacctcctcctccttcaagctcaaacaccacctcccttattcaggaccggcacttcttaatgtttgtggctttctctscaagscttctcttaagraggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccc

SEQ ID NO: 3864 - DNA, 801 bp, Homo sapiens
  CDS 409..783
  misc_feature 127: w=a or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcacgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 3865 - DNA, 416 bp, Homo sapiens
  CDS 6..398
tagtaatgtgtaatttatccttgataacggtggaacagatttctctgacgcagattactcgagagggaaagggtgcttctgccagaaatactaacttgtttctgttttgttttggtgagcagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccacc

SEQ ID NO: 3866 - DNA, 532 bp, Homo sapiens
  CDS 30..476
  misc_feature 52: w=a or t
  misc_feature 90: m=a or c
  misc_feature 456: n=a, g, c or t
  misc_feature 457: w=a or t
  misc_feature 458: n=a, g, c or t
  misc_feature 459: n=a, g, c or t
  misc_feature 467: n=a, g, c or t
  misc_feature 470: k=g or t
  UNSURE 8: Xaa=His or Leu
  UNSURE 21: Xaa=Pro or Thr
  UNSURE 143: Xaa= *  or Asp or Glu or Phe or His or Ile or Lys or Leu or Met or Asn or Gln or Val or Tyr
  UNSURE 144: Xaa= *  or Glu or Lys or Gln
  UNSURE 147: Xaa=Asp or Glu
agaagaaggtgaggtcaagagagtgcagaatgaggcattccaatgtgcagcwtcggctggtgtcatcggtgtccttcctccgctgccgcmcccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgnwnnaagttctngaktttttatgaagccaatttccctgcaaatgtcatggatgttattgcaagacagaatttcactg

SEQ ID NO: 3867 - DNA, 665 bp, Homo sapiens
  CDS 68..583
  misc_feature 368: r=a or g
  misc_feature 612: r=a or g
  misc_feature 613: n=a, g, c or t
  UNSURE 101: Xaa=Asp or Asn
ggtgggaacggcgccgagtcagtgtacacgtcggttgcctaacaaccggcagcggactcctttggctatggcctccaactttaagaaggcaaacatggcatcaagttctcagcgaaaaagaatgagccctaagcctgagcttactgaagagcaaaagcaggagatccgggaagcttttgatcttttcgatgcggatggaactggcaccatagatgttaaagaactgaaggtggcaatgagggccctgggctttgaacccaagaaagaagaaattaagaaaatgataagtgaaattgataaggaagggacaggaaaaatgaactttggtgactttttaactgtgatgacccagaaaatgtctgagaaaratactaaagaagaaatcctgaaagctttcaagctctttgatgatgatgaaactgggaagatttcgttcaaaaatctgaaacgcgtggccaaggagttgggtgagaacctgactgatgaggagctgcaggaaatgattgatgaagctgatcgagatggagatggagaggtcagtgagcaagagttcctgcgcatcatgaaaaagaccagcctctattaagatcagtgtcttctttttctactgcrngcacatgtaactagatttagtgcctgccatggtgtgaaatctggcttttgag

SEQ ID NO: 3868 - DNA, 450 bp, Homo sapiens
  CDS 106..423
agcaaacgtctcgctgaggtcatcctttacggcaggcgtccgcgtcgctagctagtcgttctgaagcggcggccagagaagagtcaagggcacgagcatcgggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatatctgga

SEQ ID NO: 3869 - DNA, 447 bp, Homo sapiens
  CDS 85..417
  misc_feature 360: s=g or c
  UNSURE 92: Xaa=His or Gln
cttttttttcaggaagcgttgtacataagtgaaagaaattatgtctgagctgtaatcactctttatattgattgttatactcacatgatcataaatattagccatgtttggtgctgtggagaaatgaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacastcagtgaagtcttcattcagttaccttcaaggaaagaattaccagaatactatgaattaattaaggaagccagtggatttcaaaaaa

SEQ ID NO: 3870 - DNA, 531 bp, Homo sapiens
  CDS 57..443
aaaagacttccggtcggcgtgaggtgaggtgtgggtgttcgtttctcaggtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggcaaagaaaaaggctgaaggcaaagcgagagaaaagaaaggggaaaagcaaagcaaaagcagtgaaagtggcaaagggtttggcctggtagactcttaaaaccttggaaaatgccacatgggatagatgacggattagaatgtatacacatgtatactttgatttcaactgccacc

SEQ ID NO: 3871 - DNA, 471 bp, Homo sapiens
  CDS 106..429
  misc_feature 470: k=g or t
agcatgcgcgccggcgaccacgcctaaatagccgcagcctctgcgcgtcgccctccacggttaccccggctctccgcccctccttctcgcggcgctcgagggaccatggccgatcctcgcgtgagacagatcaagatcaagaccggcgtggtgaagcggttggtcaaagaaaaagtgatgtatgaaaaagaggcaaaacaacaagaagaaaagattgaaaaaatgagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcckg

SEQ ID NO: 3872 - DNA, 559 bp, Homo sapiens
  CDS 33..365
  misc_feature 246: k=g or t
  misc_feature 247: k=g or t
  UNSURE 72: Xaa=Cys or Phe or Gly or Val
gtctctttccgccatctttccgcgccgccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagkktggagtgcagtggcacgatcttggctactgcaacctctgtctcccaggttcaagcgattctcctgcctcagcctccctagtagctgagattacagtgtggggtgatcagccccagatttgacgtgcaactcaaagacctggaaaaatggcagaataatctgcttccatcccgccagtttggtttcattgtactgacaacctcagctggcatcatggaccatgaagaagcaagacgaaaacacacaggaggaaaatcctgggattctttttctagggatgtaatacatatatttacaaataaaatgcctcatg

SEQ ID NO: 3873 - DNA, 527 bp, Homo sapiens
  CDS 99..494
gtctctttccgccatctttccgcgccggtgagtagcactctctgagagctccaatttcatccgtctgccatcggcgccatcctgcaatctaagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggttacattggcgaatttgaaatcattgatgaccacagagctgggaaaattgttgtgaacctcacaggcaggctaaacaagtgtggggtgatcagccccagatttgacgtgcaactcaaagacctggaaaaatggcagaataatctgcttccatcccgccagtttggtttcattgtactgacaactcagctggcatcatggaccatgaagaagcaagacgaaaacacacaggaggaaaatcctgggattctttttctagggatgtaatacatatatttacaaataaaatgcctcatg

SEQ ID NO: 3874 - DNA, 482 bp, Homo sapiens
  CDS 15..479
  misc_feature 61: s=g or c
  UNSURE 16: Xaa=Ser or Thr
tctatggaaagtaaatggtagctcggaagggtcaaaagagtccgcggtttcgccgcgtgasttgctttttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggaatggcagccccatctatgaaggaaagacaggtctgctggggggcccgggatgagtactggaagtgtttagatgagaacttagaggatgcttctcaatgcaagaagttaagaagctctttcgaatcaagttgtccccaacagtggataaaatattttgataaaagaagagactacttaaaattcaaagaaaaatttgaagcaggacaatttgagccttcagaaacaactgcaaaatcctag

SEQ ID NO: 3875 - DNA, 620 bp, Homo sapiens
  CDS 188..568
  misc_feature 161: s=g or c
ggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccastctattaccaggttttaaacttcgccatgatcgtgtcttctgcactcatgatatggaaaggcttgatcgtgctcacaggcagtgagagccccatcgtggtggtgctgagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaaagataatggagacatcaaatttctgactaaaggagataataatgaagttgatgatagaggcttgtacaaagaaggccagaactggctggaaaagaaggacgtggtgggaagagcaagagggtttttaccatatgtggtatggtcaccataataatgaatgactatccaaaattcaagtatgctcttttggctgtaatggg

SEQ ID NO: 3876 - DNA, 508 bp, Homo sapiens
  CDS 68..502
  misc_feature 62: n=a, g, c or t
acagaaccggaagcagcgtgtagttctcttcccttttgcggccatcaccgaagcgggagcgnccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagt

SEQ ID NO: 3877 - DNA, 698 bp, Homo sapiens
  CDS 243..626
  misc_feature 55: k=g or t
  misc_feature 332: w=a or t
  misc_feature 366: r=a or g
  misc_feature 370: y=c or t
  misc_feature 372: r=a or g
  misc_feature 484: n=a, g, c or t
  misc_feature 618: n=a, g, c or t
  misc_feature 619: n=a, g, c or t
  misc_feature 620: w=a or t
  misc_feature 663: m=a or c
  misc_feature 666: m=a or c
  UNSURE 42: Xaa=Asp or Asn
  UNSURE 43: Xaa=Ala or Val
  UNSURE 44: Xaa=Gly or Ser
  UNSURE 81: Xaa=Ile or Lys or Arg or Thr
  UNSURE 126: Xaa= *  or Ala or Cys or Asp or Glu or Phe or Gly or His or Ile or Lys or Leu or Asn or Pro or Gln or Arg or Ser or Thr or Val or Tyr
gacaacagccacacgtgatcggccaacactgagtcttacctcgttgtggcgtcakaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagtwgctaataaaggggagcccttggccctacctttgratgytrgtgaatactgtgtgcctagaggaaatcgtaggcggttccgcgttaggcagcccatcctgcagtatagatgggatatgatgcataggcttggagaaccacaggcaaggatganagaagagaatatggaaaggattggggaggaggtgagacagctgatggaaaagctgagggaaaagcagttgagtcatagtctgcgggcagtcagcactgacccccctcaccatgaccatcatgatgagttttgcnnwatgccctgaatcctgatggtttccctaaagttattacggaaamagmcccctgctttcgaatttacatgttcatgatgt

SEQ ID NO: 3878 - DNA, 662 bp, Homo sapiens
  CDS 207..590
  misc_feature 55: k=g or t
  misc_feature 186: r=a or g
  misc_feature 296: w=a or t
  misc_feature 330: r=a or g
  misc_feature 334: y=c or t
  misc_feature 336: r=a or g
  misc_feature 448: n=a, g, c or t
  misc_feature 582: n=a, g, c or t
  misc_feature 583: n=a, g, c or t
  misc_feature 584: w=a or t
  misc_feature 627: m=a or c
  misc_feature 630: m=a or c
  UNSURE 42: Xaa=Asp or Asn
  UNSURE 43: Xaa=Ala or Val
  UNSURE 44: Xaa=Gly or Ser
  UNSURE 81: Xaa=Ile or Lys or Arg or Thr
  UNSURE 126: Xaa= *  or Ala or Cys or Asp or Glu or Phe or Gly or His or Ile or Lys or Leu or Asn or Pro or Gln or Arg or Ser or Thr or Val or Tyr
gacaacagccacacgtgatcggccaacactgagtcttacctcgttgtggcgtcakaaccgccgtcgctcgctcccttctcggcagtggtacctgttcccggtgtccctgaggacgtgcgggccaggtttgcggggccaagtgttgcggcgacgcacctcacgtcgagaatcgggaggaggagactrcaaggataggcccaggagtaatggagtccaaagaggaacgagcgttaaacaatctcatcgtggaaaatgtcaaccaggaaaatgatgaaaaagatgaaaaggagcaagtwgctaataaaggggagcccttggccctacctttgratgytrgtgaatactgtgtgcctagaggaaatcgtaggcggttccgcgttaggcagcccatcctgcagtatagatgggatatgatgcataggcttggagaaccacaggcaaggatganagaagagaatatggaaaggattggggaggaggtgagacagctgatggaaaagctgagggaaaagcagttgagtcatagtctgcgggcagtcagcactgacccccctcaccatgaccatcatgatgagttttgcnnwatgccctgaatcctgatggtttccctaaagttattacggaaamagmcccctgctttcgaatttacatgttcatgatgt

SEQ ID NO: 3879 - DNA, 461 bp, Homo sapiens
  CDS 35..433
  misc_feature 448: n=a, g, c or t
gcagcgtggccgcgggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaagattcatagtgaccacttagtagctagtgagnaacagcatatgct

SEQ ID NO: 3880 - DNA, 995 bp, Homo sapiens
  CDS 110..604
  misc_feature 774: r=a or g
  misc_feature 827: w=a or t
gcgtcactcagcgctgggtctctcggtcccgcagccgtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagaaatcaagaaaagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaragtctaaagttttattgatgtgaaattaaattcttattggccaaatgcctgtwttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtc

SEQ ID NO: 3881 - DNA, 493 bp, Homo sapiens
  CDS 33..410
  misc_feature 397: n=a, g, c or t
  UNSURE 122: Xaa=His or Leu or Pro or Arg
tcagctgttgcggggcggggccttcgcagagcatggcggcgggcgagcttgagggtggcaaacccctgagcgggctgctgaatgcgctggcccaggacactttccacgggtaccccggcatcacagaggagctgctacggagccagctatatccagaggtgccacccgaggagttccgcccctttctggcaaagatgagggggattcttaagtctattgcgtctgcagacatggatttcaaccagctggaggcattcttgactgctcaaaccaaaaagcaaggtgggatcacatctgaccaagctgctgtcatttccaaattctggaagagccacaagacaaaaatccgtgagagcctcatgaaccagagccgctggaatagcgggcttcggggccntgagctggagagttgatggcaagtctcagtcaaggcactcagctcaaaatacacacacctgttgccattatagagctggaattaggcaaatatgga

SEQ ID NO: 3882 - DNA, 540 bp, Homo sapiens
  CDS 47..424
  misc_feature 475: y=c or t
agaggcctttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcagcgctgtcacccagtgctaccgagacatgggtgcccggcaccgcgcccgagcccactccattcagatcatgaaggtggaggagatcgcggccagcaagtgccgccggccggctgtcaagyagttccacgactccaagatcaagttcccgctgccccaccgggtcctgcgccgtcagcacaagcca

SEQ ID NO: 3883 - DNA, 729 bp, Homo sapiens
  CDS 99..464
  misc_feature 333: k=g or t
  misc_feature 345: n=a, g, c or t
  misc_feature 658: k=g or t
  misc_feature 659: m=a or c
  UNSURE 79: Xaa= *  or Gly
  UNSURE 83: Xaa=Cys or Gly or Arg or Ser
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcngcagttcggcggtcccgcgggtctgtctcttgcttcaacagtgtttggacggaacagatccggggactctcttccagcctccgaccgccctccgatttcctctccgccttccgcatctgtaatcccagctactcaggaatcaggcaggataatcacttccccaccagggaagtggaagttgcattgagctgagatggcactccagtgcactccagcctgggtgacagagcaagactccgtctcaaaaaaaacaaaaaaaacaaaacaaaacaaaaaagcagaaaatagagtcaaagagctcctctgctgtctkmaaatatcgacaatttcacaggatccttctcccataataagatctcctgtatttctgaaagataagtcact

SEQ ID NO: 3884 - DNA, 590 bp, Homo sapiens
  CDS 99..440
  misc_feature 333: k=g or t
  misc_feature 345: n=a, g, c or t
  UNSURE 79: Xaa= *  or Gly
  UNSURE 83: Xaa=Cys or Gly or Arg or Ser
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcngcagttcggcggtcccgcgggtctgtctcttgcttcaacagtgtttggacggaacagatccggggactctcttccagcctccgaccgaccccctgtagtcccagttacacagtagactgagccagggagatcgcttgagcccaaaaggctgaatctgcagtgagctgtgatcatgccactgcactccaggctgggtgacagtgagactcgttcaaaaaaaaaacaaaaaacaaaaaataaaacaa

SEQ ID NO: 3885 - DNA, 604 bp, Homo sapiens
  CDS 99..461
  misc_feature 333: k=g or t
  misc_feature 345: n=a, g, c or t
  misc_feature 590: n=a, g, c or t
  misc_feature 591: r=a or g
  misc_feature 592: m=a or c
  UNSURE 79: Xaa= *  or Gly
  UNSURE 83: Xaa=Cys or Gly or Arg or Ser
acagtgcgtctggccggcgctttatagctgcagcctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagttctcatgctgggccgtgaggkgaaacagcagcngcagttcggcggtcccgcgggtctgtctcttgcttcaacagtgtttggacggaacagatccggggactctcttccagcacaccctggaagaagcacagctatctttcctcatcttctagcccccagtctggggattctgagtctgaccatttgtcttagctcaggcctaacaggattttctgacacagggaagggccctcctcaatcccctaaatcaggggagatggggcctggcttcctccagnrmcatccttgcccg

SEQ ID NO: 3886 - DNA, 442 bp, Homo sapiens
  CDS 27..437
  misc_feature 399: r=a or g
  UNSURE 125: Xaa=Asp or Asn
gctcaggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagaratgttcttgatttctataatgtccctattcaagagatctaaat

SEQ ID NO: 3887 - DNA, 497 bp, Homo sapiens
  CDS 41..493
acagatcatcccaggccacacagaggccggcttggtcactatggaggagataggcatcttggtggagaaggctcaggatgagatcccagcactgtccgtgtcccggccccagaccggcctgtccttcctgggccctgagcctgaggacctggaggacctgtacagccgctacaagaagctgcagcaagagctggagttcctggaggtgcaggaggaatacatcaaagatgagcaaaagaacctgaaaaaggaatttctccatgcccaggaggaggtgaagcgaatccaaagcatcccgctggtcatcggacaatttctggaggctgtggatcagaatacagccatcgtgggctctaccacaggctccaactattatgtgcgcatcctgagcaccatcgatcgggagctgctcaagcccaacgcctcagtggccctccacaagcacagcaatgcactggtggacgtgctgcccccgaagccgacagcagcattatgat

SEQ ID NO: 3888 - DNA, 450 bp, Homo sapiens
  CDS 52..429
  misc_feature 210: y=c or t
  misc_feature 219: m=a or c
  misc_feature 222: y=c or t
  misc_feature 225: r=a or g
  misc_feature 234: s=g or c
  misc_feature 249: y=c or t
  misc_feature 252: y=c or t
  misc_feature 267: r=a or g
  misc_feature 276: m=a or c
  misc_feature 291: y=c or t
  misc_feature 297: s=g or c
  misc_feature 300: y=c or t
  misc_feature 342: s=g or c
  misc_feature 351: y=c or t
  misc_feature 366: r=a or g
  misc_feature 384: w=a or t
atttttatttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatacyggcatctcmtcyaargccatgggsatcatgaattccttygtyaacgacatcttcgarcgcatcgcmggcgaggcttcccgyctggcscaytacaacaagcgctcgaccattacctccagggagatccagacsgccgtgcgyctgctgcttcccggrgagctggccaagcacgcwgtgtcagagggcaccaaggccgttaccaagtacaccagctccaagtaaacttgtccctgcaactgc

SEQ ID NO: 3889 - DNA, 447 bp, Homo sapiens
  CDS 49..426
  misc_feature 381: y=c or t
  misc_feature 387: r=a or g
  misc_feature 405: y=c or t
attattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgcygtgtcrgagggcaccaaggccgtyaccaagtacaccagctccaagtaaacttgtccctgcaactgc

SEQ ID NO: 3890 - DNA, 942 bp, Homo sapiens
  CDS 315..839
atatccagggattccctgaggatttccttggagagagaagctctagggaggatggagaccccctcttctggaaggaggtgatttctgaatttgtggtcctgtcctcttgggctcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 3891 - DNA, 856 bp, Homo sapiens
  CDS 4..753
  misc_feature 51: s=g or c
  misc_feature 117: s=g or c
  misc_feature 118: k=g or t
  misc_feature 159: r=a or g
  misc_feature 160: s=g or c
  misc_feature 182: r=a or g
  misc_feature 183: r=a or g
  UNSURE 16: Xaa=Asp or Glu
  UNSURE 38: Xaa=His or Gln
  UNSURE 39: Xaa=Ala or Ser
  UNSURE 53: Xaa=Glu or Gln
  UNSURE 60: Xaa=Glu or Gly
aacatgacttctgccttcaagctggatttcctcccggacatgatggtcgasggccgcctgctcgttcctgacagaattaacggcacagccaacaagatgaacggagctttggatcaskcagaccaaccagacccagatgccattaagatgtttgtcggrsagatcccccggtcatggtcggrraaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 3892 - DNA, 695 bp, Homo sapiens
  CDS 269..592
  misc_feature 44: s=g or c
  misc_feature 45: s=g or c
atccttgcgactggtcccctgggtgatctgtcttcttctctgtssctgtaaataaagtttgggtctgatcaccatgagccttaggtatcactgtggtggctccctgaagcagacagctatgtttatttaaaaaggagattttttaagcagagaagagaaggatgaattacccggacagaaagcagctctgcagaataagacagcacctgtgtaatcagtatttttgccctctttctcccatcccattcccttaccttgctatttctagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 3893 - DNA, 497 bp, Homo sapiens
  CDS 36..461
  misc_feature 357: r=a or g
  misc_feature 467: r=a or g
  UNSURE 108: Xaa=Ile or Val
aagacgggagaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctgrtttctcggaagcctgactgggacctcaagagagatgtggccaagaagctggagaaactaaaaaagcggactcagagggccattgccgagctgatccgtgaaggctgaaargccaggaagacagcctagcctctgcagtgg

SEQ ID NO: 3894 - DNA, 482 bp, Homo sapiens
  CDS 29..352
  misc_feature 401: r=a or g
  misc_feature 404: m=a or c
gtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttartgmctttccctgctgttacctaattacaaattggatggaactgtgtttttttctgctttgttttttcagtttgctgtttct

SEQ ID NO: 3895 - DNA, 633 bp, Homo sapiens
  CDS 259..624
  misc_feature 591: n=a, g, c or t
  misc_feature 616: y=c or t
  UNSURE 111: Xaa=His or Gln
  UNSURE 120: Xaa=Phe or Leu
acacataacctcgattttcttccgccatccggctaaatagtcccatgtgcactttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtccccancaaagcccatgtaaggagctgagtyttaaagactgaagacag

SEQ ID NO: 3896 - DNA, 463 bp, Homo sapiens
  CDS 31..459
catgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagaatgaaggcatatatctcttctgat

SEQ ID NO: 3897 - DNA, 506 bp, Homo sapiens
  CDS 76..468
  misc_feature 437: s=g or c
  UNSURE 121: Xaa=Arg or Thr
cgagaaagggaagtgcattctcgcttccgtagcggtctccgccggttgggggaaagtaattccggctgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggggatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagagaagcggasaattgctagccgggcattcacccaatcagaatagccgatggctatgagcaggctgctcgcgttgctatt

SEQ ID NO: 3898 - DNA, 515 bp, Homo sapiens
  CDS 43..471
gcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaactttcatatg

SEQ ID NO: 3899 - DNA, 596 bp, Homo sapiens
  CDS 86..412
  misc_feature 544: w=a or t
  misc_feature 593: w=a or t
aaaaacgtcatcgcgggcgcgacgcctgagggacagtctggggtttggctgtccggacggtgcagcggcgaggccggccgcgaagatgccagtggcggtgatggcggaaagcgcctttagtttcaaaaagttgctggatcagtgcgagaaccaggagctcgaggcccctggaggaattgctacacccccagtgtatggtcagcttctagctttatatttgctccataatgacatgaataatgcaagatatctttggaaaagaataccacctgctataaaatctgcaaattctgaacttgggggaatttggtcagtaggacaaagaatctggcagagagatttccctgggatctatacaaccatcaacgctcaccagtggtctgagacggtccagccaattatggaaagcacttagagatgcaacaaggagacgcgcctttgccctggtctctcaagcgtatacttcaatcatcgccgatgattttgcagcctttgttggacttcctgtagaagaggcttgtgaaaggcatattagaacaaggawggcaagctgaattccaccacaagaaatggttctgcccagaaagccagtwgca

SEQ ID NO: 3900 - DNA, 552 bp, Homo sapiens
  CDS 126..527
  misc_feature 539: w=a or t
gccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgwaccatagtaacac

SEQ ID NO: 3901 - DNA, 565 bp, Homo sapiens
  CDS 29..391
  misc_feature 222: n=a, g, c or t
  misc_feature 251: n=a, g, c or t
  misc_feature 278: n=a, g, c or t
  misc_feature 298: r=a or g
  misc_feature 299: r=a or g
  misc_feature 301: n=a, g, c or t
  misc_feature 309: w=a or t
  misc_feature 312: r=a or g
  misc_feature 313: r=a or g
  misc_feature 316: r=a or g
  misc_feature 342: r=a or g
  misc_feature 346: n=a, g, c or t
  misc_feature 363: w=a or t
  UNSURE 65: Xaa=Ile or Lys or Arg or Thr
  UNSURE 75: Xaa=Ala or Pro or Ser or Thr
  UNSURE 84: Xaa= *  or Glu or Lys or Gln
  UNSURE 91: Xaa=Asp or Glu or Lys or Asn
  UNSURE 94: Xaa=Lys or Met
  UNSURE 95: Xaa=Gln or Arg
  UNSURE 105: Xaa=Lys or Arg
  UNSURE 106: Xaa=Asp or Glu
  UNSURE 112: Xaa=Glu or Val
gcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttanaccagttgctgttgagcagaaagagagtncgagccgcatttgtgctactgtgaaanagactatgaatatgatacarranctacagawgcrracrgacctggagctgtcaccactgactaragangagaaaactgcggcagwgcaattcagatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggc

SEQ ID NO: 3902 - DNA, 448 bp, Homo sapiens
  CDS 97..402
gctgcggtgattttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaatatggaggcaccaaagtagttctagatgacaaggattatttcctatttagagatggtgacattcttggaaagtacgtagactgaaataagtcactattgaaatggcatcaacatgatgctgcccatt

SEQ ID NO: 3903 - DNA, 615 bp, Homo sapiens
  CDS 158..508
  misc_feature 44: s=g or c
  misc_feature 58: b=c or g or t
  misc_feature 59: y=c or t
  misc_feature 66: s=g or c
  misc_feature 139: k=g or t
  misc_feature 258: n=a, g, c or t
  misc_feature 271: n=a, g, c or t
  misc_feature 603: n=a, g, c or t
  UNSURE 34: Xaa=Ile or Asn or Ser or Thr
aagttcctcgccagcttagagggaaggctgcccgaatacaacasccgcatcgccctgbyccttgcsacttccaaggacaagttttttgacgaagagagtgaggaggaggacaacgaggtagtgacccgcgcaacaagtkctctgtgacggggaagacatgctcggaaggggcggatgctgtaggggtgccggggatgcaccaccccaagaccccatggaaatggcagaggtggaggagacactgaagcgactgcaganccagaagggagtncagggaatcatcgtcgtgaacacagaaggcattcccatcaagagcaccatggacaaccacaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtngcttggaaccca

SEQ ID NO: 3904 - DNA, 632 bp, Homo sapiens
  CDS 186..515
  misc_feature 140: r=a or g
  misc_feature 496: n=a, g, c or t
  misc_feature 497: n=a, g, c or t
  UNSURE 104: Xaa= *  or Cys or Phe or Leu or Ser or Trp or Tyr
aactcagcctaccgacaggcactgtgcagattcaagcggagagatgtccaagcagtgaggccgctgctgcaccggccatcctgagcccctactcggccttcccgtctccgcttccccgccccgcactaggaccccctgcrgatgatcagggcggcaggaggtgatttccttcctcttttggcaacatggcgggcggagaagctggagtgactctagggcagccgcatctttcgcgtcaggatctcaccaccttggatgttaccaagttgacgccactttcacatgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatnnttgtgggagcagtacacctgacgagtttcctacggacattccagggaccaaagggacttcaaattagtcagacatgtttcctttgttgactgtcctggccacgatattttgatggctactatgctgaacggtgca

SEQ ID NO: 3905 - DNA, 547 bp, Homo sapiens
  CDS 136..513
agtgctggggagcagggaggtgggaggggagggtgcccctacaaatcccgggggctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggagagctggctgagattttcagggcctccggggagcacgtgactgacgaggagatcgaatctctgatgaaagg

SEQ ID NO: 3906 - DNA, 658 bp, Homo sapiens
  CDS 109..624
  misc_feature 525: n=a, g, c or t
agtttgggaggaaggcttctgagaagactggtgggagagaaggagagcctgcagacagaggcctccagcttggtctgtctccccacctctaccagcatctgctgagctatgagccaaaccagggatttacagggaggaaaagctttcggactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagcnagaaagctatctctgagttgccctgatttgaagggaaaagggatgatgggattgaaggggcttctaattacccagatatggaaacagaagacaaaattgtaagccagagtcaacaaattaaataaattacccc

SEQ ID NO: 3907 - DNA, 442 bp, Homo sapiens
  CDS 111..431
caataaatctgaaataagtcaagtgtttgagattgcttaaacggaacttgcctgtgaatttcgagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaagccacagacaagcccagaatatggccaggggatcaatccgattagccgactggcccagatccagcaggcaaaaaaggagaaggagcagagtacacgctcctcacagagcgaggcctcccgcgccgcagggagtttgtgatgcaggtg

SEQ ID NO: 3908 - DNA, 513 bp, Homo sapiens
  CDS 109..480
  misc_feature 464: k=g or t
  UNSURE 119: Xaa=Leu or Trp
agaaggtttccggttccggtgtaacgttcgggctccgtctcaggggctgaagtttgtgaggtgtagtattgagtcctgtttgagctattgttctctttttcctgaaaaatggcactgtcaaagagggagctggatgagctgaaaccatggatagagaagacagtgaagagggtcctgggtttctcagagcctacggtggtcacagcagcattgaactgtgtggggaagggcatggacaagaagaaggcagccgatcatctgaaaccttttcttgatgattctactctccgatttgtggacaaactgtttgaggctgtggaggaaggccgaagctctaggcattccaagtctagcagtgacaggagcagaaaacgagagctaaaggaggtgtttggtgatgactctgagatctctaaagaatcatcaggagtaaagaagcgacgaataccccgttttgaggagtkgaagaagagccagaggtgatccctgggcctccatcagagagcctggcat

SEQ ID NO: 3909 - DNA, 482 bp, Homo sapiens
  CDS 132..452
cacgccgcgtcacgagtcagccaaagatggctgcgcccaggtaatttgagcaaaggccacagtgaactccggcgtggctgaggaaggaggaggcacccacaggctgctgggaggagagcataaggctcaaaatggaaaatcataaatccaataataaggaaaacataacaattgttgatatatccagaaaaattaaccagcttccagaagcagaaaggaatctacttgaaaatggatcggtttatgttggattaaatgctgctctttgtggcctcatagcaaacagtctttttcgacgcatcttgaatgtgacaaaggctcgcatagctgctggcttaccaatggcagggataccttttcttacaacagacttaacttacagatgttttgtaagttttcctttgaatacaggtgatttggattgtgaaacctgtaccataacacggagtgactgactggtcttgttattggtggtctatacc

SEQ ID NO: 3910 - DNA, 438 bp, Homo sapiens
  CDS 75..428
  misc_feature 106: s=g or c
  misc_feature 376: n=a, g, c or t
  misc_feature 377: w=a or t
  UNSURE 11: Xaa=Ser or Thr
  UNSURE 101: Xaa= *  or Cys or Phe or Leu or Ser or Tyr
gcgtttccgcttccgccatcgcggacgcagcctcgtgccgggagtcgccgcattgtggtccgcttctctgcactatgtcgggtggcctcctgaaggcgctgcgcascgactcctacgtggagctgagccagtaccgggaccagcacttccggggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgtttgtggaatattactcacgcgcagatgcggaaaacgccatgcggtacatnwatgggacgcgtctggatgaccgaatcattcgcacagactgggacgcagctttaaggagagc

SEQ ID NO: 3911 - DNA, 663 bp, Homo sapiens
  CDS 260..625
atgaacggaagtcaccctttgtgccttatgcggtgattttaatgataggtgtcatatataggacggagtaatctgtttacattctgttcttctcgatgcactcacaagcgggtaactaggtgacaagaaaacaaagatcttattcaaaagaggtcttacagcaacccaacgtctcatcttcccatagtaaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagctgggtccatggctggcagtggaaatccctgatctgattcagaagggcgtcatccaacacaaagagaaatgc

SEQ ID NO: 3912 - DNA, 614 bp, Homo sapiens
  CDS 211..576
cttttgattctgcatggtttctaatctttatcaggagttaaacatccttctacaggataactgcatctagaggcaggactatatataagcaaaggaaaagttcttcgaagaggaaacacgaatcgctcgttttaggaataaagatgacggcgccttgaggtaagctacaggcaacaccacttccgcgtttctcttgcgccctggtccaagatggcggatgaagccacgcgacgtgttgtgtctgagatcccggtgctgaagactaacgccggaccccgagatcgtgagttgtgggtgcagcgactgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacagctgggtccatggctggcagtggaaatccctgatctgattcagaagggcgtcatccaacacaaagagaaatgc

SEQ ID NO: 3913 - DNA, 392 bp, Homo sapiens
  CDS 48..383
atttccgggcgtcacgtaacggagtggccaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaaggaaagatacctcctactccattctctgctcctcctcctgcaggggcgatgataccacctccccccagccttccgggtcctcctcgccctggtatgatgccagcaccccatatggggggccctcccatgatgccaatgatgggcctcctcctcctgggatgatgcagt

SEQ ID NO: 3914 - DNA, 429 bp, Homo sapiens
  CDS 25..405
cacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactccggacacggctatagaggaaatcaaagagaaaatgaagactgtaaaacacaaaatcttggtattgtctgggaaaggcggtgttgggaaaagcacattcagcgcccaccttgcccatggcctagcagaggatgaaaacacacagattgctcttctagacatcgatatatgtgggccatcgattcccaagataatgggattggaaggagagcaggttcaccagagtggctcaggctggtctccagtgtacgtggaagacaactgggggtgatgtcagtgggcttcctgctca

SEQ ID NO: 3915 - DNA, 422 bp, Homo sapiens
  CDS 25..405
  misc_feature 183: n=a, g, c or t
  misc_feature 318: k=g or t
  misc_feature 360: m=a or c
  misc_feature 391: n=a, g, c or t
  misc_feature 396: k=g or t
  UNSURE 98: Xaa=Ile or Met
  UNSURE 112: Xaa=Asp or Glu
  UNSURE 123: Xaa=Ala or Pro or Ser or Thr
cacgaaggcggcaaaggcgacggaatggaggaggtgcctcacgactgtccaggggccgacagcgcccaggcgggcagaggggcttcatgtcagggatgccccaaccagcggctgtgcgcttctggagcgggggccactgcggacacggctatagaggaaatcaaagagaaaatgaagactgtnaaacacaaaatcttggtattgtctgggaaaggcggtgttgggaaaagcacattcagcgcccaccttgcccatggcctagcagaggattttggacaaggctgccagaaagtgttgctactggaagaaaagtatatkatttcactttggttttttttgtgtattgttttttccagagamagggtctcactctgttgcccaggctggagtncagtkgcgcgatcataactcctgggctcaag

SEQ ID NO: 3916 - DNA, 1007 bp, Homo sapiens
  CDS 345..962
  misc_feature 89: k=g or t
  misc_feature 90: n=a, g, c or t
  misc_feature 94: r=a or g
  misc_feature 337: s=g or c
  misc_feature 617: r=a or g
  misc_feature 620: y=c or t
  misc_feature 632: r=a or g
  misc_feature 695: y=c or t
  misc_feature 722: y=c or t
  misc_feature 734: s=g or c
  misc_feature 740: y=c or t
  misc_feature 765: y=c or t
  misc_feature 797: s=g or c
  misc_feature 854: y=c or t
  misc_feature 863: r=a or g
  misc_feature 866: r=a or g
  misc_feature 950: n=a, g, c or t
  misc_feature 1002: y=c or t
  UNSURE 141: Xaa=Phe or Leu
  UNSURE 202: Xaa=Phe or Leu
ataatggatgctcggccgactgcttctgcacggtctctttgtctaaaggatgcaaacagtctacggatgctagagaaaaaggggtgggknagarattacctcatcccacgtcgcttgcaccaatcaccagtctcctgtcatggcttctctgggcagattgggggtctggaccaacaggaaaaggccccggcccatccccatggtgaccgagttgtatatagggagccgcatccgcctatgtgccgcaggttctcttacatcgaccgcctaagagtcgcgctgtaagaagcaacaacctctcctcttcgtctccgccatcagctcggcagtcgcgaasagcaaccatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgagacgggggctggcaagcatgtgccccgggcagtgtttgtagacttggaacccacagtcattgatgaagttcgcactggcacctaccgccagctcttccaccctgagcarctyatcacaggcaargaagatgctgccaataactatgcccgagggcactacaccattggcaaggagatcattgacctygtgttggaccgaattcgcaagctggcygaccagtgcacsggtctycagggcttcttggttttccacagcyttggtgggggaactggttctgggttcacctcsctgctcatggaacgtctctcagttgattatggcaagaagtccaagctggagttctcyatttacccrgcrccccaggtttccacagctgtagttgagccctacaactccatcctcaccacccacaccaccctggagcactctgattgtgccttncatggtagacaatgaggccatctatgacatctgtcgtagaaacctcgatatygagcg

SEQ ID NO: 3917 - DNA, 765 bp, Homo sapiens
  CDS 103..720
  misc_feature 348: y=c or t
  misc_feature 480: y=c or t
  misc_feature 492: s=g or c
  misc_feature 498: y=c or t
  misc_feature 523: y=c or t
  misc_feature 524: y=c or t
  misc_feature 526: k=g or t
  misc_feature 555: s=g or c
  misc_feature 612: y=c or t
  misc_feature 621: r=a or g
  misc_feature 624: r=a or g
  misc_feature 708: n=a, g, c or t
  misc_feature 760: y=c or t
  UNSURE 141: Xaa=Phe or Leu or Pro or Ser
  UNSURE 142: Xaa=Cys or Gly
  UNSURE 202: Xaa=Phe or Leu
tcactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacytaccgccagctcttccaccctgagcagctcatcacaggcaaggaagatgctgccaataactatgcccgagggcactacaccattggcaaggagatcattgaccttgtgttggaccgaattcgcaagctggcygaccagtgcacsggtctycagggcttcttggttttccacagcyytkgtgggggaactggttctgggttcacctcsctgctcatggaacgtctctcagttgattatggcaagaagtccaagctggagttctcyatttacccrgcrccccaggtttccacagctgtagttgagccctacaactccatcctcaccacccacaccaccctggagcactctgattgtgccttncatggtagacaatgaggccatctatgacatctgtcgtagaaacctcgatatygagcg

SEQ ID NO: 3918 - DNA, 455 bp, Homo sapiens
  CDS 28..351
  misc_feature 168: r=a or g
  misc_feature 415: n=a, g, c or t
gcgcgtgtgctggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcarctcaccgaagatgtggccaagttggaaaaagaaatggaacagaaacatagagaggaactggagcaattgaagctgactactaaggagaataagatagattctgttgctgttaacatttcaaacttggtgcttgagaatcagccacctcggatatcaaaagcacaaaagagacgggtgcctggatagaaggagctctctgtgttgtccttggtccctgctctgctcttaccagctgtaggcctttggnaatctctctgcgtgctgtttcctcagaagaggaaaatgag

SEQ ID NO: 3919 - DNA, 493 bp, Homo sapiens
  CDS 79..483
  misc_feature 245: r=a or g
  UNSURE 56: Xaa=Asp or Gly
ggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggrtatggcgaaggccacccagctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggggaaagctgggaacgagaggttaagcagctg

SEQ ID NO: 3920 - DNA, 1021 bp, Homo sapiens
  CDS 105..716
  misc_feature 82: k=g or t
ccctttccgtctggcggcagccatcaggtaggctgcgttgaggatctttgctcttccatccgcctttgatcgtcttcctctkgccagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagcc

SEQ ID NO: 3921 - DNA, 1040 bp, Homo sapiens
  CDS 124..735
attttcattcccggcggtttccttgtttttgttggggaactaagatggacggatacaggtcgtcttattgtacttaaagcggatgatatttaatacacagtttgatttcacaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagcc

SEQ ID NO: 3922 - DNA, 472 bp, Homo sapiens
  CDS 54..359
  misc_feature 439: w=a or t
gacgttgctcttgtgttctcgcgagaggcgggaaagggcgcagggtttgaaacatggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagwgaaacctgcatacattttgatattaagaaataa

SEQ ID NO: 3923 - DNA, 873 bp, Homo sapiens
  CDS 115..687
gcccctgtccggcagccgaggagatcccgcgcagtgctgccaacgccccggtggagaagctgaggtcatcatcagatttgaaatatttaaagtggatacaaaactatttcagcaatgcagacaattaagtgtgttgttgtgggcgatggtgctgttggtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctccca

SEQ ID NO: 3924 - DNA, 999 bp, Homo sapiens
  CDS 241..813
  misc_feature 76: s=g or c
  misc_feature 272: r=a or g
  misc_feature 273: k=g or t
  misc_feature 316: r=a or g
  misc_feature 317: r=a or g
  UNSURE 11: Xaa=Asp or Glu or Gly
  UNSURE 26: Xaa=Asp or Gly or Asn or Ser
gcccctgtccggcagccgaggagatcccgcgcagtgctgccaacgccccggtggagaagctgagacggagtctcastgtgttccccaggctggagtgcagtggcgccatcttggctcactgcagtgcgcctctgccccccgagttcaagcgattctcctgcctcaggctcctgagtagctgggactacaggtcatcatcagatttgaaatatttaaagtggatacaaaactatttcagcaatgcagacaattaagtgtgttgttgtgggcgrkggtgctgttggtaaaacatgtctcctgatatcctacacaacarrcaaatttccatcggaatatgtaccggctgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaacgtgaaagaaaagtgggtgcctgagataactcaccactgtccaaagactcctttcttgcttgttgggactcaaattgatctcagagatgacccctctactattgagaaacttgccaagaacaaacagaagcctatcactccagagactgctgaaaagctggcccgtgacctgaaggctgtcaagtatgtggagtgttctgcacttacacagaaaggcctaaagaatgtatttgacgaagcaatattggctgccctggagcctccagaaccgaagaagagccgcaggtgtgtgctgctatgaacatctctccagagccctttctgcacagctggtgtcggcatcatactaaaagcaatgtttaaatcaaactaaagattaaaaattaaaattcgtttttgcaataatgacaaatgccctgcacctacccacatgcactcgtgtgagacaaggcccataggtatggccccccccttccccctccca

SEQ ID NO: 3925 - DNA, 486 bp, Homo sapiens
  CDS 138..446
  misc_feature 189: n=a, g, c or t
  misc_feature 204: k=g or t
  misc_feature 206: s=g or c
  misc_feature 283: k=g or t
  UNSURE 18: Xaa=Ala or Pro or Ser or Thr
  UNSURE 23: Xaa= *  or Asp or Glu or Tyr
  UNSURE 49: Xaa=Gly or Val
gagttcggcatgcaagagcggaagaaaagcggctggtaccccggaagcagtcgctgcaacttccgggaggtgcttgtgtgcctggtgcgggagctacggggcccagggattgtgtttaaagtagtgcttctaccaacatgtcccgtggttccagcgccggttttgaccgccacattaccattttttcanccgagggtcggctckascaagtagaatatgcttttaaggctattaaccagggtggccttacatcagtagctgtcagagggaaagactgtgcagkaattgtcacacagaagaaagtacctgacaaattattggattccagcacagtgactcacttattcaagataactgaaaacattggttgtgtgatgaccggaatgacagctgacagcagatcccaggtaatatctgttttgatgaatttgaaggcaattgatttgtaaccaaaccatagaagccatatccaatcccattcactgg

SEQ ID NO: 3926 - DNA, 443 bp, Homo sapiens
  CDS 53..388
atttcccagcatcccgcgcgccgcagacccacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagccagtttgaagccctggggtcctctattggagtgcagagtgctgtgattgtaggtggaatt

SEQ ID NO: 3927 - DNA, 470 bp, Homo sapiens
  CDS 23..412
  misc_feature 220: n=a, g, c or t
  misc_feature 263: r=a or g
  misc_feature 437: m=a or c
  UNSURE 66: Xaa=Phe or Leu
  UNSURE 81: Xaa=Gly or Arg
tgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttnatctgtgtgaaagctttgaaaaccagatacattggtgaagtargagacatcgtagtgggacgaatcacagaggttcaacagaagaggtggaaggtggagaccaactccaggctggattcggtcttgctgctctcgtccatgaaccttcctggaggagagctgaggagagatctgcagaagatgagcttgcaatgagaggtttcttacaggaaggggmcttatcagtgctgaggtcaggcagtgttctctg

SEQ ID NO: 3928 - DNA, 488 bp, Homo sapiens
  CDS 74..478
  misc_feature 365: s=g or c
  misc_feature 381: r=a or g
  misc_feature 450: n=a, g, c or t
  UNSURE 98: Xaa=Ala or Pro
  UNSURE 103: Xaa=Glu or Gly
  UNSURE 126: Xaa= *  or Leu or Ser or Trp
agaaggcccgcagccaagcgagtggtaagaggacgccgagagagccccggacccacggagcagccccaaggctatggcgggacacccgaaagagagggtggtcacagatgaggtccatcagaaccagatcttgcgggagctgtacctcaaagagttacgaacccagaaactccacacgcagtaccatgtgaatcccctgcgcaaggttcacaggattacgaggaagcctatgtcttggcatgataacctggaggaacccgcagacgccaggtttctgaatctcattcaccatgctgcccaggggccaacgaagaagtacccggaggcacagactgaaaaccaggaaattgggtgggactcagaasccttggtcgacccagracgccgtgaccacaggatgaaccacttcagggtctacagtgacatcactctgtacaaagctaaaatgtnggacttgggagaagatgatcgccacaagtagcatctca

SEQ ID NO: 3929 - DNA, 745 bp, Homo sapiens
  CDS 137..676
  misc_feature 656: s=g or c
  misc_feature 657: r=a or g
  misc_feature 658: n=a, g, c or t
  misc_feature 660: w=a or t
  misc_feature 744: r=a or g
  misc_feature 745: w=a or t
  UNSURE 174: Xaa=Asp or Glu or Gly or His or Gln or Arg
  UNSURE 175: Xaa= *  or Leu
atttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctgsrntwaggtatggaacctggctaactgcaagctgaagaccaaccacattggccacacaggctatctgaacacggtgactgtctctccarw

SEQ ID NO: 3930 - DNA, 499 bp, Homo sapiens
  CDS 100..426
agacgcgccgcggtccccgcctgccgctgctccgccgcagtcgccgctccagtctatccggcactaggaacagccccgggcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagccccgatcaagaacatcctgtgccagaaggtaagaaaatattaaagggtgatggaaacatgttaaaaagacacagaagccagcatgaaaatgcctggtgattaaggataatttgagcattgaagtaaatgatagaaatggatgccattccatagattaaataagaatcta

SEQ ID NO: 3931 - DNA, 452 bp, Homo sapiens
  CDS 51..419
  misc_feature 383: r=a or g
  misc_feature 384: m=a or c
  misc_feature 423: r=a or g
gcctactctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccaagctctctaagatccgagtcgtccggaaatccattgcccgtgttctcacagttattaaccagactcagaaagaaaacctcaggaaattctacaagggcaagaagtacaagcccctggacctgcggcctaagaagacacgtgccatgcgccgccggctcaacaagcacgaggagaacctgaagaccaagaagcagcagcggaaggarmggctgtacccgctgcggaagtacgcggtcaaggcctgargggcgcattgtcaataaagcacagctggc

SEQ ID NO: 3932 - DNA, 627 bp, Homo sapiens
  CDS 74..433
  misc_feature 608: n=a, g, c or t
aggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggcnactcggccgcgccagtcgt

SEQ ID NO: 3933 - DNA, 511 bp, Homo sapiens
  CDS 36..404
  misc_feature 425: r=a or g
aagtacggaccgtgaactggagtggaatcgcgactatgggagctccggggggaaagatcaaccggccccgaacggagctgaagaagaagctgttcaaacgccggcgggtgttgaatcgggagcggcgtctgaggcaccgggtggtcggggctgtgatagaccaagggctgatcacgcggcaccacctcaagaagcgggcgtccagtgcacgtgccaacattacactgtcagggaagaagcgcagaaaactcctccagcagatccggcttgcccagaaagagaagacagccatggaagtggaagccccttcaaagccagccaggactagtgaaccacagctcaaaaggcaaaagaagacaaaagccccccaggatgtagaaatgaaggaccttgaagatgagagctaaacctcttccactagaagrttctcaactggagccagccttcagactcagtggttgtttcagaggactttgacaaaagcaaggcccttttcactctccagatttcc

SEQ ID NO: 3934 - DNA, 449 bp, Homo sapiens
  CDS 58..396
agcatacgccgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagtttggaaaggttcttctagcaagacacaaggcagaagaagtgttctatgcagtcaaagttttacagaag

SEQ ID NO: 3935 - DNA, 420 bp, Homo sapiens
  CDS 37..393
actttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcatttgttaatagctgctatattaaaagtgaggaggccaaacgccaacaacttgggataggagaaagaagctgttcttctgaatcttaaaagtaatcaagaactatccgaaca

SEQ ID NO: 3936 - DNA, 419 bp, Homo sapiens
  CDS 70..411
aagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggaccaaaatacattatcaacgtaaagcag

SEQ ID NO: 3937 - DNA, 357 bp, Homo sapiens
  CDS 20..346
aaggtgctttagtctgaagatggcggcctcagcagcgcgaggtgctgcggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcag

SEQ ID NO: 3938 - DNA, 518 bp, Homo sapiens
  CDS 75..467
  misc_feature 487: w=a or t
aggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgcattatgaagctacaacattttccwtcttctataacaacactctgttcctggtcgt

SEQ ID NO: 3939 - DNA, 451 bp, Homo sapiens
  CDS 92..406
  misc_feature 56: s=g or c
ctctggcctgcgcctcctgagccgagtagatatcccggagttccgcgcggcgccasccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgac

SEQ ID NO: 3940 - DNA, 474 bp, Homo sapiens
  CDS 71..385
  misc_feature 7: s=g or c
  misc_feature 348: r=a or g
  misc_feature 398: n=a, g, c or t
  UNSURE 93: Xaa=Asp or Gly
gaggcgscggaagtagtgtaaccagctgggagccagccggcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggrcccaaggaagtttgccaggttaaagacttgcttactatgaatgaagaatnggaaacgagctagaaaagcatttgatgaagcaaattatggatcttgacactttttgtagtttccgaaaattaccat

SEQ ID NO: 3941 - DNA, 614 bp, Homo sapiens
  CDS 189..524
  misc_feature 490: s=g or c
  misc_feature 491: y=c or t
  misc_feature 492: s=g or c
  misc_feature 494: n=a, g, c or t
  UNSURE 101: Xaa=Ala or Gly
  UNSURE 102: Xaa=Ala or Pro
ggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgsyscnacctgtaagaacagaaaatcgtcttatagttgagaatttatcctcaagagtcagctggcaggtttgttgaaatacagttttgagttattttgatgtggctttttaaaaaagttaatgggt

SEQ ID NO: 3942 - DNA, 473 bp, Homo sapiens
  CDS 124..432
catcagctgccttccccgggcgtctccccgcaacctcctcaacttccctagtcagtgacgcggcgccggccagaaatccgaccggaccgggctcgggggagcgtgagttgcagttaaaagaagatggatgcacagtgttcagccaaggtcaatgcaaggaagaggagaaaagaggcgcccggacccaacggggcaacagaagaagatggggttccttccaaagtgcagcgctgtgcagtgggcttacggcaaccagctcctttttctgatgaaattgaagttgactttagtaagccctatgtcagggtaactatggaagaagccagcagaggaactccttgtgagcgacctgtgagagtttatgccgatggaatatttgacttatttcactctggtcacgcccgagctctgatgcaagcgagaaccttttcctaatacgtacctcattgtgggagtttgcagtgatgagctca

SEQ ID NO: 3943 - DNA, 553 bp, Homo sapiens
  CDS 99..431
ctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggaaaatttctaccttgaaccgtatctgaaagaggttattcgggaaagaaaagaaagagaagaatgggcaaagaagtaatcatgtagttgaagtctgtggatgcagctgttatgaagatggttaaacttgaaacaaacaattttaagaattatttggtctgaagatgttttactttaaataaatgtctattgtaatgg

SEQ ID NO: 3944 - DNA, 496 bp, Homo sapiens
  CDS 40..492
ctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggctgcccaggatgtggcccagaggtgcaaggagctgggtatcaccgccctacacatcaaactccgggccacaggaggaaataggaccaagacccctggacctggggcccagtcggccctcagagcccttgcccgctcgggtatgaagatcgggcggattgaggatgtcacccccatcccctctgacagcactcgcaggaaggggggtcgccgtggtcgccgtctgtgaa

SEQ ID NO: 3945 - DNA, 687 bp, Homo sapiens
  CDS 115..654
  misc_feature 137: y=c or t
  misc_feature 147: r=a or g
  misc_feature 347: y=c or t
  misc_feature 622: n=a, g, c or t
  UNSURE 8: Xaa=Ala or Val
  UNSURE 78: Xaa=Phe or Ser
  UNSURE 170: Xaa=Asp or His or Asn or Tyr
gtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgyggatgaggargaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatytggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtgnattcaaaatatggattaaaagtgaaataccactaaaggcagaagagaatgaaatcatcccaccca

SEQ ID NO: 3946 - DNA, 636 bp, Homo sapiens
  CDS 106..585
  misc_feature 71: w=a or t
  misc_feature 72: m=a or c
  misc_feature 96: s=g or c
  misc_feature 102: y=c or t
  misc_feature 240: r=a or g
  misc_feature 474: k=g or t
  UNSURE 123: Xaa=Ile or Met
agacaagggctcttcttgatggcttactgtatccactttgtccccaagaccatagggaaatgactagaggwmactgtactagctagattttaaatsaaaacygaaatgaaagttcacttcctcattttgagtacctcatgtgacaagttccaatttcttttcaagtcaattgaactgaaatctccttgttgctttgaaatcttagaagagagcccactaattcaaggcactcttactgtrggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatkcactcatacgatctgggcatgaaccacctgggagacatgaccagtgaagaagtgatgtctttgatgagttccctgagagttcccagccagtggcagagaaaatatcacatataagtcaaaccctaatcggatattgcctgattctgtggactggagagagaa

SEQ ID NO: 3947 - DNA, 482 bp, Homo sapiens
  CDS 99..410
  misc_feature 476: k=g or t
ggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgkagtgga

SEQ ID NO: 3948 - DNA, 507 bp, Homo sapiens
  CDS 45..491
  misc_feature 42: n=a, g, c or t
agggggcccgcccgctggcccgtttccggtccggtgggtacnagatgacggagccgggcgcctctcccgaggacccttgggtcaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaaccccatgaaggggaggacaggtctctgaccaggtcaagttc

SEQ ID NO: 3949 - DNA, 491 bp, Homo sapiens
  CDS 112..417
  misc_feature 368: n=a, g, c or t
  misc_feature 443: r=a or g
  UNSURE 86: Xaa=Ala or Glu or Gly or Val
aagaccagaccaacagtaacaccaagggcaggtgggcaggcctccgccctcctcccctactccagggcccactgcagcctcagcccaggagccaccagatctcccaacaccatggtccgataccgcgtgaggagcctgagcgaacgctcgcacgaggtgtacaggcagcagttgcatgggcaagagcaaggacaccacggccaagaggagcaagggctgagcccggagcacgtcgaggtctacgagaggacccatggccagtctcactataggcgcagacactgctctcgaaggaggctgcaccggatccacaggcggcagatcgctcctgcagaaggcgcaaaagacgctcctgcaggcaccggagnaggcatcgcagaggctgcagaaccaggaagagaacatgcagaaggccactaagcttcctgggcccctcacccccrgctggaaaattaagaaaaagtcgccccgaaacaccaagtgaggccata

SEQ ID NO: 3950 - DNA, 902 bp, Homo sapiens
  CDS 58..846
  misc_feature 549: r=a or g
gcccaatttctacgcgcaccggaagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttrgagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtg

SEQ ID NO: 3951 - DNA, 708 bp, Homo sapiens
  CDS 23..652
  misc_feature 21: s=g or c
  misc_feature 56: k=g or t
  misc_feature 355: r=a or g
  UNSURE 12: Xaa=Cys or Gly
attctttgctagggacgcggstatggtactggcaggagatgaagtaaagaagattkgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttrgagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtg

SEQ ID NO: 3952 - DNA, 480 bp, Homo sapiens
  CDS 52..471
  misc_feature 64: m=a or c
  misc_feature 90: r=a or g
  misc_feature 355: m=a or c
  UNSURE 5: Xaa=Pro or Thr
  UNSURE 102: Xaa=Lys or Gln
ttgccacctccattacttccccctccaggctttggctttgctcaaaatcccatggttccctggmcacctgttgttcatctcccaggtcarccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagcmaagacaggacagagacagaaaaagcagggaggaagggcacaaagataaagagagggcacggttatcacatggtgatcgaggaacagatggaaaagcaagcagagatagtaggaatgtagacagaa

SEQ ID NO: 3953 - DNA, 470 bp, Homo sapiens
  CDS 59..391
  misc_feature 316: r=a or g
gcatttccggagcgccagggaagagggaagtcgtggtggtcgcgagggagccggaaagatggtggttaccagatctgcacgggctaaggccagcatccaagccgcgtcggctgaaagttccgggcaaaagagttttgctgctaatgggattcaagcgcatccagaaagtagtactggatctgatgcccgaactactgctgaatcacagaccactgggaagcaaagtttaatccctagaactcctaaagctagaaagaggaagagcagaactacaggctcactaccaaaggggactgaaccatctacggatggagaracctctgaggcagagtcaaattattctgtgtctgagcacatgatacattttaagggtactaggagaggcagatcttaattgcatgctcccagtgtccagtgttaggaaaaagccgaaagtactccaacaaaggagtcttacactgaagaaatag

SEQ ID NO: 3954 - DNA, 492 bp, Homo sapiens
  CDS 94..429
  misc_feature 458: k=g or t
  misc_feature 459: r=a or g
ccttctcccattttgtgcctgcctagctatccagacagagcagctaccctcagctctagctgatactacagacagtacaacagatcaagaagtatggcagtgacaactcgtttgacatggttgcacgaaaagatcctgcaaaatcattttggagggaagcggcttagccttctctataagggtagtgtccatggattccgtaatggagttttgcttgacagatgttgtaatcaagggcctactctaacagtgatttatagtgaagatcatattattggagcatatgcagaagagagttaccaggaaggaaagtatgcttccatcatcctttttgcacttcaagatactaaaatttcagaatggaaactaggactatgtacaccagaaacactgttttgttgtgatgttacaaaatataactccccaacatgacctctttcgcatttgtgctttctcakrtataagaacacagtatacataataagcagaata

SEQ ID NO: 3955 - DNA, 620 bp, Homo sapiens
  CDS 165..548
  misc_feature 40: m=a or c
gtggctgtgcggatggggcgtaggtgggcggtgcgcccamagctgcctgggtaaggcccaagatggctgtcttcgccttagtactcgtgtgaagttggcggggacggttcctgtcatcttcttgggcttatttggtgtgctgttgaaggggggagactagagaaatggcagggaacctcttatccggggcaggtaggcgcctgtgggactgggtgcctctggcgtgcagaagcttctctcttggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccct

SEQ ID NO: 3956 - DNA, 512 bp, Homo sapiens
  CDS 47..502
  misc_feature 367: r=a or g
  misc_feature 368: r=a or g
  UNSURE 107: Xaa=Ile or Met
  UNSURE 108: Xaa=Ala or Thr
attgcgccgttggtgattacggaagaaccaggagtttggcgtgaccatggggaagcaaaagaaaacaaggaagtatgcgaccatgaagcgaatgcttagtctcagagatcagaggcttaaagaaaaggatagattaaaacctaaaaagaaagaaaagaaggatcccagcgcattaaaggaaagagaagttccccaacacccttcctgcttatttttccaatataatacacagctgggcccaccttaccacatcctcgttgataccaactttatcaacttttccataaaagccaaactggacttagtgcagtcaatgatggactgtctgtatgccaagtgtatcccatgtataaccgattgtgtaatrrctgaaattgagaaattggggcagaagtatcgagtggctctaaggattgccaaggatccaagatttgaacgattaccatgtacacacaaaggaacctatgcagatgactgcttaagtacagagagtaactcagcataagtgttac

SEQ ID NO: 3957 - DNA, 459 bp, Homo sapiens
  CDS 109..456
  misc_feature 25: s=g or c
  misc_feature 125: w=a or t
  misc_feature 403: y=c or t
  misc_feature 404: n=a, g, c or t
  UNSURE 6: Xaa=Asp or Val
  UNSURE 99: Xaa=Cys or Phe or His or Leu or Pro or Arg or Ser or Tyr
aggtgggggcgactgggccaggcgscggggcaggaagggaggcggccgccgtgccattcttaaaggcgcccgagtgtaggcgacaggccgctgacggccggaaggaaaatgagtgagtctttggwtgtttgtgatgttgccgaagatttagtggaaaagctgagaaagtttcgttttcgcaaagaaacgaacaacgctgctattataatgaagattgacaaggataaacgcctggtggtactggatgaggagcttgagggcatttcaccagatgaacttaaagatgaactacctgaacgacaacctcgaaccttcattgtgtatagttataaatatcaacatgatgatggaagagtttcatatcctctgtgctttattttctccagtcctgttggatgtaagyntgaacaacagatgatgtatgctggaagtaagaataaagctagtccagacagctga

SEQ ID NO: 3958 - DNA, 531 bp, Homo sapiens
  CDS 123..509
  misc_feature 480: n=a, g, c or t
  UNSURE 120: Xaa=Cys or Gly or Arg or Ser
agtgggggaggctgacatcaccacggcggcagccctttaagcgccccatcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaangcaagacatggcagcagtgcagaggaccctgatggctttgggcagcttggc

SEQ ID NO: 3959 - DNA, 503 bp, Homo sapiens
  CDS 164..490
  misc_feature 422: y=c or t
  UNSURE 87: Xaa=Pro or Ser
agcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctycttgcaaagacccatacatcacaggccattttgcaacctgtgttggcagcagaagattttactatctttaaagcaatgacg

SEQ ID NO: 3960 - DNA, 516 bp, Homo sapiens
  CDS 126..440
  misc_feature 444: n=a, g, c or t
  misc_feature 445: n=a, g, c or t
  misc_feature 456: n=a, g, c or t
acacgcacgccggcgtgccagtttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaannatgttttctgnaaaacataaccagccattggctatttaaaacttgtaattttttttaatttacaaaaatat

SEQ ID NO: 3961 - DNA, 606 bp, Homo sapiens
  CDS 206..601
  misc_feature 14: k=g or t
  misc_feature 435: n=a, g, c or t
  misc_feature 436: n=a, g, c or t
  misc_feature 589: m=a or c
  misc_feature 596: r=a or g
  UNSURE 77: Xaa=Ala or Asp or Glu or Gly or Val
  UNSURE 128: Xaa=His or Gln
  UNSURE 131: Xaa=Glu or Lys
cttctcctctctckgtgacagcctcttggaaagagggacactggaggggtgtgtttgcaatttaaatcactggatttttgcccaccctctttccaaataagaaggcaggagctgcttgctgaggtgtaaaagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagnntatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccamtatgagraggcataaaa

SEQ ID NO: 3962 - DNA, 412 bp, Homo sapiens
  CDS 31..393
catgctgatgaaagggtccttcaggcactcatgaaaaggttttatttaccagggacctcacggccaccgataatagtttctgagtttcggaatgagatatatgatgtaagacacagagctgcttatcatccagactttccaacagttctgacagctttagaaatagataatgcggttgtggcaaatagcctaattgacatgagaggcatagagacagtgctactaatcaaaaataattctgtagctcgtgcagtaatgcagtcccaaaagccacccaaaaattgtagagaagcttttactgctgatggtgatcaagtttttgcaggacgttattattcatctgaaaatacaagacctaagttcctaagcagagatgtggattctgaaaataagtgacttggagaatgaggtt

SEQ ID NO: 3963 - DNA, 636 bp, Homo sapiens
  CDS 134..547
  misc_feature 337: s=g or c
  UNSURE 68: Xaa=Lys or Asn
atctcggtgcatctgttgggcgggaccgcggggcctgtgacaccgcacgctgagctctgtgatgtagccgcttgcggagactgcaagcagccgcggcgcgcccggccctccctcttccgctgccgccgtgggaatggaaacatctgccccacgtgccggaagccaagtggtggcgacaactgcgcgccactccgcggcctaccgcgcagatcctctacgtgtgtcctcgcgagacaagctcaccgaaatggccgcgtccagtcaaggaaactttgagggaaattttgagtcactggaccttgcggaatttgctaagaagcagccatggtggcgtaastgttcgggcaggaatctggaccttcagcagaaaagtatagcgtggcaacccagctgttcattggaggtgtcactggatggtgcacaggtttcatattccagaaggttggaaagttggctgcaacagctgtgggaggtggattttttctccttcagcttgcaaaccatactgggtacatcaaagttgactggcaacgagtggagaaggacatgaagaaagccaaagagcagctgaagatccgtaagagcaatcagatacctactgaggtcaggagcaaagctgaggaggtggtgtcattt

SEQ ID NO: 3964 - DNA, 447 bp, Homo sapiens
  CDS 36..422
agtcagttgccggaagtcggcgtgaggtggggcttatgcggcggcgtggtgaaatagatatggcgaccgagggggatgtggagctggagttggagactgagaccagtggaccagagcggcctccggagaagccacggaaacatgacagcggtgcggcggacttggagcgggtcaccgactatgcagaggagaaggagatccagagttccaatctggagacggccatgtctgtgattggagacagaaggtcccgggagcagaaagccaaacaggagcgggagaaagaactggcaaaagtcactatcaagaaggaagatctggagctaataatgactgagatggagatatctcgagcagcagcagaacgcagtttgcgggaacacatgggcaacgtggtagaggcgcttattgccctaaccaactgatgcgtgctttctcaaatatacc

SEQ ID NO: 3965 - DNA, 445 bp, Homo sapiens
  CDS 57..431
  misc_feature 14: s=g or c
  misc_feature 419: m=a or c
  misc_feature 433: r=a or g
  UNSURE 121: Xaa=His or Gln
gtagcgcggcggasaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccamcgctggaccgagtractcctctctcc

SEQ ID NO: 3966 - DNA, 506 bp, Homo sapiens
  CDS 91..408
  misc_feature 435: y=c or t
  misc_feature 436: s=g or c
  misc_feature 437: k=g or t
  misc_feature 496: n=a, g, c or t
tcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggttgcctggccacggcggccgccctcacctacggcctctactccttccaccggggcaacagccagcgctctcagctcatgatgcgcacccggatcgccgcccagggtttcacggtcgcagccatcttgctgggtctggctgtcactgctatgaagtctcgaccctaagcccagggtctggccttgaaagcyskgcagaaatgattccaaaacccagggagcaaccactggccctaccgtgggacttactccntcctctcctt

SEQ ID NO: 3967 - DNA, 425 bp, Homo sapiens
  CDS 39..341
  misc_feature 67: s=g or c
  misc_feature 152: n=a, g, c or t
  misc_feature 259: r=a or g
  misc_feature 395: m=a or c
  UNSURE 10: Xaa=Ala or Gly
  UNSURE 38: Xaa=His or Gln
  UNSURE 74: Xaa=Cys or Tyr
atacagtgacctcgggcggcgggtcacgtcggccgggcatggctgcatggagcccggccgcggcagscctctcctccgcgggatccgcgggcttccacttcaccatcggatgtttgccactcagcactgagggggagctcagagtgacccanattctcaaagaaaagtttccacgagctacagctataaaagtcactgacatttcaggcactaaaagaagaaatcaaagagatgcatggattgcggatatttacctctrtccccaaacgctgaccacgccctggctgcatagatgctgctgcttaagaccttggatgaacttcactgacatcattcttccctaagcagtcaccaaaaaatttatatattttgctcatatacatttccatattatmattatagaagatgtataatctatttagatg

SEQ ID NO: 3968 - DNA, 381 bp, Homo sapiens
  CDS 27..341
aagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagatggatctgcagctcactaatattgaacatttttctgagtgtgatgttcaagctaaaataaagcaactcaaggccttccagcaggaaatttcactgaa

SEQ ID NO: 3969 - DNA, 514 bp, Homo sapiens
  CDS 113..415
  misc_feature 322: k=g or t
  misc_feature 353: r=a or g
  misc_feature 354: n=a, g, c or t
  misc_feature 355: n=a, g, c or t
  misc_feature 356: n=a, g, c or t
  misc_feature 379: s=g or c
  UNSURE 70: Xaa=Lys or Asn
  UNSURE 81: Xaa=Ala or Asp or Glu or Gly or Ile or Lys or Met or Asn or Arg or Ser or Thr or Val
  UNSURE 82: Xaa=Ala or Pro or Ser or Thr
acttccggccagggagggggataggctcagacacaaggagaggcttggagagagcagacgccttctggattcaagaagacgaggctcacctgttactcggcctcccagaaagatggataggagaaatgactacggatatagggtgcctctatttcagggccctctgcctcccccggggagcctggggcttcccttccctccagatatacagactgagaccacagaagaggacagtgtcctgctgatgcataccctgttggcggcaaccaaggactccctggccatggacccaccagttgtcaaccggcctaagaaaagcaakaccaagaaggcccctataaagactattactrnnnctgcacctgctgcccctccagtscagctgccaatgagattgccaccaacaagcccaaaataacttggcaggctttaaacctgccagtcattacccagatcagccaggctttacctaccactgaggtaaccaatactcaggcttcttcagtcactgctc

SEQ ID NO: 3970 - DNA, 565 bp, Homo sapiens
  CDS 189..554
  misc_feature 485: s=g or c
  misc_feature 487: n=a, g, c or t
  misc_feature 506: m=a or c
  UNSURE 99: Xaa=Asp or Glu
  UNSURE 100: Xaa=Ala or Glu or Gly or Val
tcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctacgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggasgnagaagggcactaccgaggmggtctgccgcatctacctgctgcgcatcctgcacacctactacaagtttgattacaagg

SEQ ID NO: 3971 - DNA, 582 bp, Homo sapiens
  CDS 117..449
  misc_feature 268: r=a or g
  misc_feature 275: n=a, g, c or t
  misc_feature 276: r=a or g
  misc_feature 289: r=a or g
  misc_feature 291: r=a or g
  misc_feature 293: n=a, g, c or t
  misc_feature 556: n=a, g, c or t
  misc_feature 557: n=a, g, c or t
  UNSURE 51: Xaa=Glu or Gly
  UNSURE 54: Xaa=Gly or Ser
  UNSURE 58: Xaa=Asp or Gly
  UNSURE 59: Xaa=Asp or Glu or Lys or Asn
atatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtattccacttaaagccatggaattagcaatagtttgctttttaatagaaggcccatttgtaagaatgttgaaaatatgtgtaccgtttaaagraaaagcnrgctttaaaagtgrcrancaaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgnnctttaaagcattgacgcacagacaa

SEQ ID NO: 3972 - DNA, 522 bp, Homo sapiens
  CDS 144..515
  misc_feature 10: r=a or g
  misc_feature 11: s=g or c
  misc_feature 489: r=a or g
  UNSURE 116: Xaa=Gly or Arg
actctcgcgrsatccctactggctataaaggcagctccccggagagctcttgcgcgtcttgttcttgcctggtgtcggtggttagtttctgcgacttgtgttgggactgctgataggaagatgtcttcaaagccacagctgttatgccagatggtcagtttaaagatatcagcctgtctgactacaaaggaaaatatgttgtgttcttcttttaccctcttgacttcacctttgtgtgccccacggagatcattgctttcagtgatagggcagaagaatttaagaaactcaactgccaagtgattggtgcttctgtggattctcacttctgtcatctagcatgggtcaatacacctaagaaacaaggaggactgggacccatgaacattcctttggtatcagacccgaagcgcaccattgctcaggattatggggtcttaaaggctgatgaggcatctcgttcaggggcctttttatcattgatgatarggtattcttcggcagatcactgtaaatgacctc

SEQ ID NO: 3973 - DNA, 571 bp, Homo sapiens
  CDS 152..526
actcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgac

SEQ ID NO: 3974 - DNA, 554 bp, Homo sapiens
  CDS 64..546
  misc_feature 386: n=a, g, c or t
  misc_feature 389: m=a or c
  misc_feature 390: m=a or c
  misc_feature 497: r=a or g
  misc_feature 516: r=a or g
  misc_feature 529: w=a or t
  misc_feature 538: m=a or c
  misc_feature 539: m=a or c
  UNSURE 108: Xaa=Lys or Met or Arg or Thr
  UNSURE 109: Xaa=Lys or Asn or Thr
  UNSURE 145: Xaa=Lys or Arg
  UNSURE 156: Xaa=Ser or Thr
  UNSURE 159: Xaa=Lys or Pro or Gln or Thr
ccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgangammtatgaacagggattcatcacagaccctgtggtcctcagccccaaggatcgcgtgcgggatgtttttgaggcaaggccggcatggtttctgcggtatcccaatcacaracacaggccggatggggarccgctggtggcawcatctcctmmaggacattgatttct

SEQ ID NO: 3975 - DNA, 566 bp, Homo sapiens
  CDS 113..490
agagccggggcacctgcgcaggcttggctgcgccctctcgcgccgcacgctctgcgggttcctcccttcttccgagcctctcctctggccgccgcgcgggagagaggccgagatggcagatgagattgccaaggctcaggtcgctcggcctggtggcgacacgatctttgggaagatcatccgcaaggaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgctgatctgggcctgaataagggttatcgaatggtggtgaatgaaggttcagatggtggacagtctgtctatcacgttcatctccatgttcttggaggtcggcaaatgcattggcctcctggttaagcacgttttggggataattttctcttctttaggcaatgattaagttaggcaattccagtatgttaagtaacac

SEQ ID NO: 3976 - DNA, 519 bp, Homo sapiens
  CDS 116..433
  misc_feature 340: y=c or t
ccgcctccagggaggttccttattaaataggagccaactggctgggtcggggctcaataccccaagcaatacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttatyggtaaagattgtataggcggatgcagtgatctagtctctttgcaacagagtggggaactgctgacgcggctaaagcagattggagctctgcagtaaccacagatctcataggaaatgttcaacaattctgtgaaaggtcacaggacccaattggagaaatcatatgaaaagcatagttg

SEQ ID NO: 3977 - DNA, 598 bp, Homo sapiens
  CDS 42..503
tcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgc

SEQ ID NO: 3978 - DNA, 478 bp, Homo sapiens
  CDS 139..459
aaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtggagatcctagaaggcaaggatgccgggaagcagggcaaagtggttcaagttatccggcagcgaaactgggtggtcgtgggagggctgaacacacattaccgctacattggcaagaccatggattaccggggaacatgatcctagtgaagcccct

SEQ ID NO: 3979 - DNA, 490 bp, Homo sapiens
  CDS 113..478
attgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaagatgccaagcttgccttgatcaaggaga

SEQ ID NO: 3980 - DNA, 486 bp, Homo sapiens
  CDS 171..482
  misc_feature 268: w=a or t
  misc_feature 282: n=a, g, c or t
  misc_feature 341: w=a or t
  misc_feature 362: w=a or t
  misc_feature 363: w=a or t
  misc_feature 369: y=c or t
  misc_feature 370: w=a or t
  misc_feature 416: k=g or t
  misc_feature 436: m=a or c
  misc_feature 440: m=a or c
  misc_feature 442: y=c or t
  misc_feature 443: n=a, g, c or t
  UNSURE 33: Xaa=Ile or Lys
  UNSURE 38: Xaa=Asp or His or Asn or Tyr
  UNSURE 64: Xaa=Arg or Ser
  UNSURE 65: Xaa= *  or Lys
  UNSURE 67: Xaa= *  or Leu or Gln
  UNSURE 89: Xaa=Ala or Glu
  UNSURE 90: Xaa=Asp or Glu
  UNSURE 91: Xaa=Ala or Val
gttgcctggcgacgtgttactcagtggcgcagtgcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccawacaaagagtgagtnatgtgacatccacagaaaatgaatctgatacacaaatcctaacgtttaggcacattacwaaagctcaggagaagacaagwwaacgaywgcagcctataaaactagagcctttggtaagttcaaaaaccattgtkttagcctctgtagccacagmggamgyngtaaaattgctttggaggatagaagtcatgtccagactctgaa

SEQ ID NO: 3981 - DNA, 382 bp, Homo sapiens
  CDS 44..367
  misc_feature 285: r=a or g
  misc_feature 286: n=a, g, c or t
  misc_feature 357: w=a or t
  UNSURE 81: Xaa=Asp or Glu or Gly
  UNSURE 105: Xaa=Ile or Lys
aggatccggcgccgaatcactgactggcacaggtgttgggaaaatgatccacagtctatttctcataaactgttccggtgacatatttctagagaagcactggaagagcgttgtgagccagtctgtctgtgattatttctttgaagctcaagagaaagctgctgatgttgaaaatgtaccacctgtcatttcaacacctcaccactacctcatcagtatctaccgggataagctcttctttgtatctgtcatacagaccgaagtgccacctctctttgtaattgrngttcctacatccgagttgctgacacttttcaggactactttggtgagtgttcagaggctgcaattaaggawaatgtggtcatagtatatgaactct

SEQ ID NO: 3982 - DNA, 509 bp, Homo sapiens
  CDS 125..505
  misc_feature 322: y=c or t
  misc_feature 442: w=a or t
  misc_feature 488: r=a or g
  UNSURE 122: Xaa=Ala or Thr
attgtgcggctcctactaaacggaaggggccgggagaggccgcgttcagtcgggtcccggcagcggctgcagcgctctcgtcttctgcggctctcggtgccctctccttttcgtttccggaaacatggcctccggtgtggctgtctctgatggtgtcatcaaggtgttcaacgacatgaaggtgcgtaagtcttcaacgccagaggaggtgaagaagcgcaagaaggcggtgctcttctgcctgagtgaggacaagaagaacatcatcctggaggagggcaaggagatcctggtgggcgatgtgggccagactgtcgacgayccctacgccacctttgtcaagatgctgccagataaggactgccgctatgccctctatgatgcaacctatgagaccaaggagagcaagaaggaggatctggtgtttatcttctgggccccwgagtctgcgccccttaagagcaaaatgatttatgccagctccaagrcgccatcaagaagaagctgac

SEQ ID NO: 3983 - DNA, 467 bp, Homo sapiens
  CDS 39..422
  misc_feature 64: y=c or t
  UNSURE 9: Xaa=Ala or Val
gcaaaggggtggggttgtggagtggatgctttggcaagatggcggggagcggcgtccgccaagytacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagc

SEQ ID NO: 3984 - DNA, 456 bp, Homo sapiens
  CDS 31..390
  misc_feature 372: n=a, g, c or t
  misc_feature 373: n=a, g, c or t
  misc_feature 435: m=a or c
  UNSURE 115: Xaa=Cys or Gly or Arg or Ser
tcctttccgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactnngcagcggcagatacttctaggacctaacacagggctctcaggaggaatgccaggggctctamcctcacttcctggaaagatct

SEQ ID NO: 3985 - DNA, 490 bp, Homo sapiens
  CDS 95..481
actaggggactccgcctctcccgatttcctccgggctacaggcgacagagctgagccaagcgtttactgggcagctgttacgctcagattccaaatgaaaatgtttgagagcgctgactctacagccacaagatctggccaggatctctgggctgaaatttgttcctgtctgccaaatcctgaacaagaagatggtgccaacaatgcattctcagactcctttgtggattcttgccctgaaggtgaaggccagagggaggtggctgactttgctgtccagccagctgtaaagccttgggctcccttgcaggattcagaagtgtatttagcatctctagagaagaagctaagaagaatcaaaggtttaaatcaggaagtgacttccaaggacatgcttcgaactctgggcccaagccaagaaggaatgctgggatcggttcctccaggagaagttagcttcagagttctttgtggatggacttgattctga

SEQ ID NO: 3986 - DNA, 483 bp, Homo sapiens
  CDS 114..431
  misc_feature 424: s=g or c
  UNSURE 104: Xaa=Arg or Thr
gacttgcttccagacaaaggttgtctcaagtttgttgctcaaaccgagttctggagaacgccatcagctcgctgcttaaaattaaaccacaggttccattatgggtcgacttgatgggcaaagtcatcatcctgacggccgctgctcaggggattggccaagcagctgccttagcttttgcaagagaaggtgccaaagtcatagccacagacattaatgagtccaaacttcaggaactggaaaagtacccgggtattcaaactcgtgtccttgatgtcacaaagaagaaacaaattgatcagtttgccaatgaagttgagagacttgatgttctctttaatgttgctggttttgtccatcatggaactgtcctggattgtgaggagaaagactgggacttctcgatgaatctcaatgtgcgcasatgtacctgatgatcaaggcattccttcctaaaatgcttgctcagaaatctggcaatat

SEQ ID NO: 3987 - DNA, 400 bp, Homo sapiens
  CDS 55..393
  misc_feature 161: s=g or c
  misc_feature 205: m=a or c
  misc_feature 376: n=a, g, c or t
  UNSURE 36: Xaa=Cys or Ser
  UNSURE 51: Xaa=Pro or Thr
  UNSURE 108: Xaa=Leu or Met or Val
aatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctstaagaactttgctgagttggctcgtcgaggttactacaatggcmcaaaattccacagaattatcaaagacttcatgatccaaggaggtgacccaacagggacaggtcgaggtggtgcatctatctatggcaaacagtttgaagatgaacttcatccagacttgaaattcacgggggctgaattctcgcaatggccaatgcggggccagataccantggcagccagttctttgtgacctc

SEQ ID NO: 3988 - DNA, 341 bp, Homo sapiens
  CDS 14..328
  misc_feature 234: w=a or t
  misc_feature 238: w=a or t
  misc_feature 253: w=a or t
  UNSURE 74: Xaa=Ile or Lys
  UNSURE 75: Xaa=Asp or Glu
  UNSURE 80: Xaa=Asp or Glu
agtacttgggcgcatgcggcaaccgtatctcagttctcgcgaggtttcgtcttcccggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgawagawgaagatggagaagawatagttacctatgatcgagtataccatgctgtgtctgttatgcggcaaagccgaagatactatcagtattctccctgatgacccccga

SEQ ID NO: 3989 - DNA, 596 bp, Homo sapiens
  CDS 6..371
  misc_feature 582: r=a or g
aaaaaatgcctcatccctactccagaaacgagaacaacggaggcagaggagctgaagactccagtatgcaactgactacaaggagacagaaggctgaggccggggtgctagagaaccttgccgtgctggaattcacgttgacgcccccacggagctctgctgcagagccctcgagtcccgcacttccgggcgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgratatatatcaagcc

SEQ ID NO: 3990 - DNA, 597 bp, Homo sapiens
  CDS 10..507
  misc_feature 149: r=a or g
  UNSURE 47: Xaa=Lys or Arg
accatattaatgctctttaataataaagaaaaatacacatttgaggaaattcagcaagagacagatatccctgaaagagagcttgttagagccctacagtccctcgcctgtggtaaaccaacacagcgggttcttacaaaagaacccaratcaaaggaaatagaaaatggtcatatatttacagttaatgatcaattcacatccaaactacacagagtcaagattcaaacagttgctgccaaacaaggtgaatccgacccagagaggaaagaaacaaggcagaaagtagacgacgacagaaaacatgagatagaagctgctatagtgcggataatgaaatctagaaagaagatgcagcacaatgttctagtagcggaggtaactcagcagttgaaggcgcgattcttaccaagtccagttgttattaagaaacgtattgaaggacttattgagagagaatatttggcacgaacacctgaggatcgcaaagtatacacatatgtagcataaaatgcgttcagaaatttgatttattcttggactgtactcttcgcatggactgggaagttcttttaaatcattaaatattaagacgac

SEQ ID NO: 3991 - DNA, 426 bp, Homo sapiens
  CDS 26..403
aaggcgggaacacgcggggcccaagatggcggccagccggtaccggcgttttcttaagctctgtgaggaatggccagtggacgagaccaaacggggccgggacttgggcgcttacctgcgacagcgggtagcacaggcctttcgggagggagagaatacccaggttgcagagcctgaggcctgtgatcagatgtacgagagcttagcgcgactccattcaaactactacaaacacaagtaccctcgccccagagacaccagcttcagtggcctgtcgttggaagagtacaagctgatcctgtccacagacaccttggaagagcttaaggaaatagataaaggcatgtggaagaaactgcaggagaagtttgcccccaagggtcctgaggaggatcataaggcctgagctcaggccttacctcgtgc

SEQ ID NO: 3992 - DNA, 598 bp, Homo sapiens
  CDS 76..516
  misc_feature 401: w=a or t
  misc_feature 585: w=a or t
  UNSURE 109: Xaa=Ile or Asn
aagcacccttcagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccataaagcacctggatgatctcaagggcacctttgcccagctgagtgaactgcactgtgacaagctgcatgtggatcctgagaacttcaagctcctgggaawtgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatcaaataataaawctattctgctgag

SEQ ID NO: 3993 - DNA, 474 bp, Homo sapiens
  CDS 35..436
  misc_feature 426: w=a or t
  misc_feature 449: r=a or g
  misc_feature 453: m=a or c
  UNSURE 131: Xaa=Ile or Asn
agcagctagtcacgctcggtaccaggcgcagatcatggcaggcagccggctggaaaccgtagggagcatcttctctcggactcgggacctggttcgggccggggtgctgaaggagaagcccctgtggtttgacgtatatgacgcctttcccccgctgagggagcccgtcttccaaaggcctcgagtgcgatatggcaaagccaaagctcccatccaagacatctggtaccacgaggatcggattagagcgaagttttattcagtgtatgggtctggtcaaagagcttttgatctattcaatccaaacttcaagtctacctgtcaacggtttgtggagaagtacactgagctacagaaacttggagaaacagatgaagagaagttatttgtggaaacagggaaggctttattggcagaaggtgtcawtttaagacggtaggcgacaaggrctcmacacgaggtagtcacgtttcc

SEQ ID NO: 3994 - DNA, 556 bp, Homo sapiens
  CDS 157..510
  misc_feature 153: m=a or c
ccacccttaagaaaggagacagaaccacatcatgaacttgatctgcaactggaatatggacaaggacacaggggcattggtttagttttggtctctgtgtacttatttccttcagatgcccgaggaaagagaaaaagtagagaagcagcagcmgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttggga

SEQ ID NO: 3995 - DNA, 444 bp, Homo sapiens
  CDS 45..398
gagcgcggctgcgcggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgagacccccaagaggcccatttcccccaataaaagagatttggga

SEQ ID NO: 3996 - DNA, 466 bp, Homo sapiens
  CDS 108..437
acagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcattggtcttttggagattactttaaggaattggcatgtaagatggctctgg

SEQ ID NO: 3997 - DNA, 570 bp, Homo sapiens
  CDS 68..502
  misc_feature 13: m=a or c
  misc_feature 97: k=g or t
  misc_feature 401: m=a or c
  UNSURE 10: Xaa=His or Gln
  UNSURE 112: Xaa=Ile or Leu
taaagaaaaagcmagttctttgatcagtttactcaaacaggaagggatagccacaagtgacaacttcatgcaggctttcctgaatgtattggaccaktgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccagaaattgatcagaataaggaccgcatgttggagattttggaaggaaagggactgagtttcttattcccamtcctcaaattggagaaggaactgttgaagcaaataaagttggatccatcccctcaaaccatatataaatggattaaagataacatctctcccaaactcatgtagataaaggatttgtgaacatcttaatgactagcttcttacagtacatttctagtgaagtaaacccc

SEQ ID NO: 3998 - DNA, 441 bp, Homo sapiens
  CDS 20..367
  misc_feature 10: k=g or t
  misc_feature 11: n=a, g, c or t
  misc_feature 112: w=a or t
  UNSURE 31: Xaa=Lys or Asn
caccgaggtkntcaagaacatgggctatgccgccaaggccatgaaggcggcccatgacaacatggacatcgataaagttgatgagttaatgcaggacattgctgaccagaawgaacttgcagaggagatttcaacagcaatttcgaaacctgtagggtttggagaagagtttgacgaggatgagctcatggcggaattagaagaactagaacaggaggaactagacaagaatttgctggaaatcagtggacccgaaacagtccctctaccaaatgttccctctatagccctaccatcaaaacccgccaagaagaaagaagaggaggacgacgacatgaaggaattggagaactgggctggatccatgtaatggggtccagcgctggctgggcccagacagactgtggtggcctgcgcacgagcaggcgtgtgcgtgtgcgg

SEQ ID NO: 3999 - DNA, 468 bp, Homo sapiens
  CDS 107..418
  misc_feature 133: n=a, g, c or t
  misc_feature 141: r=a or g
  UNSURE 9: Xaa=Asp or Glu
  UNSURE 12: Xaa=Glu or Gly
agaagtggttctcatctttttttgcagcttaagatctgccttggtatttgaagagatataaactagatcaatttctttcacaggatcaactaaacagtgtaccacaatgaattctgaacttgactattatganaagtttgragaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggtaacgttcaagttgattttaaaaactatttgcatatattctaaggtgtgtatgtacatggtacaagcaatgagattataagcaagaatgg

SEQ ID NO: 4000 - DNA, 532 bp, Homo sapiens
  CDS 138..473
  misc_feature 13: r=a or g
  misc_feature 21: r=a or g
aaaatggcgcagrgcagggargggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatctgaaagaactgagagatcatgctgaagtaacattgttatcatgcttgtgggcaataagagtgatctacgtcatctcagggc

SEQ ID NO: 4001 - DNA, 471 bp, Homo sapiens
  CDS 33..374
  misc_feature 217: w=a or t
  misc_feature 259: r=a or g
  misc_feature 311: w=a or t
  misc_feature 312: m=a or c
  misc_feature 364: k=g or t
  misc_feature 367: n=a, g, c or t
  misc_feature 368: n=a, g, c or t
  misc_feature 400: n=a, g, c or t
  UNSURE 62: Xaa=Leu or Gln
  UNSURE 76: Xaa=Lys or Arg
  UNSURE 94: Xaa=His or Asn
  UNSURE 111: Xaa=Ile or Ser
  UNSURE 112: Xaa=Ile or Lys or Met or Asn or Arg or Ser or Thr
actgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacwacttcatcgcatgaatagagaagagattctggcatttattargtcttgccaacatgaatgtggtggaataagtgctagtatcggacatgatccwmatcttttatacactcttagtgctgtccagattcttacgctgtatgacagtaktanntgttattgacgtaaatgagttgtggaatatgntaaaggtctacagaaagaagatggttcttttgctggagatatttggggtccactaagcagctggtctaact

SEQ ID NO: 4002 - DNA, 450 bp, Homo sapiens
  CDS 21..443
  misc_feature 304: y=c or t
  misc_feature 305: n=a, g, c or t
  misc_feature 399: r=a or g
  UNSURE 95: Xaa=Ala or Val
  UNSURE 127: Xaa=Asp or Asn
gcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttgyngtgattagcttcgcagtctggaaagctttaggagttcacagtatgaacgactttcgaagtaaaatgcaatcaatatttccaacaattcccaagractccgaatcggctgttgagtgggaggaaacattgaaatccaaatgagatg

SEQ ID NO: 4003 - DNA, 495 bp, Homo sapiens
  CDS 94..480
  misc_feature 141: s=g or c
  misc_feature 392: r=a or g
  misc_feature 399: w=a or t
  misc_feature 400: n=a, g, c or t
  misc_feature 401: n=a, g, c or t
  misc_feature 403: r=a or g
  misc_feature 404: n=a, g, c or t
  misc_feature 407: n=a, g, c or t
  misc_feature 425: k=g or t
  misc_feature 454: r=a or g
  UNSURE 16: Xaa=Asp or Glu
  UNSURE 100: Xaa=Lys or Arg
  UNSURE 103: Xaa= *  or Ala or Glu or Gly or Ile or Lys or Leu or Pro or Gln or Arg or Ser or Thr or Val
  UNSURE 104: Xaa=Ala or Asp or Gly or Ile or Asn or Ser or Thr or Val
  UNSURE 105: Xaa=His or Leu or Pro or Arg
  UNSURE 111: Xaa= *  or Leu
  UNSURE 121: Xaa=Ile or Val
acttcccacgcgacttcctgcgggaaacatggcggcattgagcggagtccgctggctgacccgagcgctggtctccgccgggaaccctggggcatggagaggtctgagtacctcggccgcggcgcacgctgcatcgcggascaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtatargggggcwnnarnccntcctatgatatgcggctkaggcgtaagttggacttatttgccacgtrtccatgtgagtcacttcctgggtatatgactcggcacacat

SEQ ID NO: 4004 - DNA, 479 bp, Homo sapiens
  CDS 30..347
  misc_feature 442: w=a or t
  misc_feature 445: y=c or t
  misc_feature 446: s=g or c
agtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacatgtaagagtgctgtaggactcctttgcctaatgctgaggagtaaataccttacacagctgtcctctgggtttggttttctatttwctystccaaaagttaagttagaaaagttctgtgttag

SEQ ID NO: 4005 - DNA, 391 bp, Homo sapiens
  CDS 73..381
  misc_feature 11: m=a or c
  misc_feature 12: m=a or c
  misc_feature 15: k=g or t
acacagctgcmmggkactccagtgatcgccgcggctcgctcgcgccccggaaactgccccttctcgggggtcatgatgggcagcaagatggcgtctgctagtagggtcgttcaggtagtcaaaccacacactccattaataaggtttcctgacagaagagacaatcctaaacccaatgtatcagaagctttgagatcagcagggctaccatctcactcttctgtaatttcacaacattctaaaggaagtaaatcaccagatttgctgatgtatcagggtccaccagacactgcagaaataataaaaacattacctcagaaatacagaaggaaacttgtgtctcaagaagaaatggaatttatccaacgtggaggtcctgaataaccatggt

SEQ ID NO: 4006 - DNA, 463 bp, Homo sapiens
  CDS 74..379
  misc_feature 252: r=a or g
  UNSURE 60: Xaa=His or Arg
ggctgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcrcatctactgtgcactctctggttcagctgctgatgcccaagccgtggccgacatggccgcctaccagctggagctccatgggatagaactggaggaactccacttgttttggctgctgcaaatgtggtgagaaatatcagctataaatatcgagaggacttgtctgcacatctcatggtagctggctgggaccaacgtgaaggaggtcagg

SEQ ID NO: 4007 - DNA, 463 bp, Homo sapiens
  CDS 26..409
  misc_feature 278: m=a or c
  misc_feature 399: y=c or t
  UNSURE 85: Xaa=Pro or Thr
  UNSURE 125: Xaa=Ala or Val
gatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccmcgacagcggtttcttcccctggcggtccagcccgggctcccccctaccaagagcctccatggggtggccctgccacagccccctacagcttagagaccctgaaggcggcactatccttggyacccgtagcttgaaagggacgagttactgcttttcgggaggctgtctggctgcgacgtgtgctg

SEQ ID NO: 4008 - DNA, 359 bp, Homo sapiens
  CDS 1..333
  misc_feature 118: y=c or t
  misc_feature 323: n=a, g, c or t
  misc_feature 324: s=g or c
  UNSURE 40: Xaa=Phe or Leu
  UNSURE 108: Xaa=His or Leu or Pro or Gln or Arg
atggagagggacaggaggaaacgcagcgccagcagcatctcatctaccctccttgacacctccccgtggctccagaccctagaggtcagccttgcggaccaacaggaggactcccagytttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagcnsgactcccactagcacctcgtaccaacctcgcccca

SEQ ID NO: 4009 - DNA, 563 bp, Homo sapiens
  CDS 170..493
  misc_feature 556: n=a, g, c or t
actgtctccgagacgcttcctgtccggtgagcgtcgaccgactgaaacggcggcccataatgcattgcgatggcgggtaggcgtgtgggggcggagccagggccggaagtagagcggaggtggtggcggcggaggctttggcagctcgggactgagtgcaagaatcagcatgattcttcagaggctcttcaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagangtttcag

SEQ ID NO: 4010 - DNA, 461 bp, Homo sapiens
  CDS 80..433
agaggaagtcccgcctctctctcctcaggcagcagcaacgcggaggaaacgggagtgaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaact

SEQ ID NO: 4011 - DNA, 526 bp, Homo sapiens
  CDS 81..434
  misc_feature 488: y=c or t
  misc_feature 512: r=a or g
aaaaactagccgaggagagccagggagccggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggaagattctcaacagataccctcacttcaagactaagattgaagggctggacatccacttcatccacgtgaagcccccccagctgcycgcagccataccccgaagcccttrctgatggtgcacgg

SEQ ID NO: 4012 - DNA, 454 bp, Homo sapiens
  CDS 57..413
gaagaggggcgcaagctcattgcgttttgagtctcgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggcgccattgagttcggacagcggatgctccaggtggcatctcaagcct

SEQ ID NO: 4013 - DNA, 465 bp, Homo sapiens
  CDS 62..388
  misc_feature 13: s=g or c
  misc_feature 374: y=c or t
ctaaggggcggastccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgytgtggagctggtggtgaagaatcccctgtgcccgctgggccaaactgtgcaaagtgagctctttcgctcccgactggactcctatgttcgc

SEQ ID NO: 4014 - DNA, 574 bp, Homo sapiens
  CDS 172..537
  misc_feature 13: s=g or c
  misc_feature 431: r=a or g
  misc_feature 464: m=a or c
  UNSURE 87: Xaa=Asp or Gly
  UNSURE 98: Xaa=Asn or Thr
ctaaggggcggastccgtggaaaccggaagtaactcttgacgggcactcggagcagttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgrcttgggcgtgggaccatccgagatgtgctgcamcacatctacagtgcgctgttgtggagctggtggtgaagaatcccctgtgcccgctgggccaaactgtgcaaagtgagctctttcgctcccgactggactcctatgttcgc

SEQ ID NO: 4015 - DNA, 426 bp, Homo sapiens
  CDS 54..410
  misc_feature 382: r=a or g
  misc_feature 397: r=a or g
  misc_feature 399: r=a or g
  misc_feature 401: m=a or c
  UNSURE 110: Xaa=Cys or Tyr
  UNSURE 115: Xaa=Glu or Gly
  UNSURE 116: Xaa=Gly or Arg or Ser
ccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgctttrcgggaaagggttggrargmagcaggctgtaagcagcctggagca

SEQ ID NO: 4016 - DNA, 494 bp, Homo sapiens
  CDS 54..485
  misc_feature 39: r=a or g
ccctcgccttcctctttccgtctcaggtcgccgctgcgragggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcaggccagcgccatcctgcgcagcagaagcctgtgatggtgaagaggaagcggacccgccccaccaagagctcctgagccccctgcccccagagcaataaagtcag

SEQ ID NO: 4017 - DNA, 484 bp, Homo sapiens
  CDS 140..475
  misc_feature 204: m=a or c
  misc_feature 234: w=a or t
  misc_feature 253: r=a or g
  misc_feature 265: v=a or c or g
  misc_feature 268: m=a or c
  misc_feature 310: s=g or c
  misc_feature 329: n=a, g, c or t
  UNSURE 22: Xaa=Ala or Glu
  UNSURE 32: Xaa=Ile or Asn
  UNSURE 43: Xaa=His or Gln
  UNSURE 57: Xaa=His or Gln
  UNSURE 64: Xaa=Leu or Met or Val
acattttccctgggtgagctctcatttattcctgcggatgcacacataccctgaccagtcacagatctctacctccagctcaggctcttctcctgagctccagccccacgtgtccaagtgtctgctgggaatctcctagatgttgtgggctaactccaactcaaacggactgattcaccgcaagactgtgggcgtggagccggmagccgacggcaaaggtgtcgtggtggtcawtaagcggagatccggccargcggaagctggvcamctcctatgtgcggaccaccatcaacaagaatgctcgcgccasgctcagcagcatcagacantgatccgcaagaacaagtaccgccccgacctgcgcatggcagccatccgcaggccagcgccatcctgcgcagcagaagcctgtgatggtgaagaggaagcggacccgccccaccaagagctcctgagccccctgcccccagagcaataaagtcag

SEQ ID NO: 4018 - DNA, 532 bp, Homo sapiens
  CDS 144..503
  misc_feature 29: n=a, g, c or t
  misc_feature 30: n=a, g, c or t
  misc_feature 289: k=g or t
  misc_feature 460: n=a, g, c or t
  misc_feature 461: n=a, g, c or t
  misc_feature 503: k=g or t
  misc_feature 513: r=a or g
  misc_feature 518: r=a or g
  UNSURE 49: Xaa=Leu or Arg
  UNSURE 106: Xaa=Ile or Lys or Met or Asn or Arg or Ser or Thr
caatacccacagcatctaactaaatcctnnggatttattctccgggagaaattatccctttctaggaaaatgaaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagatattagttattttgatctacatckttttctaaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaanntttttactgattcacaaaaaggaagacagtttgcccacctcktagtggcacraatcraagctgcatgcact

SEQ ID NO: 4019 - DNA, 626 bp, Homo sapiens
  CDS 131..571
aggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacatcaatgacatttttttcctctcacttaggaacaatatgaacgtgaagatttcttgattaagcccagtgataatcttatagtttgtggccga

SEQ ID NO: 4020 - DNA, 481 bp, Homo sapiens
  CDS 108..455
  misc_feature 466: m=a or c
  misc_feature 467: k=g or t
gtttttttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggcccttttcatctacctgctcttctacttccgagtgcccttcatctatggcacaaatatgactttaccmkagtcggcatacagt

SEQ ID NO: 4021 - DNA, 547 bp, Homo sapiens
  CDS 129..521
  misc_feature 83: s=g or c
  misc_feature 125: w=a or t
  misc_feature 151: y=c or t
  misc_feature 159: k=g or t
  misc_feature 160: k=g or t
  misc_feature 220: n=a, g, c or t
  misc_feature 532: m=a or c
  misc_feature 533: k=g or t
  UNSURE 8: Xaa=Ala or Val
  UNSURE 11: Xaa=Cys or Phe or Gly or Val
  UNSURE 31: Xaa=Lys or Met or Arg or Thr
gtttttttagtctatcgctgcggttgcgagcgctgtagggagcctgtgctgtgccgcgcagttaggcagcagcagccgcggasagtagccgccgtgggagggagccatgaagcattacgagcagwgagatgattcttcaagaaaccaaagyagcctgtkkcattccagcgattcctcattgctcaagggtggagattctggacgcaaagacaagggagangctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggcccttttcatctacctgctcttctacttccgagtgcccttcatctatggcacaaatatgactttaccmkagtcggcatacagt

SEQ ID NO: 4022 - DNA, 393 bp, Homo sapiens
  CDS 27..350
  misc_feature 241: y=c or t
  UNSURE 72: Xaa=Phe or Ser
aggcccgtccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctytgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggagg

SEQ ID NO: 4023 - DNA, 413 bp, Homo sapiens
  CDS 42..344
  misc_feature 240: r=a or g
  UNSURE 67: Xaa=Gly or Ser
ttgaagtgttgaataaacacttatttttgacttcaaaaccaatggtctacttggttaatctttctgaaaaagactacattagaaagaaaaacaaatgtggggccttggaactcaagttgcaagaattgagtgctgaggagagacagaagtatctggaagcgaacatgacacaaagtgctttgccaaagatcattaaggctgggtttgcagcactccaactagaatactttttcactgcargcccagatgaagtgcgtgcatggaccatcaggaaagggactaaggctcctcaggctgcaggaaagattcacacagattttgaaaagggattcatatggctgaagtaatgaaatacgaagattttaaagaggaaggttctgaaaatgcagtcaaggctgctggaaagtacagac

SEQ ID NO: 4024 - DNA, 461 bp, Homo sapiens
  CDS 86..457
  misc_feature 286: r=a or g
cttttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaratcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagc

SEQ ID NO: 4025 - DNA, 343 bp, Homo sapiens
  CDS 26..337
  misc_feature 139: s=g or c
  misc_feature 140: n=a, g, c or t
  UNSURE 39: Xaa= *  or Gly or Arg
agcctgaagcggaagtggaggaaagatggaggaccatcagcacgtgcccatcgacatccagaccagcaagctgctcgattggctggtggacagaaggcactgcagcctgaaatggcagagtctggtgctgacgatccgsngagaagatcaatgctgccatccaggacatgccagagagcgaagagatcgcccagctgctgtctgggtcctacattcactactttcactgcctaagaatcctggaccttctcaaaggcacagaggcctccacgaagaatatttttggccgatactcttcacagcggatgaaggattggcaggagattatagctctgtatgagaa

SEQ ID NO: 4026 - DNA, 425 bp, Homo sapiens
  CDS 70..405
  misc_feature 62: r=a or g
  misc_feature 150: y=c or t
  misc_feature 166: d=a or g or t
  misc_feature 365: w=a or t
  misc_feature 418: k=g or t
  UNSURE 33: Xaa=Leu or Met or Val
  UNSURE 99: Xaa=Leu or Gln
gaaatcgtaggacttccgaaagcagcggtggcgtttgcttcactgcttggaaggtgtgagtrcgcgaagatgcgaaaggtggttttgatcaccggggctagcagtggcattggcctggccctctgcaagcggctgctggcggaagatgaygagcttcatctgtgtdtggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaacwaatatcaaagcacttttctttggcctcttttcaagaaaagtgattcatatgtkctccaca

SEQ ID NO: 4027 - DNA, 425 bp, Homo sapiens
  CDS 46..417
gggtgccgctggcggccgttgccagggtaggggtcgctttgcggcatggcgatggcggagggcgagaggactgagtgtgctgagcccccccgggacgaacccccggctgatggagctctgaagcgggcagaggagctcaagactcaggccaatgactacttcaaagccaaggactacgagaacgccatcaagttctacagccaggccatcgagctgaaccccagcaatgccatctactatggcaaccgcagcctggcctacctgcgcactgagtgctatggctacgcgctgggagacgccacgcgggccattgagctggacaagaagtacatcaagggttattaccgccgggctgccagcaacatggcactgggcagttccgggccgcgctgcgagactacgagacggtggtcaaggtgaagccc

SEQ ID NO: 4028 - DNA, 527 bp, Homo sapiens
  CDS 115..507
  misc_feature 185: r=a or g
  misc_feature 435: n=a, g, c or t
  misc_feature 473: n=a, g, c or t
  misc_feature 475: r=a or g
  misc_feature 486: s=g or c
  misc_feature 505: r=a or g
  UNSURE 24: Xaa=Cys or Tyr
  UNSURE 107: Xaa= *  or Cys or Trp
  UNSURE 120: Xaa= *  or Leu or Ser or Trp
  UNSURE 121: Xaa=Met or Val
  UNSURE 131: Xaa=Ala or Thr
acacatgcctgcttaaagccctctccatcctctgcctcacccagtccccgctgagactgagcagacgcctccaggatctgtcggcagctgctgttctgagggagagcagagaccatgtctgacatagaagaggtggtggaagagtacgaggaggaggagcaggaaggtaagcgtaaacgtgtgtrctcatttggatcaaagacagcctggttcgaaactgacccacctcttctctcttctcttgctgcctggacttctgagcagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttgntgcctcccaagatcccagatggagagagagtggacttngrtgacatccacsggaagcgcatggagaaggrcctgaatgagttgcaggcgctg

SEQ ID NO: 4029 - DNA, 453 bp, Homo sapiens
  CDS 96..407
  misc_feature 403: n=a, g, c or t
  UNSURE 103: Xaa=Lys or Met or Arg or Thr
ctttgggccgtagttagtgtggggccgtgtctcagtccacccaaggtctcctcggatcgcctggagaggcactcggacctggagcagtgaggagaatgaataccttccaagaccagagtggcagctccagtaatagagaaccccttttgaggtgtagtgatgcacggagggacttggagcttgcgattggtggagttctccgggctgaacagcaaattaaagataacttgcgagaggtcaaagctcagattcacagttgcataagccgtcacctggaatgtcttagaagccgtgaggtatggctgtatgaacaggtggaccttatttatcagcttaaagaggagacacttcaacagcaggctcagcagctctactcgttattgggccagttacccaaaacaangatctagccaatcaagtctctgtgtgcctggagagactgggcagtttgac

SEQ ID NO: 4030 - DNA, 469 bp, Homo sapiens
  CDS 76..465
cttctcccagcattgccccccccacgtttcagcacagcgctggccgcagtctgacaggaaagggacggagccaagatggcggcggccgacggcgacgactcgctgtaccccatcgcggtgctcatagacgaactccgcaatgaggacgttcagcttcgcctcaacagcatcaagaagctgtccaccatcgccttggcccttggggttgaaaggacccgaagtgagcttctgcctttccttacagataccatctatgatgaagatgaggtcctcctggccctggcagaacagctgggaaccttcactaccctggtgggaggcccagagtacgtgcactgcctgctgccaccgctggagtcgctggccacagtggaggagacagtggtgcgggacaaggcagtggagtccttacgggccatctcacacgagcactcgccctctgacctggaggcgcactttgtgcgctagt

SEQ ID NO: 4031 - DNA, 458 bp, Homo sapiens
  CDS 91..396
  misc_feature 346: k=g or t
  misc_feature 347: s=g or c
  misc_feature 400: w=a or t
  misc_feature 401: r=a or g
  misc_feature 406: w=a or t
  UNSURE 86: Xaa= *  or Ala or Gly or Ser
acttgtgcgcatgctccgggtgtcccggagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaksatgtcaagagccgaagaattcagattgccgaaagaccatcattttgatatgawratatwagagcattcccaaaggcaaaatttccattgtagagcattgacacttctcata

SEQ ID NO: 4032 - DNA, 424 bp, Homo sapiens
  CDS 20..394
  misc_feature 422: n=a, g, c or t
  misc_feature 423: m=a or c
ctttcgggtggtcaggaagatggcggcctctggggcggacgcaggtcctggtacaatacttggtgttacgaaaggatctatcacaagctccgttctcctggccggcgggcgcactggtagcgcaggcttgtcacgcggccaccgggccttgcacactcaccgcgaccacccgcacacagccgcttacctccaagagctggggcgcatgcgcaaagtggtcctcgaggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaactgctgctttgatgtgtttgaatanmc

SEQ ID NO: 4033 - DNA, 382 bp, Homo sapiens
  CDS 54..371
  misc_feature 42: s=g or c
  misc_feature 43: n=a, g, c or t
  misc_feature 271: s=g or c
  misc_feature 342: s=g or c
  misc_feature 362: m=a or c
  UNSURE 73: Xaa=Cys or Ser
  UNSURE 97: Xaa=Asp or His
  UNSURE 103: Xaa=Asp or Glu
acctctgcagagccgggtggagcccattgacgtccagcgaasnaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctctsctccccaccagactgccagacgactacatcattctgcccacagacctgcgctgccacagccatcgccatcsatcgcatcccaccgacagamtgctgctcctagtgatctgg

SEQ ID NO: 4034 - DNA, 422 bp, Homo sapiens
  CDS 18..341
  misc_feature 11: k=g or t
  misc_feature 12: y=c or t
  misc_feature 34: k=g or t
  misc_feature 84: k=g or t
  misc_feature 282: r=a or g
  misc_feature 419: s=g or c
  UNSURE 6: Xaa=Met or Arg
  UNSURE 23: Xaa=Leu or Val
  UNSURE 89: Xaa=Gly or Ser
aatggcaaatkyggcgaatgagggagacagcgakgcgtcagagcatgaaaggtgactggcaccagcagtttggatcgcctcctktggcgggaggcccttgtagaggatacctttggagaacagctcacaccccagagggaagtggcttggacaaagggggctgctcagcagacttcgatctcctctgggggatgtggataccgctcaggcccgcacccctccattggtcctggagactgatatgggaggcggtatgtgccttggctccggagggcacctggrgcacccctcacctggagaaccctcatccagagcactcctttcctggagcacccctcacctgaagcaccctcagttggagcatcctctcacctagagaaccctcacctggagcaccctgttacccggggcaccctcasctg

SEQ ID NO: 4035 - DNA, 426 bp, Homo sapiens
  CDS 35..418
  misc_feature 294: r=a or g
  misc_feature 330: r=a or g
  misc_feature 339: r=a or g
  misc_feature 354: n=a, g, c or t
  misc_feature 355: k=g or t
  misc_feature 372: r=a or g
  misc_feature 422: r=a or g
  UNSURE 87: Xaa=Gln or Arg
  UNSURE 99: Xaa=Glu or Gly
  UNSURE 102: Xaa=Glu or Gly
  UNSURE 107: Xaa=Ile or Lys or Met or Asn or Arg or Ser or Thr
  UNSURE 113: Xaa=Asp or Gly
gttgcacagttgtttccgggaagcgggactccaaatgggtcgcagtcgcagccgctctccacggagggaacgtaggcgttcccggtccacatcccgggagagagaacgcaggcgccgagaaaggtccaggtctcgggagagagatcggagaaggagccgctcgcgatccccgcaccgaagacgctcccgatctccaagacgacatagatccacatctccttccccttctcgactgaaagaaagaagagatgaggaaaagaaagaaacaaaagaaacaaagagcaaagaacggcrgattactgaggaagacttagagggcaaaacagaggragaaatagraatgatgaagttaankgggatttgctcctttgrctccacaaaaggtaagaaggtggatggctctgtaaatgcctatgcataartgtc

SEQ ID NO: 4036 - DNA, 828 bp, Homo sapiens
  CDS 245..802
  misc_feature 368: r=a or g
  misc_feature 370: r=a or g
  misc_feature 613: m=a or c
  misc_feature 670: w=a or t
  misc_feature 696: m=a or c
  misc_feature 723: s=g or c
  misc_feature 724: n=a, g, c or t
  misc_feature 757: n=a, g, c or t
  misc_feature 758: n=a, g, c or t
  misc_feature 759: n=a, g, c or t
  misc_feature 760: k=g or t
  misc_feature 779: s=g or c
  UNSURE 42: Xaa=Gly or Arg
  UNSURE 151: Xaa=Ala or Glu
  UNSURE 160: Xaa=Ala or Gly
  UNSURE 171: Xaa=His or Gln
  UNSURE 172: Xaa=any one of the twenty amino acids
  UNSURE 179: Xaa=Glu or Gln
gagtcacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaaggtgaacacaaatgggctgctgtggtaggtttggaaattcatgcccagatttcctccaactctaatcttctctggatctcaagttcgcttttcagcacctccaaattctttggtttctttttttgatgcatctctacctggaactttgccggttctcaacaggrgrtgtgtagaagcggcggtgatgacaggcctggctctgaactgccacataaacaagaagtccttgtttgacaggaagcactacttctatgcagacctccctgcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggmaaaagcctccacgacaacctgaggtctcagacgctcattgatttgaacagggcaggwgtgggccttctggaggtggtcctggmgcccgacatgtcctgtggagaagaggsngcaacagctgtcagggagctgcagctgatccannnkgccctggggaaccagccasaggaacatggcagagggcccagttgagagtggatgccaatatatccgtg

SEQ ID NO: 4037 - DNA, 433 bp, Homo sapiens
  CDS 43..360
  misc_feature 333: n=a, g, c or t
  UNSURE 97: Xaa=Asp or Glu
gcgtttccgtttccgctaggactctggcagttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgancacgccattcacagccatcgccggcagtgaaatcttctccctggagatgagcaagaccgaggcgctgacgcaggccttccggcggtccatcggcgttcgc

SEQ ID NO: 4038 - DNA, 568 bp, Homo sapiens
  CDS 31..348
  misc_feature 2: n=a, g, c or t
  misc_feature 397: m=a or c
  misc_feature 533: m=a or c
gnagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgatacagcctagaagggtcacattttggaccctgtctatccactaggmctgggctttggctgctaaacctgctgccttcagctgccatcctggacttccctgaatgaggccgtctcggtgcccccagctggatagagggaacctggccctttcctagggaacaccctaggcttacccctcctgmctcccttcccctgcctgctgctgggggagatgctg

SEQ ID NO: 4039 - DNA, 413 bp, Homo sapiens
  CDS 22..387
  misc_feature 376: m=a or c
aggcgcttacagtgcaccaagatggccgcccccgtggatctagagctgaagaaggccttcacagagcttcaagccaaagttattgacactcaacagaaggtgaagctcgcagacatacagattgaacagctaaacagaacgaaaaagcatgcacatcttacagatacagagatcatgactttggtagatgagactaacatgtatgaaggtgtaggaagaatgtttattcttcagtccaaggaagcaattcacagtcagctgttagagaagcagaaaatagcagaagaaaaaattaaagaactagaacagaaaaagtcctacctggagcgaaggttaaaggaagctgaggacaacatccgggagatgctgatggcamgaagggccaagtagggagcctctctgggaagctcttc

SEQ ID NO: 4040 - DNA, 472 bp, Homo sapiens
  CDS 28..414
  misc_feature 360: n=a, g, c or t
  UNSURE 111: Xaa=Asp or Glu
aggaagtgacgtcaggcggccgcggagatggaggatttgctcgacttggacgaggagcttcgctacagcttggctacctccagggccaagatgggtcgccgagctcaacaggagtcagcgcaggccgagaatcacctcaatggcaagaattcctctttgactctgactggagagacttcctctgctaaattacctcgctgccgacagggaggctgggcaggtgattccgtgaaggcttcgaagtttaggaggaaggcttctgaagaaatagaagatttccgcctcagaccacagagcctgaatggatcagattatggaggagatattcctatcattccggatctggaggaagtacaggangaagactttgttttgcaggtggcagccccctcccagcatccagataaaagcgggtgatgacctaccgtgacctggacaatgacctcatgaagtactcagccattcagacact

SEQ ID NO: 4041 - DNA, 446 bp, Homo sapiens
  CDS 39..410
aacagaatagcagcagtaatatcagttacagcaatgcaatgcagaaagaaatcacactgccttcaagactcatatattacatcaaccaagactcggaaagcccttatcacgttcttgacacaaaggcaagacaccagcaaaaacataataaggctgtccatctggcccaggcaagcttccagattgaagccttcggctccaaattcattcttgacctcatactgaacaatggtttgttgtcttctgattatgtggagattcactacgaaaatgggaaaccacagtactctaagggtggagagcactgttactaccatggaagcatcagaggcgtcaaagactccaagggtggctctgtcaacctgcaatggacttcccgggatgggagaaagagagagactccgagtatatagcctttttaatagtttttactatacaaaatacat

SEQ ID NO: 4042 - DNA, 518 bp, Homo sapiens
  CDS 73..417
  misc_feature 36: m=a or c
  misc_feature 37: s=g or c
  misc_feature 39: s=g or c
  misc_feature 106: s=g or c
  misc_feature 173: r=a or g
  misc_feature 175: r=a or g
  misc_feature 184: s=g or c
  misc_feature 194: m=a or c
  misc_feature 195: k=g or t
  misc_feature 206: k=g or t
  misc_feature 262: m=a or c
  misc_feature 374: m=a or c
  misc_feature 388: n=a, g, c or t
  misc_feature 389: s=g or c
  misc_feature 410: r=a or g
  misc_feature 411: s=g or c
  misc_feature 431: s=g or c
  UNSURE 12: Xaa=Gly or Arg
  UNSURE 34: Xaa=Asp or Gly
  UNSURE 35: Xaa=Ile or Val
  UNSURE 38: Xaa=Ala or Pro
  UNSURE 41: Xaa=Ala or Asp or Glu
  UNSURE 45: Xaa=Leu or Trp
  UNSURE 64: Xaa=Lys or Gln
  UNSURE 101: Xaa=Lys or Thr
  UNSURE 106: Xaa=Ala or Gly or Pro or Arg or Ser or Thr or Trp
  UNSURE 113: Xaa=Lys or Asn or Arg or Ser
tgaggatgccgggaagggctggtggtcgggggcctmsascggcggttgcacttagttgcggctgctgtcaccatgtcccgcgttttggtgccttgccatgtgaaasgctccgtagccctccaggtgggcgacgtgcggacctcccaaggccggcctggcgtgctggtcatcgrtrtcaccttcsccagcgtcgmkcccttcgagtkgcaggaaatcacgtttaagaattactacacagcttttttgagcatccgtgtccgtmagtacacctcagcacacacacctgccaagtgggtgacctgcctgcgggactactgcctaatgcctgacccacacagtgaggagggagcccaggagtatgtatcgctgttcamgcatcagatgctgnsgacatggctagaatatcggarstacgcctgattctgcggcascatcaccactgtggctgtctttcacagtggaggagctgcagatctatcagcagggaccaaagagccctccgtgacctttcccaagtg

SEQ ID NO: 4043 - DNA, 409 bp, Homo sapiens
  CDS 13..357
  misc_feature 243: n=a, g, c or t
  misc_feature 244: k=g or t
  misc_feature 287: s=g or c
  misc_feature 303: n=a, g, c or t
  misc_feature 315: r=a or g
  misc_feature 344: r=a or g
  misc_feature 362: m=a or c
  misc_feature 387: y=c or t
  UNSURE 78: Xaa=Asp or Tyr
  UNSURE 92: Xaa=Ala or Gly
  UNSURE 97: Xaa=Ile or Met
  UNSURE 111: Xaa=Lys or Arg
gcacaatgggccatggagttcccgttcgatgtggacgcgctgttcccggagcggatcacggtgctggaccagcacctgaggcccccagcccgccgacccggaaccacaacgccggcccgtgttgatctacagcagcaaattatgaccattatagatgaactgggcaaggcttctgccaaggcccagaatctttccgctcctatcactagtgcatcaaggatgcagagtaaccgccatgttgtnkatattctcaaagacagttcagcccgaccggctggaaaaggagscattattggtttcatnaagtgggatacragaagctctttgtactggatgatcgtgargctcataatgaggtagamcactttgcatcctggacttttacaycatgagtctgtgcaacgccatg

SEQ ID NO: 4044 - DNA, 535 bp, Homo sapiens
  CDS 38..454
  misc_feature 18: n=a, g, c or t
  misc_feature 419: w=a or t
  UNSURE 128: Xaa=Arg or Trp
caaggatgattttgcgantaatcgagaatttatcacaatggttgtatacaagactgatggaaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccawggagatcctggtccccatggctttctgaggaaatctagtggtgactataggtgtgggttttgctacctggaattagaaatataccttctgggatcttcaatatcattcctagtacc

SEQ ID NO: 4045 - DNA, 419 bp, Homo sapiens
  CDS 24..365
  misc_feature 207: r=a or g
  misc_feature 227: n=a, g, c or t
  misc_feature 410: r=a or g
  UNSURE 62: Xaa=Glu or Lys
agtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggagraggacgcgggcctggtggcngaggccgaggccgtggctgccggctggatgctcgatttcctctgcctctctctttgccgagctttccgcgacggccgctccgaggacttccgcagacccgcaacagcgcagaggctattattcatggactatccagtctaacagcttgccagttgagaacgatatacatatgtcagtttttgrcaagaattg

SEQ ID NO: 4046 - DNA, 404 bp, Homo sapiens
  CDS 60..368
  misc_feature 350: n=a, g, c or t
  UNSURE 97: Xaa=His or Gln
atttggactgacgtcccgccctctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacatttccagcaagagggagagggtgaagattctctacaaaaagattgaagatctgatcaagtacctggatcctgagtacatcgaccgcattgccatacctgatgcctctaagctgcaattcatcctagcagaggagcagtttatcctttcccangttgcactcctgagcaggtgaatgccttggtgcccatgctggacagtgctcaca

SEQ ID NO: 4047 - DNA, 453 bp, Homo sapiens
  CDS 70..444
  misc_feature 309: s=g or c
  UNSURE 80: Xaa=Asp or Glu
gctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgggagatgccatcccagcagtggaggtgtttgaaggggagccagggaacaaggtgaacctggcagasctgttcaagggcaagaagggtgtgctgtttggagttcctggggccttcacccctggatgttccaagacacacctgccagggtttgtggagcaggctgaggctctgaaggccaagggagtccaggtggtggctgtctgagtgtta

SEQ ID NO: 4048 - DNA, 407 bp, Homo sapiens
  CDS 55..360
agtctctccggcccggtttccctcggcgtgctactgtgcgctcgatccagcaccatggggaagcgggacaatcgggtggcctatatgaacccaatagcaatggcgagatcaaggggtccaatccagtcttcagggccaacaatacaggattatctgaatcgaccaaggcctacctgggaagaagtaaaagagcaactagaaaagaaaaagaaaggctccaaggctttggctgaatttgaagaaaaaatgaatgagaactggaagaaagaactggaaaaacacagggagaaattgttaagtggaagtgagagctcatccaaaaaaaagacagagaaagaaaaaagaaaagaagaaatctggtagggtgagcaaaaattttccatttttctaaacgttacaattaagag

SEQ ID NO: 4049 - DNA, 425 bp, Homo sapiens
  CDS 96..419
  misc_feature 398: k=g or t
  misc_feature 419: n=a, g, c or t
  UNSURE 101: Xaa=Ile or Met
atcacgtggacgctactcgctatccccggcctgttggcttcttccgcgctggagtatccagataggcgacacgccggcgggcggctgaggcgggaatggctgctgtactgcagcgcgtcgagcggctgtccaatcgagtcgtgcgtgtgttgggctgtaacccgggtcccatgaccctccaaggcaccaacacctacctagtggggaccggccccaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatgacactacctattgcatkaaaaaactcccacggaatccntagaga

SEQ ID NO: 4050 - DNA, 452 bp, Homo sapiens
  CDS 103..408
  misc_feature 7: w=a or t
  misc_feature 330: n=a, g, c or t
  misc_feature 331: n=a, g, c or t
  misc_feature 415: r=a or g
  UNSURE 76: Xaa= *  or Cys or Trp
  UNSURE 77: Xaa=Ala or Pro or Ser or Thr
agtctcwcccagcgaccgccgcgggggcaaggcctggagctgtggttcgaatttgtgcaggcagcgggtgctggcttttagggtccgccgcctctctgcctaatgagctgcaccagaatgatccaggttttagatccacgtcctttgacaagttcggtcatgcccgtggatgtggccatgaggctttgcttggcacattcaccacctgtgaagagtttcctgggcccgtacgatgaatttcaacgacgacattttgtgaataaattaaagcccctgaaatcatgtctcaatataaaacacaaagccaagtctcccccaaatatcatatgnncagatcactcgcttcctttacatcttctacccaaatacctttcagcgaggctggccctggctgcagatctaacatcctaataarcctatctatcctccatttcacaacactccttccgaca

SEQ ID NO: 4051 - DNA, 410 bp, Homo sapiens
  CDS 37..363
  misc_feature 387: r=a or g
agtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtaggaacaacacattactgagaaratattgctactgttagcattaca

SEQ ID NO: 4052 - DNA, 432 bp, Homo sapiens
  CDS 11..325
agtagacgccatgatggatgtgtctggtgtgggtttcccaagcaaggttccttggaagaagatgtctgcagaggagctggagaatcagtactgtcccagccgatgggttgtccgactgggagcagaggaagccttgaggacctactcacagataggaattgaagccaccacaagggcccgggccaccaggaagagcctgctgcatgtcccctatggagacggcgaaggggagaaagtggacatttacttccccgacgagtcgtctgaagccttgcctttcttcctgttctttcacggaggatactggcagagcggaagattatcttgaaaacaatcttccagtagttctgacgatacttggagcctggtccacgtgcatcccaccttgggaagcctctccaaagagctttcggagctgacactgacagcttc

SEQ ID NO: 4053 - DNA, 441 bp, Homo sapiens
  CDS 47..373
  misc_feature 2: k=g or t
  misc_feature 3: k=g or t
  misc_feature 7: y=c or t
  misc_feature 8: n=a, g, c or t
  misc_feature 34: r=a or g
  misc_feature 160: s=g or c
  misc_feature 161: n=a, g, c or t
  misc_feature 164: s=g or c
  misc_feature 166: y=c or t
  misc_feature 177: r=a or g
  misc_feature 196: r=a or g
  misc_feature 226: r=a or g
  misc_feature 227: r=a or g
  misc_feature 356: n=a, g, c or t
  misc_feature 357: n=a, g, c or t
  misc_feature 358: n=a, g, c or t
  UNSURE 39: Xaa= *  or Gly or Arg
  UNSURE 40: Xaa=Gly or Arg
  UNSURE 44: Xaa=Lys or Arg
  UNSURE 61: Xaa=Ala or Thr
  UNSURE 104: Xaa=any one of the twenty amino acids
ckktttyncctgcatccgggcctgagagtgcagrcttgagggaagcatggaggtccatggcaagcccaaggctagcccgagttgttcgtcgcccacccgggattcctcaggagtcccagtgtccaaggagctgctgacggcgggaaagccgacggccgcsngasgyatatgggacargttgctcatcaactcccarcctaagtccagaaagacctccactcttcarrcagttcggatagagaggagtcccttattggaccaggtacagacatttctcccacagatggcacgggcaaatgaaaagctaagaaaagaaatggcagctgcaccacctggtcgtttcaatattgaaaacnnngatgggcctcataagtaaagttatacaaatggatgtggctttgtttgagatgaatcagtcggattcaaaagaagtggacagtt

SEQ ID NO: 4054 - DNA, 443 bp, Homo sapiens
  CDS 107..439
  misc_feature 301: r=a or g
  misc_feature 348: r=a or g
  misc_feature 349: k=g or t
  UNSURE 81: Xaa=Asp or Glu or Gly
agtgggcgaggctccgccccgtggtggggcgctttccgtcggcgtgtgttttggggttgccatcggcccgtagtatgtgaaaattgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaaacaaaagcgraaagaaaaacgcaagaggaaaaaattagagcgacaatgtcaaatggrkccaaactcagatggacatgacagaaaacgtgttcgaagagatgttgttcatagcaccttcgccttattattgactgtagttttgatcacttgat

SEQ ID NO: 4055 - DNA, 455 bp, Homo sapiens
  CDS 62..403
  misc_feature 277: w=a or t
  misc_feature 309: h=a or c or t
  misc_feature 409: y=c or t
  misc_feature 426: m=a or c
  UNSURE 83: Xaa=Ile or Asn or Thr
atcagattcacaaattactagacaagctctcaatgaaatcgagtcacgtcacaaggacatcatgaagctggagaccagcatccgagagttgcatgagatgttcatggacatggctatgtttgtggagactcagggtgaaatgatcaacaacatagaaagaaatgttatgaatgccacagactatgtagaacacgctaaagaagaaacaaaaaaagctatcaaatatcagagcaaggcaagaaggaaattgatgttcattattatttgtgtaattgtwttgcttgtgatccttggaattatcctagcaahcaacattgtcatagcaaccatatcccaagagccatttatccttgagactcagaccacatctgcaaccaaatcagcatcctgtcattttcgtgaatgaatycagacgctgtaaccggmatcgagtgctgaccttgtaatgtatgagt

SEQ ID NO: 4056 - DNA, 466 bp, Homo sapiens
  CDS 106..462
  misc_feature 12: m=a or c
  misc_feature 13: y=c or t
  misc_feature 27: s=g or c
  misc_feature 29: r=a or g
gacacgtcgggmytggcggctgcagcsargggtcctccgacgctgggcttccgtgagcggcgctctgccagatctctggaccggattcgtcccattctcgtcctcatggtggacaagaaactggtggtggttttcggaggcacaggtgcccagggtggctccgtggcccgcacactcctggaagatgggacattcaaggttcgagtggtgacccgaaaccctaggaagaaggcagcaaaggagctgaggctgcaaggtgcagaagtagtgcagggagaccaagatgaccaggtcatcatggagctggccctgaatggggcttacgccaccttcatcgtgaccaattactgggagagctgcagccaggagcaggaggtcaagcaggggaagctgctcgctgatctggccaggcgcctgggcctccactatgtgtctacagcggcctggagaacatcaagaagctgac

SEQ ID NO: 4057 - DNA, 386 bp, Homo sapiens
  CDS 6..314
  misc_feature 265: r=a or g
  UNSURE 87: Xaa=His or Arg
tctcaatgtttcttattcctttaggaaacagcctgactctcttctgtatcttattctattctttccaccataaaactgcaattgcatacttttgggcaagggctatcatccagaccttaattctccaaacacttctgctacttatgaactcctctctcattgattgcagggttgtgcattattatcttttcttacaggtatcccaggaccacccttctgcctgccctacaaccagataccttcagctttctcactttctcattcrttctcttcagcagtctctctatatatactcaattgtaacccattgcatttaattcaacctaagttgttataatcccagttctcttacaccaggtccttgctcacccacagcattcacatca

SEQ ID NO: 4058 - DNA, 386 bp, Homo sapiens
  CDS 44..358
  misc_feature 298: y=c or t
  misc_feature 376: r=a or g
attttcggtgtagaagtggcagcacggcagactggtcaaacaaatggattttacagaggcttacgcggacacgtgctctacagttggacttgctgccagggaaggcaatgttaaagtcttaaggaaactgctcaaaaagggccgaagtgtcgatgttgctgataacaggggatggatgccaattcatgaagcagcttatcacaactctgtagaatgtttgcaaatgttaattaatgcagattcatctgaaaactacattaagatgaagacctttgaaggtttctgtgctttgcatctyggctgcaagtcaaggacattggaaaatcgtacagattcttttagaagctggggcagatcctaatgcaactactttagragaaacgaca

SEQ ID NO: 4059 - DNA, 489 bp, Homo sapiens
  CDS 98..460
  misc_feature 458: r=a or g
  UNSURE 121: Xaa=Gly or Ser
acagttgctgagaggaggcgagaggcgggggcgctagggccgagatcatgtctgactgggagaggtttccttggcagcagaggacgctaggttttggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcargctgaaaaactgtgatctttatttttccaga

SEQ ID NO: 4060 - DNA, 407 bp, Homo sapiens
  CDS 41..379
  misc_feature 313: h=a or c or t
gaattgattgtggcctgtgaacacggagactccaagtcctatgtatacgagggaagctgcccacaaactgacagggagaggaagttcttcagtttatgcgttgcttgggaactgtgtctccgcggctggccagcgcgcgatgtttcccggggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgccthaaggagccagccccgcttctcagagctacagttaccactcttcgggagaatacagctccgatttcttaactccagagtttgtcaagtttagcat

SEQ ID NO: 4061 - DNA, 424 bp, Homo sapiens
  CDS 8..346
taaaaaaatgttcgaaatatgttcagggataaatacaagatataaaaacacgaaagcaagcacaaaacaaaagcaaatatcagaactttcccaaagaaccacaaacagaagggacagaagggacagaagagcacgtctgctgcactttaataaagcagggctaccaatgctaaatacacttatggaagtgaccgaactaaacccaggtggctcggtgtttaatttaatggccagttgcaatacacaggtggctgcactgataagtcagtggttgaagctgtgcatcccgacttcaagtactagaacatttgccagtagcacccagaacaggaaagcctcagttccttagacagcaaaaggttaagtcaactgtgtcaagagccagagaaatacttgatattcttaaatgcatttgtgtcatagt

SEQ ID NO: 4062 - DNA, 430 bp, Homo sapiens
  CDS 49..411
  misc_feature 275: w=a or t
  misc_feature 278: k=g or t
  misc_feature 279: m=a or c
  UNSURE 76: Xaa=Lys or Met
  UNSURE 77: Xaa=Ile or Arg or Ser
caatgagccccaaacttttcagtaaaataaaaaaaggattgatattttatgaaacatttttataccctaaaatgcagaagcatgttagaaatatatagttgctatcagtcttcaattaaatgtttaccacttggcaaaaatgatactttggtaaatccaaacatgcctaggtatccactctgtatactccggagaatgttcctatttaagcttattattgtcttgagcattaagcatctcacatcagttgttacatctggctttaagtctccaawgakmccctggggaactcaatcccatcaaaggaatttcgagaggagttcacagctcctatctaccatagaagggagaaacaggataaggaatagatccctgataaagcacatgaacaaattaaatccattgttaatttgagtgactggcatagaga

SEQ ID NO: 4063 - DNA, 437 bp, Homo sapiens
  CDS 55..399
  misc_feature 330: s=g or c
  misc_feature 361: n=a, g, c or t
  misc_feature 362: k=g or t
  UNSURE 92: Xaa=His or Gln
  UNSURE 103: Xaa= *  or Gly or Ile or Leu or Arg or Val
agtgtgctggggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcasacctgttccttcaggccttctggcagaccankaatcgcgagtggacgggcattgacaggctgcgctggataaattctacatgctcatgcggatggtcctgaacgagt

SEQ ID NO: 4064 - DNA, 464 bp, Homo sapiens
  CDS 12..428
  misc_feature 11: r=a or g
  misc_feature 19: n=a, g, c or t
  misc_feature 65: n=a, g, c or t
  misc_feature 67: v=a or c or g
  misc_feature 113: d=a or g or t
  misc_feature 122: d=a or g or t
  misc_feature 155: w=a or t
  misc_feature 157: r=a or g
  misc_feature 158: r=a or g
  misc_feature 194: h=a or c or t
  misc_feature 313: m=a or c
  misc_feature 319: d=a or g or t
  misc_feature 346: m=a or c
  misc_feature 383: w=a or t
  misc_feature 398: n=a, g, c or t
  misc_feature 399: r=a or g
  misc_feature 403: w=a or t
  misc_feature 404: w=a or t
  misc_feature 414: n=a, g, c or t
  misc_feature 422: s=g or c
  misc_feature 423: r=a or g
  UNSURE 3: Xaa=Ala or Asp or Gly or Val
  UNSURE 19: Xaa=Ala or Asp or Gly
  UNSURE 34: Xaa=Asp or Glu
  UNSURE 37: Xaa=Asp or Glu
  UNSURE 49: Xaa=Lys or Arg
  UNSURE 101: Xaa=Pro or Gln
  UNSURE 103: Xaa=Lys or Met or Arg
  UNSURE 112: Xaa=Asn or Thr
  UNSURE 129: Xaa=Ile or Met
  UNSURE 130: Xaa=Glu or Lys
  UNSURE 131: Xaa=Asp or Glu or Val
  UNSURE 135: Xaa= *  or Glu or Lys or Gln
  UNSURE 137: Xaa=His or Gln
  UNSURE 138: Xaa=Glu or Lys
cctcaaaagaratggaggncatgggttgtaggttttaccacgctgcctccattgcagcccgagcngvtagctacatggcctatatgactcaatatcagcgtaaactctgggadgacatagadgatctggttcatgacccagaatttgatcgtggwarrgcaagatgcataatatctgatggtatggatgcagghctttggcaactttgtactactagggacataatggactctgtagtcagagttatggccatggccatagactatagacggcaggcctggcttcgacttacatctctcactaagaaaacccmggagadgatctcccacttgccctttgatggtamttccctttttggacaagatgtgaaagctgttgttgcwgaagacaacaatatnraagwwaatgactatnaagatcasraatactaataatcagcatcgatacttttatagtcatgatca

SEQ ID NO: 4065 - DNA, 450 bp, Homo sapiens
  CDS 123..446
  misc_feature 106: r=a or g
  misc_feature 107: m=a or c
  misc_feature 434: k=g or t
  UNSURE 104: Xaa=Ile or Met
ttacattaaagaaaagaaggcagcagtgaaagaatttgaagacaagaaggttgagctgaaagagaacctgattgctgagctagaagaaaagaagaaaatgattgarmaatgaaaagctgacaatggaactgactggagattctatggaggtgaaacctatcatgaccataaagttgcggaggcgaccaaatgatcccgtccccatcccagacaagaggaggaaacctgctccagcccagctaaactatttgttaacagatgaacagatcatggaggatctgagaacattaaataagcttaagtcacccaagagaccagcatctccatcctctcctgagcacttgcctgcaacacccgcggaatctccagcccagaagttcgaagctcggatagaagatggcaaactgtactatgaccaaagatggtatgttatkggaaacctggactagt

SEQ ID NO: 4066 - DNA, 458 bp, Homo sapiens
  CDS 112..432
  misc_feature 276: k=g or t
accccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagtkatcattcctgagaggtacccatttgaacctcctcagatccgatttctcactccaatttatcatccaaacattgattctgctggaaggatttgtctggatgttctcaattgccaccaaaaggtgcttggagaccatccctcaacatcgcaactgtgttgacctctattcagctgctcatgtca

SEQ ID NO: 4067 - DNA, 433 bp, Homo sapiens
  CDS 96..401
  misc_feature 20: w=a or t
  misc_feature 53: k=g or t
  misc_feature 54: b=c or g or t
  misc_feature 92: d=a or g or t
  misc_feature 148: m=a or c
  misc_feature 241: r=a or g
  misc_feature 242: r=a or g
  misc_feature 331: r=a or g
  UNSURE 18: Xaa=Ala or Glu
  UNSURE 49: Xaa=Glu or Gly
  UNSURE 79: Xaa=Cys or Tyr
agccaaaaaacacacgaaawaaatgctcaccatcactggccatcagagaaatkbaaatcaaaaccacagtgagataccatctcacaccagtdagaatggcaatcactaaaaagtcaggaaacaacagatgctggagaggatgtggagmaataggaacacttttacactgttggtgggactgtaaactagttcaaccattgtggaagtcagtgtggcgattcctcaggcatctagaactagrrataccatttgacccagccatcccattactgggtatatacccaaaggactataaatcatgctgccataaagacacatgcacacgtatgtrtattgtggcactattcacaatagcaaagacttggaaccaatccaaatgtccaataatgaatagactggattaagaaatgtggcacatatcaccatggaatac

SEQ ID NO: 4068 - DNA, 475 bp, Homo sapiens
  CDS 104..430
  misc_feature 101: r=a or g
  misc_feature 107: y=c or t
  misc_feature 108: k=g or t
  misc_feature 109: s=g or c
  misc_feature 113: s=g or c
  misc_feature 123: r=a or g
  misc_feature 134: y=c or t
  misc_feature 136: m=a or c
  misc_feature 155: v=a or c or g
  UNSURE 2: Xaa=Cys or Phe or Leu or Arg or Trp
  UNSURE 4: Xaa=Asp or His
  UNSURE 7: Xaa=Glu or Gly
  UNSURE 11: Xaa=Phe or Leu
  UNSURE 18: Xaa=Asp or His or Asn
ccacttcctctcctaccctgccctccttaggccctggcctccctcatcttctcctggttcccggagcacactgagctcttttccttcacaaggctttggargcatgyksctcsatctgcctgraaacttctccytmaggactcagtacatgagtvacctccccatagacgcttcccctgaccctctgtgttggtctgctctggctctcataagaaaataccagagactgagtggcttaaacaaaagacatttattttctcacagtcctggaggctggaagtccaagaccaaggtgttcgcagggttggtttcttctaaggcctctctccttggcttggagatggccctggttggtcttctgagtgcaggtgtccctggtgtctctttgtgtgtccagattttctcttataaggacactggtgagattggatgaggggcccctgacggcctcatcttaatgtaatcacctctctta

SEQ ID NO: 4069 - DNA, 454 bp, Homo sapiens
  CDS 21..353
  misc_feature 182: r=a or g
  misc_feature 340: w=a or t
  misc_feature 341: w=a or t
  misc_feature 345: d=a or g or t
  misc_feature 357: r=a or g
  misc_feature 364: m=a or c
  misc_feature 415: n=a, g, c or t
  misc_feature 447: r=a or g
  UNSURE 107: Xaa=His or Leu or Gln
  UNSURE 109: Xaa= *  or Glu or Lys
attttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagargatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagcwwagadaacagctttgaratgcaamaaggtgatcagaatcctcaaattgcggcacatgtcataagtgaggccagcngtaaaacaacatctgtgttacagtgggctgaraaaggat

SEQ ID NO: 4070 - DNA, 448 bp, Homo sapiens
  CDS 4..336
  misc_feature 14: s=g or c
  misc_feature 24: m=a or c
  misc_feature 104: m=a or c
  misc_feature 291: s=g or c
  misc_feature 295: n=a, g, c or t
  misc_feature 312: s=g or c
  misc_feature 329: b=c or g or t
  misc_feature 330: b=c or g or t
  misc_feature 341: h=a or c or t
  misc_feature 342: n=a, g, c or t
  misc_feature 358: s=g or c
  misc_feature 359: s=g or c
  UNSURE 4: Xaa=Pro or Arg
  UNSURE 34: Xaa=Ala or Glu
  UNSURE 96: Xaa=Asp or Glu
  UNSURE 98: Xaa=Ala or Pro or Ser or Thr
  UNSURE 109: Xaa=Cys or Phe or Leu or Ser or Trp
aagatggcggcgcscggtacaggmtccgggttgtggcgtcctaggagccgcgacggtttctgccctcgggcagtgaggggcagcagcgcttggctgacccctgmggcgtcccgtagcctcgcgttaagccttgttcagagcgggggcttttgctgtcgcagtgggttccggagagtgcaggtgatttcgcagcaggtttcttgtgctggccgcgctcgccggacgaagaagagaagggcagttgggcctgcggccttggcgttcatgaggcctcagagagctccggaggasttancaactgtgagggggctsctagagttcttctcctbbggtgtgtgaghngcagcctaggaccccssgttcggggagtcgcaaagaaggccgtaagggcttcacttccttctccggaggcctgccttctgcgcgtcgattaacaccgcattctttc

SEQ ID NO: 4071 - DNA, 406 bp, Homo sapiens
  CDS 40..393
  misc_feature 295: v=a or c or g
  misc_feature 296: n=a, g, c or t
  misc_feature 297: w=a or t
  UNSURE 86: Xaa=Ala or Asp or Glu or Gly or His or Ile or Lys or Leu or Asn or Pro or Gln or Arg or Ser or Thr or Val
tttcttcacagaattggaaaaaactactttaaagttcatatggaaccaaaaaaggcctgcattgccaagtcaatcctaagccaaaagaacaaagctggaggcatcacactacctgacttcaaactatactacaaggctacagtaaccaaaacagcatggtactggtaccaaaatagagatatagaccaatggaacagaacagagccctcagaaataatgctgcatatctacaaccatctgatctttgacagacctgacaaaaacaagaaatggggaaaggattccctatttaatvnwtggtgctgggaaaactggctagccatatgtagaaagctgaaactgcatcccttccttacactttatgcaaaattaattcaagatggattaaagacttaaatgttagacc

SEQ ID NO: 4072 - DNA, 494 bp, Homo sapiens
  CDS 38..439
  misc_feature 366: r=a or g
  misc_feature 382: w=a or t
  misc_feature 384: w=a or t
  misc_feature 397: s=g or c
  misc_feature 452: k=g or t
  misc_feature 467: m=a or c
  misc_feature 472: m=a or c
  misc_feature 474: r=a or g
  UNSURE 110: Xaa=Lys or Arg
  UNSURE 116: Xaa=Glu or Val
aacctcttcaaagaggttctacttaaagttccaggtcatgacatttttctgctggaatttggttgggcccttggagttttcttacaggaatttgtccctcagcaggcaaaatattgattcatggtgcaaagatcatagctacgtgattgctggttattatcaagctaatgagcgagtaaaggatgccagtccaaaccaggttgcagagaaggtggcctccagaatcgccgagggcttcagcgacactgcgctcatcatggtagacaacaccaagtttacgatggactgcgtaggcctacgatccacgtgtacgagcaccatgagaacagatggcggtgcagagacccacaccatgactactgtgaractggccagaggcacwgwggatctcagcctsgctcctggacagccggtcctacgagacgctcgtggatttcgataaccacctggakgacattcggaatgamtggamaracccagagatcaataaagct

SEQ ID NO: 4073 - DNA, 456 bp, Homo sapiens
  CDS 146..451
  misc_feature 105: r=a or g
  misc_feature 451: r=a or g
aagtttgaaactgtcaggttgccgtctaggtagcggttgtgcttgctgaggctgcacttgctgacactgcagctgcgacgcggctaagaggcgcagagcgaggartcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatattgtcaagtcattcaaagacagrtgagt

SEQ ID NO: 4074 - DNA, 431 bp, Homo sapiens
  CDS 57..419
atcagctgatttcactttcgtttcctaacttgccagtggcccatgacttttcagaaatgaggctggagtgcaatggcaccatcttggctcactgcaacctccacctcccgggttcaagtgattctcctgcctcagcctcccgagtagctgggattacagagcaactaagaggtctttcttggctctatgagaacctggtgggattcctgaagataaagtccacaaaaatgaagctccagacaagactatggccaccaggagtttctcactttcaagctagtgcgcactcagcctctggcaatttgttaaaatcactgtttaagtgttcctaccagtttatgattctagcagcttctgcctcagacaagcagatctcagcagtgactccctggattcgtctgtctcttcagatttcagggtagtagtttact

SEQ ID NO: 4075 - DNA, 413 bp, Homo sapiens
  CDS 13..318
  misc_feature 402: v=a or c or g
  misc_feature 403: v=a or c or g
ccctgtgtctacatgtgtgtacgtctgtgtgtgggcgggtgtgtgtttttctgtacacctggggggagaggtatctgtaaagtcagttctcttctctcctgtagggtggatatgcagcctacagatatgcacagcctgctactgcaaccgcagccaccgctgctgcagccgctgcagccgcttacagtgacggttatggcagggtgtacacagccgacccctaccatgcccttgcccctgccgctagctatggagttggcgctgtggcgagtttataccgaggtggctacagccgatttgccccctactgaagtgacgtgagacccctgcaaatgggacagccccccagttcatgaggcctggctattgcaatatttactagtagaggactctatagcaagvvtgaagaggta

SEQ ID NO: 4076 - DNA, 435 bp, Homo sapiens
  CDS 12..416
tttaagaaggaatgctgtcaaagtattcaagaccagatgagataaaaacagcaaaaaaaatcttgcctttgggtggatcgcttgagcttaggagttcgagaccagcctgggcaacatggcgaaaccccatctctacaaagaatacaaaacttagtggggcgtggtggtgtgagccggtagtcccagctgctggagaggctggggtgggaggatcgcttgagcccagggagtcgaggctgcagttagccgtgttcacgccactacattccagcctgggccacagaggaagaccctgtccccccaaaaaaaagaaaaaggaaaaaaaagtctggccttttaaaaagccagacttctgtttgtttccaatctattcaatctctgtcccccaaatcttttggcatagaatttgtctagcttagactaaaccttccatct

SEQ ID NO: 4077 - DNA, 348 bp, Homo sapiens
  CDS 11..340
  misc_feature 301: b=c or g or t
tagagggattatgacaacaggctctggccaggaaccagggcagtcagggacctctctgaggacaggtcccatggggtctctgggacaggcagagcaagtcagctcgatgcccatggggtctctggaacatgaggggctggtaagcctgaggcctgtggggttgcaggaacaggaggggcccatgagcctggggcctgtggggtctgcaggcccagtggagacctctaaggggttgctggggcaggagggcctggtggaaattgccatggactcaccagagcaagaggggctggtgggtccbatggagatcaccatggggtctctggagaaggcagggctgtgagccca

SEQ ID NO: 4078 - DNA, 375 bp, Homo sapiens
  CDS 4..357
  misc_feature 38: b=c or g or t
  misc_feature 40: k=g or t
  misc_feature 253: s=g or c
  misc_feature 342: s=g or c
  UNSURE 12: Xaa=Ile or Ser or Thr
  UNSURE 13: Xaa=Phe or Val
  UNSURE 84: Xaa=Glu or Gln
  UNSURE 113: Xaa=Asp or Glu
aagatggcgtgcttgttggagaccccaatccgcatgabcktcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtsagtggtgttgggaagtcttgctatgggtactgaaaacaatgtcaagtctctactggactgccatattatccctgccttattgcaaggastactgtccccagacctgaagtttattgaagctt

SEQ ID NO: 4079 - DNA, 435 bp, Homo sapiens
  CDS 31..378
  misc_feature 8: m=a or c
  misc_feature 9: n=a, g, c or t
  misc_feature 10: n=a, g, c or t
  misc_feature 140: m=a or c
  misc_feature 414: n=a, g, c or t
  misc_feature 415: n=a, g, c or t
  UNSURE 37: Xaa=Ala or Asp
cagaggtmnnggatccagaaactagagttcatgttggataagctacagaatgaaattgatcaggagttggaacacaataattcccttgttagagaagaaaaagagacaactgatacaaggaaaaaatcacttctttctgmtgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacanngtaaagttgcatctaaagta

SEQ ID NO: 4080 - DNA, 407 bp, Homo sapiens
  CDS 37..399
  misc_feature 321: h=a or c or t
  misc_feature 322: k=g or t
  misc_feature 374: k=g or t
  UNSURE 96: Xaa=Cys or Gly
  UNSURE 113: Xaa=Gly or Val
atttgagttgcttctaacttttgcctattataagtaatgcttacacattatgcttatgagtattcatccacaagtttgtgtgacatatgttttcaattatttggggaatatatttatgagttaccaattaatggatcaaatgataactctctgattgtcaaactgtctcccaaagtgcttgtaacatttataaacacatcagtaatatgtacaagtgttccactttctccacctccttgtcaacacttattgttgtctattttttttttaattttagccatcttagtggttatgatacagtatttcatggtggatctgachkgcacttccctaatgtctaatgaagctgaacatcttttcatgtgcttattggkcattagtgtatctttttcaaagaaatagccacc

SEQ ID NO: 4081 - DNA, 454 bp, Homo sapiens
  CDS 11..409
  misc_feature 15: y=c or t
  misc_feature 146: r=a or g
  misc_feature 333: n=a, g, c or t
  misc_feature 334: r=a or g
  misc_feature 335: k=g or t
  misc_feature 363: h=a or c or t
  misc_feature 454: m=a or c
  UNSURE 2: Xaa=Ala or Val
  UNSURE 46: Xaa=Glu or Lys
  UNSURE 108: Xaa=Ile or Lys or Met or Arg or Thr
  UNSURE 109: Xaa=Phe or Val
  UNSURE 118: Xaa=His or Leu or Pro
acgcggagcaatggygacctttgtgagcgagctggaggcggccaagaagaacttaagcgaggccctgggggacaacgtgaaacaatactgggctaacctaaagctgtggttcaagcagaagatcagcaaagaggagtttgaccttraagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcaganrkttgatcatagattccagcctcaaaatchtctctcaggagcccagcaatttgtggcaaaggatccccaagatgaatgacgacttgaaactttgttcccacacaatgatgcttcccactcm

SEQ ID NO: 4082 - DNA, 356 bp, Homo sapiens
  CDS 11..343
taataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcagatggagtctcgctctgtcgcccaggctggagtgcagtggcgcgatctcggctcactgcaagctccgcctcccgggttcacgccattctcctgcctcagcctcctgagtagctgggactacaggtgcccgccaccatgcctggctaattttttgtatttttgatagagacagc

SEQ ID NO: 4083 - DNA, 362 bp, Homo sapiens
  CDS 30..347
cttgtggctttgtctcccgcgaagaggagatggcggagtcgttgaggtctccgcgccgctccctgtacaaactggtgggctcgccgccttggaaagaggctttccggcagagatgcctggagagaatgagaaacagccgggacaggctcctaaacaggtaccgccaggctggaagcagtgggccagggaattctcagaacagctttctagttcaagaggtgatggaagaagagtggaatgctttgcagtcagtggagaattgtccagaagacttggctcagctggaggagctgatagacatggctgtgctggaggaaattcaacaggagctgatcaaccaaggcctgtgatacttgggccaa

SEQ ID NO: 4084 - DNA, 415 bp, Homo sapiens
  CDS 54..404
  misc_feature 415: v=a or c or g
tcggtagtaagctactagctgcttcctcaaaagagaatagttgtctgcagagaatggcatacctttgctccaaaatcctgaagatctacactgtggttcataaggggcccaccagaggctccatactggatttctatctgccacagacagttacttcaagcaccagtgagtcttcggggttcaagtggctaagcagcttgcatgacagcctaggcctgttgcagacctctgatgttctggcgtccattcaaaactggcaggctttcagattagctgtaatggtaatgcagtatatattactttcactactgacatacatggtaccctttcttaagggtagaagggcccagatgcagcaatttctttttgtcctaagagaactatctcagcatgtcccagaccactaggctccggv

SEQ ID NO: 4085 - DNA, 457 bp, Homo sapiens
  CDS 110..448
ggtgaaagaagtttgctgacgaagatggcgactgaggcacagagtgaaggggaggtgccagcccgcgaatccggccggagtgatgccatctgcagttttgtgatctgcaatgattcttccctttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacaaaaacttgcgagtagagggtttgtttagagtacc

SEQ ID NO: 4086 - DNA, 461 bp, Homo sapiens
  CDS 51..446
  misc_feature 135: n=a, g, c or t
  misc_feature 136: v=a or c or g
  UNSURE 29: Xaa= *  or Ala or Glu or Gly or Lys or Pro or Gln or Arg or Ser or Thr
ttataccccttttatataatttggttttatttgcaggtcctaatctacccatggctacagttgatataaaaaatccagaaatcacaacaaatagattttatggtccacaagtcaacaacatctcccataccaagnvaaagaagaagggaaaagctaaaaagaagagattaaccaaggcagatataggaacaccaagcaatttccagcacattggacatgttggttgggatccaaatacaggctttgatctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaaggtaacttttatctctattcagcgttctgttttgttttaatcttttgaggtcagtttcat

SEQ ID NO: 4087 - DNA, 482 bp, Homo sapiens
  CDS 53..364
  misc_feature 127: m=a or c
  misc_feature 136: s=g or c
  misc_feature 139: y=c or t
  misc_feature 140: k=g or t
  misc_feature 149: w=a or t
  misc_feature 270: d=a or g or t
  UNSURE 25: Xaa=Asp or Glu
  UNSURE 30: Xaa=Gly or Trp
  UNSURE 33: Xaa=Cys or Ser
  UNSURE 73: Xaa=Cys or Phe or Tyr
ctgggcccttttgtctccccaggtgctgattctcctgtacatcgcagactggatggtgcactggatgtggggccggggcctggacccggacaacttctccatcccatacttgactgctctgggggamctgcttggsacykgggctcctwgcactcagcttccatgttctctggctcataggggaccgagacacggatgtcggggactagcttggtcactcaacattttccccatccctctgcactttctatttgaaatttttcttttgtdcccctgtccctcctccaccccacactcccacctctttctaggacttcactttgataccaaattctcattattttcaatgggaatttttatacattgagccaagtttgtatagcaagaatttgggaaacacagatggcctgagataagcagtacaagtaggtttttgagacaatcaccaagtgcagtttcatggtgggtgcctcaggtgatgt

SEQ ID NO: 4088 - DNA, 412 bp, Homo sapiens
  CDS 36..350
  misc_feature 142: b=c or g or t
  misc_feature 144: d=a or g or t
  misc_feature 146: h=a or c or t
  misc_feature 347: r=a or g
  misc_feature 368: m=a or c
  misc_feature 369: n=a, g, c or t
  UNSURE 36: Xaa=Met or Arg or Thr
  UNSURE 37: Xaa= *  or Cys or Gly or Arg or Ser
ggggcttctcggcccgaggcagaggaacagggaagatggcggctgtggtggagaatgtagtgaagctccttggggagcagtactacaaagatgccatggagcagtgccacaattacaatgctcgcctctgtgctgagcgcabgdghcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagacagrccctgaagaaggaggggctgmnctctcaggatggcagtagtttagaggctctgttgcgcactgac

SEQ ID NO: 4089 - DNA, 439 bp, Homo sapiens
  CDS 28..366
  misc_feature 122: s=g or c
  misc_feature 127: s=g or c
  misc_feature 230: n=a, g, c or t
  misc_feature 297: y=c or t
  misc_feature 298: n=a, g, c or t
  misc_feature 302: r=a or g
  misc_feature 309: r=a or g
  misc_feature 383: v=a or c or g
  misc_feature 414: w=a or t
  UNSURE 32: Xaa=Ala or Gly
  UNSURE 34: Xaa=Asp or His
  UNSURE 68: Xaa=Leu or Pro or Gln or Arg
  UNSURE 91: Xaa= *  or Glu or Lys or Gln
  UNSURE 92: Xaa=Lys or Arg
tagtaagcgtgtaccactcttccatagatgggtatattggttgttctaatttttaactacattaataaagtcaatatattaacaatgcaatggcgaatttccttgcacatgcccctttatgscccasatgtgattatttctttagtacagactcctagaagtagaattccttggtcaaggaatattctcaatttaaatagtgatagatatcaacattgtcttccaaagcnactttaccactgtacactcctatcagcaatgaagagtacttcctgtaccaatcacagagttaggtaynagaracagaaraatgcagaaggcattgttcctgcctttggagtgcttaataatgatgagacagacatgtaaacagatatctttavtatagtatggtagattctatgatagggtgcwaaagagaaacatcatatctctttgt

SEQ ID NO: 4090 - DNA, 434 bp, Homo sapiens
  CDS 102..407
  misc_feature 25: s=g or c
  misc_feature 131: s=g or c
  misc_feature 134: s=g or c
  misc_feature 136: v=a or c or g
  misc_feature 142: m=a or c
  misc_feature 353: w=a or t
  misc_feature 354: n=a, g, c or t
  misc_feature 355: n=a, g, c or t
  misc_feature 412: m=a or c
  UNSURE 10: Xaa=Lys or Asn
  UNSURE 12: Xaa=Ala or Glu or Gly
  UNSURE 14: Xaa=Ala or Asp
  UNSURE 85: Xaa= *  or Ala or Glu or Gly or Lys or Leu or Met or Pro or Gln or Arg or Ser or Thr or Val or Trp
agactcgaagagctccgggaaggasgagggagcagcccagccccggctgagggcagtcaggtgtgacgcccacgcgggaggtagcaagagatgagggcgccatgttttggaagtttgacctgcacacaaastcsgvactggmcacgctgctggagcgggaggacctgagcctgcccgagctgctggacgaggaagacgtgctgcaggagtgcaaggtcgtcaaccgcaagctgctggacttcctgctgcagccaccccacctgcaagcaatggtggcctgggtcacccaggagccgccagatagcggtgaggagcggctgcgctacaagtaccccagtgtggcctgcgagatwnngacctcagatgtgccccagatcaatgatgccctgggtgctgatgagtccttctgaamcggctctacggcttcctgcaga

SEQ ID NO: 4091 - DNA, 471 bp, Homo sapiens
  CDS 38..454
  misc_feature 235: v=a or c or g
  misc_feature 417: v=a or c or g
  UNSURE 127: Xaa=Asn or Ser or Thr
agacgaaggaaacaccccgcagcctgcacatgctcagatggagctctgggcccgcgggttctactgcgcaggccctcacactcagcagggacttggacgcgaaagccctggtggcgctcagccggttgggagttgtagctttctggctgctacagcaggagatacaggtggccaatgggtgagctggctggaggtaggaacaaggttaaggaagctgggatcttcgtgcagactvgatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcgggagatcgacttavtaactgtgaacacgtgtcactggaaaaagcagtatgttaataagtaactgggct

SEQ ID NO: 4092 - DNA, 454 bp, Homo sapiens
  CDS 18..419
  misc_feature 137: n=a, g, c or t
  misc_feature 180: n=a, g, c or t
  misc_feature 304: k=g or t
  misc_feature 305: s=g or c
  UNSURE 55: Xaa=Ala or Pro or Ser or Thr
  UNSURE 96: Xaa=Ile or Met or Arg or Ser
actattgggcctggcccatggcggaaatgagagcttggcgcccattggtccgaccttccctgcaatgcgtcaaactggggcgagccactgcaaggtggtggtgggtggtcaaggtgaagccccacgacaaggatgcnaaaatgaaataccaggagtgcaacaagatcgtgaagcagaagncctttgagcgggccatcgcgggcgacgagcacaagcgctccgtggtggactcgctggacatcgagagcatgaccatcgagggtgagtacagcggacccaagcttgaggacgacaaagtgacaaksaccttcatgaaggggctcatgcagtggtacaaggaccagaagaaactgcaccagaaaatgcgcctaccaggttctggccccctggtggaagtcgggcaggcaccctcccggggctgacactggggagcaacatgaagtcaaattttcat

SEQ ID NO: 4093 - DNA, 433 bp, Homo sapiens
  CDS 100..411
  misc_feature 422: r=a or g
gaggtaatttccaggtcctggaacacagaagggattggcctccctgaaacctcccagctcaatgaccagatctccaggcacaggaacggggggcaggggatggtgaatgacggggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccagatggcttctgggaggccctgggcgggaaggctgcctaccgcacatccccacggctgaaggacaagaagatggatgccatcctcctcgcctctttgcctgctccaacaagattggacgttttgtgatcgaagargttcctggtga

SEQ ID NO: 4094 - DNA, 386 bp, Homo sapiens
  CDS 36..338
  misc_feature 107: m=a or c
  misc_feature 112: r=a or g
  misc_feature 114: m=a or c
  misc_feature 296: k=g or t
  misc_feature 297: d=a or g or t
  misc_feature 298: r=a or g
  UNSURE 24: Xaa=Asp or Glu
  UNSURE 26: Xaa= *  or Trp
  UNSURE 87: Xaa=His or Gln
  UNSURE 88: Xaa= *  or Glu or Gly or Lys or Arg
agtctcctcagactgtatcaagcaaatctatagacatgtctgtggaaaagatgacaaaagtagaagagagttttcaaaaggccatgggacttaagaagacggttgamaggtrgmgaaattcacatactcactgtctgtggcaaatggcattgggccagagaagaaacccgtatgccaccctaaggatgcaggacaccatggtacagaaattggcactggccaaaaagcaactactaatggtccgtcaagctgccctgcaccagctgtttgaaaaggagcatcagcagtaccagcakdractaaatcagatgggcaaagctttttatgtagagagattctgatggcatccaaaacactgctcttccattctcaacatgcctgctaag

SEQ ID NO: 4095 - DNA, 345 bp, Homo sapiens
  CDS 13..333
caggacataggcatgggcaaggacttcatgtctaaaacaccaaaagcaatggcaacaaaagccaaaattgacaaatgggatctaattaaactaaagagctgctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaaacaaccccatcaaaaagtgggcgaaggacatgaacagacacttctcaaaagaagacatttatgcagccaaaaaacacatgaaaaaatgctcatcatgaccggccatc

SEQ ID NO: 4096 - DNA, 374 bp, Homo sapiens
  CDS 40..345
  misc_feature 126: h=a or c or t
  misc_feature 127: h=a or c or t
  misc_feature 128: h=a or c or t
  misc_feature 322: w=a or t
  misc_feature 326: m=a or c
  misc_feature 351: v=a or c or g
  UNSURE 29: Xaa=Asp or Glu
  UNSURE 30: Xaa=Phe or His or Ile or Leu or Asn or Pro or Ser or Thr or Tyr
  UNSURE 95: Xaa= *  or Lys
  UNSURE 96: Xaa=Lys or Thr
caacacctctatgcaaataaactagaaaatctagaagaaatggataaattcctggagacgtacaccctcccaagactaaaccaggaagaagttgaatctctgcatagaccaataacaagttctgahhhtgaggcagtaattaatagcctagcaaccaaaaaaagtccaggaccagacgaattctaccagaggtacaaagaggaattggtaccattccttctgaaactattgcaaacaatacaaaaagagggactccttcctaactcattttgtgaggccagcgtcatcctgatgccaagacctggcagagacacaacaaaawagamaattccaggccaatatccctgatgvacatcgatgccaaaatcctcaat

SEQ ID NO: 4097 - DNA, 458 bp, Homo sapiens
  CDS 100..429
gcaaccagcactgaccaattggaggcattaagggacattctgcgtgacatcacacccaatgtgctttcttttgcacttgattttgacgaagccacaaaaatgattgcgaatgatgtccatacactcaggagatctaaaaccactgttggacgccctttgattgcttggcgatatgtacctataaatgttgttgagacactgagaacacgtggggcccccacccggatagtgagaaaagtagcccggaacctgggcaaggccacttcaggtgtccttgttgtgctggatgtagtcaaccttgtgcaagactcactggacttgcacaagggggcaaaatccgagtctgctgagtcgctgaggcagtgggctcaggagctggaggagaatctcaatgagctcacccatatccatcagagtctaaaagcaggctaggcccaattgttgcgggaagtcaggga

SEQ ID NO: 4098 - DNA, 431 bp, Homo sapiens
  CDS 96..410
  misc_feature 406: w=a or t
  UNSURE 104: Xaa=Glu or Val
caaaatcgtggtttatttctgtaacgtgaagacttctgctcttttttctttgtttgtttttttcgtaaacatctgggtgtatatcaaacggcaagatgtccagtaatgtcccggcggatatgataaatttgcgcctcattttggtaagcggaaaaacaaaagagttcctgttttctcctaacgattctgcttctgacattgcaaagcatgtatatgacaattggccaatggactgggaagaagagcaggtcagcagtccaaatattctacgacttatttatcaaggacgatttctacatggaaatgtcacattaggagcattaaaacttccttttggcaaaacaacagtgatgcatttggtggccagagagacattaccagagccaaactctcaaaggtcagaggwatcgtgagaagactggagagagtaa

SEQ ID NO: 4099 - DNA, 455 bp, Homo sapiens
  CDS 19..435
  misc_feature 124: s=g or c
  misc_feature 435: s=g or c
  UNSURE 36: Xaa=Glu or Gln
  UNSURE 139: Xaa=Lys or Asn
gctattgcagatcactacatgcaggtgcttgtttgtcagcatgaatgtgtgagggaacttgccacccgccctggccgcctctctcccatcgagaattttcttcctctgcactatgattacctasagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaastagagggagcagaagttcat

SEQ ID NO: 4100 - DNA, 450 bp, Homo sapiens
  CDS 36..401
  misc_feature 364: h=a or c or t
  misc_feature 365: n=a, g, c or t
  UNSURE 110: Xaa=Ile or Lys or Met or Asn or Thr
gcggcgccggcttgctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggcaccctggtctccctggagcccagcagcgtggccagtgacgtcagcaagcctgtgctcaccacaaaagtccttctggggcaggatgagcctctcatccatgtctttgcaaagaacctggtagcgtttgtgtctcaagaagctggaaacagagcagtcctcctcgccgtggccgtgaaggacaaaagcatggaggggctgahngcgctgagggaggtgatccgggtgtgccaggtgtggtgactggaggcagccgccccgcgctgctcagcaggacacgtgaacacca

SEQ ID NO: 4101 - protein, 94 aa, Homo sapiens
  SIGNAL -20..-1: score 5 seq LQRFAVLSRGVHS/SV
  UNSURE 36: Xaa=His or Arg
MFSKLAHLQRFAVLSRGVHSSVASATSVATKKTVQGPPTSDDIFEREYKYGAHNYXPLPVALERGKGIYLWDVEGRKYFDFLSSYSAVNQGHCH

SEQ ID NO: 4102 - protein, 71 aa, Homo sapiens
  SIGNAL -20..-1: score 3.5 seq WQLVLNVWGKVEA/DI
MGLSDGEWQLVLNVWGKVEADIPGHGQEVLIRLFKGHPETLEKFDKFKHLKSEDEMKASEDLKKHGATVLT

SEQ ID NO: 4103 - protein, 113 aa, Homo sapiens
  SIGNAL -20..-1: score 3.5 seq WQLVLNVWGKVEA/DI
  UNSURE 84: Xaa=Phe or Ile or Leu or Met or Val
  UNSURE 85: Xaa=Pro or Thr
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKXXGVHLGMHH

SEQ ID NO: 4104 - protein, 108 aa, Homo sapiens
  SIGNAL -34..-1: score 3.8 seq TLFVFISXGSALG/FK
  UNSURE -6: Xaa=Ile or Asn or Ser or Thr
  UNSURE 7: Xaa=His or Asn
  UNSURE 60: Xaa=any one of the twenty amino acids
MASEFKKKLFWRAVVAEFLATTLFVFISXGSALGFKYPVGXNQTAVQDNVKVSLAFGLSIATLAQSVGHISGAHLNPAVTLGLLLSCQISIFRXSCTSSPSAWGPSSP

SEQ ID NO: 4105 - protein, 116 aa, Homo sapiens
  SIGNAL -44..-1: score 5.5 seq ILFFTGWWIMIDA/AV
  UNSURE 54: Xaa=Leu or Trp
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVXLFIGFMLMFGSLIASMWI

SEQ ID NO: 4106 - protein, 100 aa, Homo sapiens
  SIGNAL -19..-1: score 6.2 seq WXFLVAIIKGVQC/XX
  UNSURE -14: Xaa=Ser or Thr
  UNSURE -12: Xaa=Leu or Val
  UNSURE 1: Xaa=His or Gln
  UNSURE 2: Xaa=Ala or Val
  UNSURE 3: Xaa=His or Gln
  UNSURE 10: Xaa=Gly or Ser
  UNSURE 14: Xaa=Pro or Ser
  UNSURE 32: Xaa=Phe or Tyr
  UNSURE 35: Xaa=Asn or Ser
  UNSURE 56: Xaa= *  or Tyr
  UNSURE 64: Xaa=Asp or Glu
  UNSURE 65: Xaa=Glu or Lys
  UNSURE 68: Xaa=Phe or Ile
  UNSURE 69: Xaa=Asn or Thr
MEFGLXWXFLVAIIKGVQCXXXLVESGGXLVKXGGSLRLSCAASGFTFSDXYMXWIRQAPGKGLEWVSYISSGGXYTNYADSXXGRXXISRDNAKNSLYL

SEQ ID NO: 4107 - protein, 126 aa, Homo sapiens
  SIGNAL -19..-1: score 11.7 seq VFCLLAVAPGAHS/QV
  UNSURE 32: Xaa=His or Tyr
  UNSURE 45: Xaa=Phe or Leu
  UNSURE 55: Xaa=Asp or Gly
  UNSURE 59: Xaa=Lys or Asn
  UNSURE 82: Xaa=Glu or Gln
  UNSURE 87: Xaa=Arg or Thr
  UNSURE 89: Xaa=Asp or Glu
  UNSURE 95: Xaa=His or Tyr
  UNSURE 99: Xaa=Asp or Glu
MDWTWRVFCLLAVAPGAHSQVQLVQSGAEVKKPGASVKVSCKASGYTFTSXYMHWVRQAPGQGXEWMGIINPSXGSTXYAQKFQGRVTMTRDTSTSTVYMXLSSLXSXDTAVYXCARXAYSSYRFD

SEQ ID NO: 4108 - protein, 127 aa, Homo sapiens
  SIGNAL -19..-1: score 11 seq TLLLLTVPSWVLS/QV
  UNSURE 30: Xaa=Ser or Thr
  UNSURE 35: Xaa=Cys or Ser
  UNSURE 42: Xaa=Ala or Pro
  UNSURE 46: Xaa=Ala or Gly
  UNSURE 52: Xaa=Phe or Leu
  UNSURE 56: Xaa=Glu or Gln
  UNSURE 60: Xaa= *  or Lys or Asn or Tyr
MDILCSTLLLLTVPSWVLSQVTLRESGPALVKPTQTLTLTCTFSGFSLXTSGMXVSWIRQXPGKXLEWLAXIDWXDDKXYSTSLKNRLTISKDTSKNQVVLTLSKMDPVDTATYYCARSRLVPHDHW

SEQ ID NO: 4109 - protein, 88 aa, Homo sapiens
  SIGNAL -19..-1: score 11 seq TLLLLTVPSWVLS/QV
  UNSURE 5: Xaa=Lys or Arg
MDILCSTLLLLTVPSWVLSQVTLXESGPALVKPTETLTLTCTLSGFSLNVSGMRMIWVRQFPGQALEWLARIDWDDEKYFTSSLRTRL

SEQ ID NO: 4110 - protein, 110 aa, Homo sapiens
  SIGNAL -19..-1: score 10.6 seq ILFLVAAXTGAXS/QV
  UNSURE -6: Xaa=Ala or Pro or Ser or Thr
  UNSURE -2: Xaa=His or Leu
  UNSURE 3: Xaa=His or Gln
  UNSURE 5: Xaa=Glu or Val
  UNSURE 9: Xaa=Gly or Ser
  UNSURE 13: Xaa=Lys or Thr
  UNSURE 28: Xaa=Ile or Thr
  UNSURE 30: Xaa=Asn or Thr
  UNSURE 33: Xaa=Asp or Gly
MDWTWSILFLVAAXTGAXSQVXLXQSGXEVKXPGASVKVSCKASGYXFXRYXINWVRQAPGQGLEWMGWISPYNGNTNYAQQFQDRVTLTTDTSTSTAFLELRSLKSDDT

SEQ ID NO: 4111 - protein, 120 aa, Homo sapiens
  SIGNAL -19..-1: score 10.7 seq ILFLVAAATGXHS/QV
  UNSURE -3: Xaa=Ala or Val
  UNSURE 9: Xaa=Ala or Pro
  UNSURE 53: Xaa=Ala or Gly
  UNSURE 63: Xaa=Glu or Lys
  UNSURE 64: Xaa=Phe or Leu
  UNSURE 72: Xaa=Arg or Thr
  UNSURE 82: Xaa=Asp or Glu
  UNSURE 85: Xaa=Asn or Ser
  UNSURE 98: Xaa=Lys or Arg
MDWTWSILFLVAAATGXHSQVQLVQSGXEVKKPGASVKVSCKASGYTFTSYGISWVRQAPGQGLEWMGWISXYNGNTNYAQXXQGRVTMTXDTSTNTAYMXLRXLRSDDTAVYYCAXRGL

SEQ ID NO: 4112 - protein, 132 aa, Homo sapiens
  SIGNAL -19..-1: score 10.8 seq ILFLVAAATGAHS/QV
  UNSURE 9: Xaa=Ala or Pro
  UNSURE 31: Xaa=Asn or Ser
  UNSURE 33: Xaa=Asp or Gly
  UNSURE 35: Xaa=Asn or Ser
  UNSURE 63: Xaa=Asp or Glu or Lys or Asn
  UNSURE 72: Xaa=Arg or Thr
  UNSURE 77: Xaa=Lys or Asn or Arg or Ser
  UNSURE 93: Xaa=Ile or Met or Val
  UNSURE 101: Xaa=Ile or Leu or Val
  UNSURE 103: Xaa=Ala or Glu or Gly or Val
  UNSURE 104: Xaa=Leu or Val
MDWTWSILFLVAAATGAHSQVQLVQSGXEVKKPGASVKVSCKASGYTFTXYXIXWVRQAPGQGLEWMGWISAYNGNTNYAQXLQGRVTMTXDTSTXTAYMELRSLRSDDTAXYYCAREIXVXXCDGQLGPGN

SEQ ID NO: 4113 - protein, 105 aa, Homo sapiens
  SIGNAL -19..-1: score 9.5 seq ILXLVAAXTGAHS/QG
  UNSURE -14: Xaa=Ser or Thr
  UNSURE -11: Xaa=Phe or Ile or Leu
  UNSURE -6: Xaa=Ala or Thr
  UNSURE 4: Xaa= *  or Leu or Gln
  UNSURE 24: Xaa=Ala or Asp
  UNSURE 36: Xaa=Arg or Trp
  UNSURE 73: Xaa=Arg or Ser
  UNSURE 77: Xaa=Ala or Glu or Gly or Val
  UNSURE 84: Xaa=Ala or Glu or Gly or Val
MDWTWXILXLVAAXTGAHSQGQXVQSGAEVKKPGASVKVSCKXSGYTFTYFGVSXFRQAPGQGLEWMAWISGHNGDTNYATEDPGQSHPDHXHIHXHSLHGAXEP

SEQ ID NO: 4114 - protein, 108 aa, Homo sapiens
  SIGNAL -19..-1: score 9.2 seq ILFLVAAATGAHS/QL
  UNSURE 77: Xaa=Ile or Thr
MDWTWSILFLVAAATGAHSQLQLVQSGAEVKKPGASMKVSCQASDYTFLNFGITWVRQAPGQGLEWMGWISFHSGNTNYAENFQGRGAISADTSTXTAYIEVRSLRSD

SEQ ID NO: 4115 - protein, 121 aa, Homo sapiens
  SIGNAL -19..-1: score 10.8 seq ILFLVAAATGAHS/QV
  UNSURE 9: Xaa=Ala or Gly or Ser or Thr
  UNSURE 24: Xaa=Ala or Thr
  UNSURE 33: Xaa=Ala or Asp or Gly or Val
  UNSURE 53: Xaa=Ala or Gly or Ser or Thr
  UNSURE 55: Xaa=Lys or Asn
  UNSURE 57: Xaa=Lys or Asn
  UNSURE 68: Xaa=Leu or Val
  UNSURE 70: Xaa=Leu or Met
  UNSURE 82: Xaa=Asp or Glu
MDWTWSILFLVAAATGAHSQVQLVQSGXEVKKPGASVKVSCKXSGYTFTSYXISWVRQAPGQGLEWMGWISXYXGXTDYAQKFQGRXTXTTDTSTNIAYMXLRNLRSDDTAFYYCVRGHLG

SEQ ID NO: 4116 - protein, 140 aa, Homo sapiens
  SIGNAL -19..-1: score 10.8 seq ILFLVAAATGAHS/QV
  UNSURE 28: Xaa=Ile or Thr
  UNSURE 31: Xaa=Asn or Ser
  UNSURE 32: Xaa=Ser or Tyr
  UNSURE 34: Xaa=Ile or Met
  UNSURE 55: Xaa=Asn or Thr
  UNSURE 57: Xaa= *  or Lys or Asn or Tyr
  UNSURE 59: Xaa=Ile or Lys
  UNSURE 63: Xaa=Lys or Asn
  UNSURE 66: Xaa=Asp or Gly
  UNSURE 70: Xaa=Phe or Ile
MDWTWRILFLVAAATGAHSQVQLVQSGAEVKKPGASVKVSCKASGYXFTXXAXHWVRQAPGQRLEWMGWINAAXGXTXYSQXFQXRVTXTRDTSASTVSMELSSLRSEDTAVYFCARDWEIAVVPTAINSYGFDPGAREP

SEQ ID NO: 4117 - protein, 115 aa, Homo sapiens
  SIGNAL -19..-1: score 13.3 seq LALLLAVLQGVCA/EV
MGSTAILALLLAVLQGVCAEVQLVQSGAEVKKPGESLKISCKGVGYNFAGWWIGWVRQMPGEGLELMGLVYPLDSNTAYSPSFKDHVTISADRSLSTAYLQWISLKPRTPPYITV

SEQ ID NO: 4118 - protein, 81 aa, Homo sapiens
  SIGNAL -19..-1: score 13.3 seq LALLLAVLQGVCA/EV
  UNSURE -16: Xaa=Ala or Thr
MGSXAILALLLAVLQGVCAEVHLVQSGAELKKPGESLTISCKGSGYEFGTHWIGWVRQMPGKGLEWMGIIYPDDSDTRYNP

SEQ ID NO: 4119 - protein, 95 aa, Homo sapiens
  SIGNAL -19..-1: score 12.7 seq LALLLAVLQGVCG/EE
  UNSURE 60: Xaa= *  or Tyr
MGSTAILALLLAVLQGVCGEEQLVQSGAEVKKPGESLRISCTGSGYSFTSHWIGWVRQMPGTGLEWTAIIYPDDSDTKXSPSFQGQVTISADKST

SEQ ID NO: 4120 - protein, 96 aa, Homo sapiens
  SIGNAL -19..-1: score 13.3 seq LALLLAVLQGVCA/EV
  UNSURE -16: Xaa=Ala or Thr
  UNSURE 64: Xaa= *  or Gly or Arg
MGSXAILALLLAVLQGVCAEVQLVQSGAEVKKPGESLKISCKASGLSLIDWVGWVRQKPGKGLEWMGIIYIGDSDTRYSPSFXRPGHHLSRQVHQH

SEQ ID NO: 4121 - protein, 80 aa, Homo sapiens
  SIGNAL -19..-1: score 13.3 seq LALLLXVLQGVCA/EV
  UNSURE -8: Xaa=Ala or Thr
MGSAAILALLLXVLQGVCAEVQLVQSGPEVKKPGESLKISCEVSGYTFNFYWLAWVRQRPGKGLEWMGAIRPGYFGSAYS

SEQ ID NO: 4122 - protein, 127 aa, Homo sapiens
  SIGNAL -19..-1: score 9.7 seq ILFLVAAATSAHS/QV
MDWTWRILFLVAAATSAHSQVQLVQSGTEVRGPGASVKVSCKASGYTFVSYDINWVRQAAGQGLEWMGWMNPFSGDSGFAQNFQGRVTLTRNSSIGTAYMELTSLRSDDTAVYYCARGRGYTHYYFF

SEQ ID NO: 4123 - protein, 103 aa, Homo sapiens
  SIGNAL -19..-1: score 10.6 seq TLLLLTXPSWVLS/QX
  UNSURE -14: Xaa=Ser or Tyr
  UNSURE -7: Xaa=Ala or Ile or Thr or Val
  UNSURE 2: Xaa=Ile or Val
  UNSURE 7: Xaa=Ser or Thr
  UNSURE 10: Xaa=Ala or Val
  UNSURE 13: Xaa=Glu or Lys
MDTLCXTLLLLTXPSWVLSQXTLKEXGPXLVXPTQTLTLTCTFSGFSLRTSGEGVGWIRQPPGKALEWLALIYWDDDKRYRPSLKTRLTITKDTSKNQVVLTM

SEQ ID NO: 4124 - protein, 86 aa, Homo sapiens
  SIGNAL -19..-1: score 10.7 seq TLLLLTTPSWVLS/QV
MDTLCYTLLLLTTPSWVLSQVTLKESGPVLVKPTETLTLTCTVSGFSLNNAGMGVSWVRQPPGKALEWLAHEYPHDQRSYNTSLSG

SEQ ID NO: 4125 - protein, 99 aa, Homo sapiens
  SIGNAL -19..-1: score 10.8 seq ILFLVAAATGAHS/QV
  UNSURE 3: Xaa=Gln or Arg
  UNSURE 5: Xaa=Leu or Val
  UNSURE 13: Xaa=Lys or Arg
  UNSURE 24: Xaa=Ala or Thr
  UNSURE 28: Xaa=Ala or Thr
  UNSURE 30: Xaa=Ser or Thr
  UNSURE 31: Xaa=Gly or Val
  UNSURE 37: Xaa=Leu or Val
  UNSURE 51: Xaa=Ile or Met
MDWTWRILFLVAAATGAHSQVXLXQSGAEVKXPGASVKVSCKXSGYXFXXYYIHWXRQAPGQGLEWMGRXNPKDGAPNYAPNFEGRVTMTRDTSITTAY

SEQ ID NO: 4126 - protein, 119 aa, Homo sapiens
  SIGNAL -19..-1: score 10.8 seq ILFLXAAATGAHS/QV
  UNSURE -9: Xaa=Ala or Val
  UNSURE 24: Xaa=Ala or Thr
  UNSURE 28: Xaa=Ala or Thr
  UNSURE 29: Xaa=Phe or Leu
  UNSURE 32: Xaa=His or Tyr
  UNSURE 33: Xaa=Phe or Tyr
  UNSURE 34: Xaa=Ile or Leu or Met
  UNSURE 50: Xaa=Arg or Trp
  UNSURE 64: Xaa=Phe or Tyr
  UNSURE 76: Xaa=Ile or Met
  UNSURE 80: Xaa= *  or Tyr
  UNSURE 88: Xaa=Ala or Ser
  UNSURE 89: Xaa=Asp or Glu
  UNSURE 99: Xaa=Asp or Glu
MDWTWRILFLXAAATGAHSQVRLVQSGAEVKKPGASVKVSCKXSGYXXTGXXXHWLRQAPGQGLEWMGXINPRTGGTKSAQKXRDFLTMTRDAPXNTAXMELTGLRXXETATYFCARXQ

SEQ ID NO: 4127 - protein, 99 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITADESTTTVYMQLSSLTSEDTAVYYCAREAREWQWLV

SEQ ID NO: 4128 - protein, 102 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITADESTTTVYMQLSSLTSEDTAVYYCARDSASVVMANGLG

SEQ ID NO: 4129 - protein, 143 aa, Homo sapiens
  SIGNAL -19..-1: score 9.9 seq FLFVVAAATGVQS/QV
  UNSURE 19: Xaa=Lys or Thr
  UNSURE 21: Xaa=Ala or Ser
  UNSURE 28: Xaa=Ser or Thr
  UNSURE 29: Xaa=Phe or Leu
  UNSURE 30: Xaa=Arg or Ser
  UNSURE 52: Xaa=Ile or Thr
  UNSURE 54: Xaa=Phe or Ile or Leu or Val
  UNSURE 55: Xaa=Phe or Leu
  UNSURE 58: Xaa=Ala or Ser
  UNSURE 60: Xaa=Asn or Tyr
  UNSURE 87: Xaa=Lys or Arg
  UNSURE 89: Xaa=Asp or Glu
  UNSURE 90: Xaa=Asp or Glu
  UNSURE 95: Xaa= *  or Tyr
  UNSURE 96: Xaa=Phe or Ile or Ser or Thr
  UNSURE 110: Xaa=Ile or Met
  UNSURE 112: Xaa=Asp or Val
MDWTWRFLFVVAAATGVQSQVQLVQSGAEVKKPGSSVXVXCKASGGXXXSYGISWVRQAPGQGLEWMGGIXPXXGTXNXAQKFQGRVTITADESTNTVYMELNSLXSXXTAVYXXASRVVAGGLVFYAXDXWGQGPRSPSPQL

SEQ ID NO: 4130 - protein, 121 aa, Homo sapiens
  SIGNAL -19..-1: score 9.9 seq FLFVVAAATGVQS/QV
  UNSURE 30: Xaa=Ile or Asn or Ser or Thr
  UNSURE 31: Xaa=Ser or Thr
  UNSURE 33: Xaa=Ala or Thr
  UNSURE 34: Xaa=Phe or Ile
  UNSURE 57: Xaa=Lys or Thr
MDWTWRFLFVVAAATGVQSQVQLVQSGAEVKKPGSSVKVSCKASGGTFXXYXXSWVRQAPGQGLEWMGGIIPIFGXTNYAQKFQGRVTMTADESTTTVYMELSRLTSEDTAVYYCARDINR

SEQ ID NO: 4131 - protein, 116 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
  UNSURE 60: Xaa=Lys or Arg
  UNSURE 62: Xaa=Asp or Glu
  UNSURE 63: Xaa=Asp or Glu
  UNSURE 68: Xaa= *  or Tyr
  UNSURE 69: Xaa=Phe or Ile or Ser or Thr
  UNSURE 83: Xaa=Ile or Met
  UNSURE 85: Xaa=Asp or Val
MDWTWRFLFVVAAATGVQSQXQLXQSGAEVKKPGSSVKVSCEASGYTFSNYAVSWFQGRVTITADESTNTVYMELNSLXSXXTAVYXXASRVVAGGLVFYAXDXWGQGPRSPSPQL

SEQ ID NO: 4132 - protein, 115 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
  UNSURE 47: Xaa=Glu or Gly
  UNSURE 50: Xaa=Ser or Thr
  UNSURE 52: Xaa=Ala or Thr
  UNSURE 66: Xaa=Leu or Val
MDWTWRFLFVVAAATGVQSQXQLXQSGAEVKKPGSSVKVSCEASGYTFSNYAVSWFQGRVTITADXSTXTXYMELSSLRSEDTAXYYCARGQAPGRVVVPLFLWGQGTWSPSPQP

SEQ ID NO: 4133 - protein, 129 aa, Homo sapiens
  SIGNAL -19..-1: score 9.9 seq FLFVVAAATGVQS/QV
  UNSURE 34: Xaa=Ile or Val
  UNSURE 35: Xaa=Ile or Asn or Ser or Thr
  UNSURE 50: Xaa=Gly or Arg
  UNSURE 55: Xaa=Phe or Leu
  UNSURE 59: Xaa=Lys or Asn
  UNSURE 61: Xaa=Ala or Pro
MDWTWRFLFVVAAATGVQSQVQLVQSGAEVKKPGSSVKVSCKASGGTFSNYAXXWVRQAPGQGLEWMGXITPIXGTAXYXQKFQGRITITADESTSTAYMELTGLKSDDTAVYYCARDSASVVMANGLG

SEQ ID NO: 4134 - protein, 126 aa, Homo sapiens
  SIGNAL -19..-1: score 9.9 seq FLFVVAAATGVQS/QV
  UNSURE 31: Xaa=Ser or Thr
  UNSURE 42: Xaa=Ala or Gly or Arg or Thr
  UNSURE 51: Xaa=Ile or Val
  UNSURE 58: Xaa=Ala or Pro
  UNSURE 59: Xaa=His or Asn
  UNSURE 63: Xaa=Lys or Asn
  UNSURE 68: Xaa=Phe or Ile or Leu or Met or Val
  UNSURE 69: Xaa=Arg or Thr
MDWTWRFLFVVAAATGVQSQVQLVQSGAEVKKPGSSVKVSCKASGGTFNXYAISWVRQAPXQGLEWMGGXTPIFGTXXYAQXFQGRXXITADESTSRVYMELSSPRSEDTAVYYCVSSSTECGRDC

SEQ ID NO: 4135 - protein, 94 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITADESTTTVYMELSRLTSEDTAVYYCARDINR

SEQ ID NO: 4136 - protein, 99 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITADESTSRVYMELSSPRSEDTAVYYCVSSSTECGRDC

SEQ ID NO: 4137 - protein, 104 aa, Homo sapiens
  SIGNAL -19..-1: score 8.3 seq FLFVVAAATXVQS/QX
  UNSURE -4: Xaa=Asp or Gly
  UNSURE 2: Xaa=Gly or Val
  UNSURE 9: Xaa=Ala or Ser
  UNSURE 13: Xaa=Lys or Arg
  UNSURE 24: Xaa=Ala or Thr
  UNSURE 28: Xaa=Ile or Thr
  UNSURE 29: Xaa=Phe or Leu
  UNSURE 31: Xaa=Ser or Thr
  UNSURE 33: Xaa=Ala or Gly
  UNSURE 35: Xaa=Arg or Ser or Thr
  UNSURE 73: Xaa= *  or Cys or Phe or Gly or Ile or Leu or Met or Arg or Ser or Val or Trp
  UNSURE 78: Xaa=Arg or Thr
  UNSURE 79: Xaa=Ala or Gly
MDWTWRFLFVVAAATXVQSQXQLVQSGXEVKXPGSSVKVSCKXSGGXXSXNXIXWVRQAPGQGLEWMGRIIPMVEKADTAQKFQGRLTISTXLSTSXXFMELSS

SEQ ID NO: 4138 - protein, 126 aa, Homo sapiens
  SIGNAL -19..-1: score 9.4 seq FLFVVAAATGVQS/QX
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
MDWTWRFLFVVAAATGVQSQXXLVQSGAEVKKPGSSVKXSCKASGGXXXXXGISWVRQAPGQGLEWMGDIIPIYDLVNYAQKFQGRVTITAHKSTTTAYMEVISLTSEDTAVYYCAREAREWQWLV

SEQ ID NO: 4139 - protein, 129 aa, Homo sapiens
  SIGNAL -19..-1: score 9.4 seq FLFVVAAATGVQS/QX
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
MDWTWRFLFVVAAATGVQSQXXLVQSGAEVKKPGSSVKXSCKASGGXXXXXGISWVRQAPGQGLEWMGDIIPIYDLVNYAQKFQGRVTITAHKSTTTAYMEVISLTSEDTAVYYCARDSASVVMANGLG

SEQ ID NO: 4140 - protein, 121 aa, Homo sapiens
  SIGNAL -19..-1: score 9.4 seq FLFVVAAATGVQS/QX
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
MDWTWRFLFVVAAATGVQSQXXLVQSGAEVKKPGSSVKXSCKASGGXXXXXGISWVRQAPGQGLEWMGDIIPIYDLVNYAQKFQGRVTITAHKSTTTAYMEVISLTSEDTAVYYCARDINR

SEQ ID NO: 4141 - protein, 142 aa, Homo sapiens
  SIGNAL -19..-1: score 9.4 seq FLFVVAAATGVQS/QX
  UNSURE 2: Xaa=Gly or Val
  UNSURE 3: Xaa=Asp or Glu or His or Gln
  UNSURE 20: Xaa=Ile or Val
  UNSURE 28: Xaa=Ile or Thr
  UNSURE 29: Xaa=Phe or Leu
  UNSURE 30: Xaa=Arg or Ser
  UNSURE 31: Xaa=Asp or Asn
  UNSURE 32: Xaa=Asp or His
MDWTWRFLFVVAAATGVQSQXXLVQSGAEVKKPGSSVKXSCKASGGXXXXXGISWVRQAPGQGLEWMGDIIPIYDLVNYAQKFQGRVTITAHKSTTTAYMEVISLTSEDTAVYYCARGQAPGRVVVPLFLWGQGTWSPSPQP

SEQ ID NO: 4142 - protein, 103 aa, Homo sapiens
  SIGNAL -19..-1: score 9.9 seq FLFVVAAATGVQS/QV
  UNSURE 9: Xaa=Ala or Ser
  UNSURE 28: Xaa=Ile or Thr
  UNSURE 29: Xaa=Phe or Leu
  UNSURE 30: Xaa=Asn or Ser
  UNSURE 31: Xaa=Ile or Thr
  UNSURE 32: Xaa=Ser or Thr
  UNSURE 35: Xaa=Ser or Thr
  UNSURE 53: Xaa=Ala or Cys or Asp or Phe or Gly or His or Ile or Leu or Asn or Pro or Arg or Ser or Thr or Val or Tyr
  UNSURE 64: Xaa= *  or Leu or Ser or Trp
  UNSURE 77: Xaa=Ile or Asn or Ser or Thr
MDWTWRFLFVVAAATGVQSQVQLVQSGXEVKKPGSSVRVSCKASGGXXXXXAVXWVRQAPGQGLEWVGRLIXVLNVAHYAQKXQDRVTITADKSTXTAYMELR

SEQ ID NO: 4143 - protein, 58 aa, Homo sapiens
  SIGNAL -19..-1: score 10.2 seq FLFVVAAAXGVQS/QV
  UNSURE -5: Xaa=Ser or Thr
  UNSURE 20: Xaa=Ile or Val
MDWTWRFLFVVAAAXGVQSQVQLVQSGAEVKKPGSSVKXSCEATGVDVKKYGFSWVRQ

SEQ ID NO: 4144 - protein, 121 aa, Homo sapiens
  SIGNAL -19..-1: score 9.3 seq FLFVVAAATGVQX/QX
  UNSURE 0: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
MDWTWRFLFVVAAATGVQXQXXLVQSXAEXKKPXSSVSVSCKTSGDTFRRFTMSWVRQAPGQGLEWMGRVIPILGSPTYAQKFQGRVTITADESTTTVYMQLSSLTSEDTAVYYCARDINR

SEQ ID NO: 4145 - protein, 142 aa, Homo sapiens
  SIGNAL -19..-1: score 9.3 seq FLFVVAAATGVQX/QX
  UNSURE 0: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
MDWTWRFLFVVAAATGVQXQXXLVQSXAEXKKPXSSVSVSCKTSGDTFRRFTMSWVRQAPGQGLEWMGRVIPILGSPTYAQKFQGRVTITADESTTTVYMQLSSLTSEDTAVYYCARGQAPGRVVVPLFLWGQGTWSPSPQP

SEQ ID NO: 4146 - protein, 94 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITAHKSTTTAYMEVISLTSEDTAVYYCARDINR

SEQ ID NO: 4147 - protein, 99 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITAHKSTTTAYMEVISLTSEDTAVYYCAREAREWQWLV

SEQ ID NO: 4148 - protein, 80 aa, Homo sapiens
  SIGNAL -19..-1: score 9.9 seq FLFVVAAATGVQS/QV
  UNSURE 27: Xaa=Ala or Asp or Gly or Val
  UNSURE 30: Xaa=Gly or Ser
  UNSURE 31: Xaa=Asn or Thr
  UNSURE 33: Xaa=Ala or Pro
  UNSURE 34: Xaa=Phe or Ile or Leu or Val
  UNSURE 46: Xaa=Glu or Gln
  UNSURE 52: Xaa=Asp or Glu or Ile or Lys or Asn or Val
MDWTWRFLFVVAAATGVQSQVQLVQSGAEVKKPGSSVKVSCKASGXTFXXYXXSWVRQAPGQGLXWMGRIXPLDGIVKYA

SEQ ID NO: 4149 - protein, 97 aa, Homo sapiens
  SIGNAL -19..-1: score 9.4 seq FLFVVAAATGVQS/QX
  UNSURE 2: Xaa=Gly or Val
  UNSURE 5: Xaa=Glu or Val
  UNSURE 28: Xaa=Ile or Leu
  UNSURE 29: Xaa=Phe or Leu
  UNSURE 31: Xaa=Ser or Thr
  UNSURE 35: Xaa=Ala or Thr
MDWTWRFLFVVAAATGVQSQXQLXQSGAEVKKPGSSVKVSCKASGGXXTXMLSXGCDRPLDKDLSGWEATSLFLIHQITHRSSRTESRFRWTNPLTQ

SEQ ID NO: 4150 - protein, 126 aa, Homo sapiens
  SIGNAL -19..-1: score 9.3 seq FLFVVAAATGVQX/QX
  UNSURE 0: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
MDWTWRFLFVVAAATGVQXQXXLVQSXAEXKKPXSSVSVSCKTSGDTFRRFTMSWVRQAPGQGLEWMGRVIPILGSPTYAQKFQGRVTITADESTTTVYMQLSSLTSEDTAVYYCAREAREWQWLV

SEQ ID NO: 4151 - protein, 129 aa, Homo sapiens
  SIGNAL -19..-1: score 9.3 seq FLFVVAAATGVQX/QX
  UNSURE 0: Xaa=Cys or Ser
  UNSURE 2: Xaa=Ala or Val
  UNSURE 3: Xaa=His or Gln
  UNSURE 8: Xaa=Gly or Arg
  UNSURE 11: Xaa=Leu or Val
  UNSURE 15: Xaa=Gly or Arg
MDWTWRFLFVVAAATGVQXQXXLVQSXAEXKKPXSSVSVSCKTSGDTFRRFTMSWVRQAPGQGLEWMGRVIPILGSPTYAQKFQGRVTITADESTTTVYMQLSSLTSEDTAVYYCARDSASVVMANGLG

SEQ ID NO: 4152 - protein, 102 aa, Homo sapiens
  SIGNAL -19..-1: score 9.6 seq FLFVVAAATGVQS/QX
  UNSURE 2: Xaa=Ile or Met or Val
  UNSURE 5: Xaa=Leu or Val
MDWTWRFLFVVAAATGVQSQXQLXQSGAEVKKPGSSVKVSCEASGYTFSNYAVSWFQGRVTITAHKSTTTAYMEVISLTSEDTAVYYCARDSASVVMANGLG

SEQ ID NO: 4153 - protein, 134 aa, Homo sapiens
  SIGNAL -22..-1: score 15.3 seq LLLLLTHLPLALG/SP
  UNSURE 80: Xaa=His or Leu or Pro or Arg
  UNSURE 107: Xaa= *  or Tyr
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGXNKFVTVQATFGTQVVEKVVLVSLQSGXLFIQT

SEQ ID NO: 4154 - protein, 55 aa, Homo sapiens
  SIGNAL -24..-1: score 5.4 seq VYLTIFLLLSSLS/SY
MGGYYCNVCPIVYLTIFLLLSSLSSYLAYLSIHLRVCLQPPPVCPSVQLPVTLCI

SEQ ID NO: 4155 - protein, 80 aa, Homo sapiens [sequence omitted]

SEQ ID NO: 4156 - protein, 392 aa, Homo sapiens
  SIGNAL -16..-1: score 10.1 seq LWTLSLLLGAVAG/KE
  UNSURE 305: Xaa=Pro or Thr
  UNSURE 376: Xaa= *  or Gly
MLPLWTLSLLLGAVAGKEVCYERLGCFSDDSPWSGITERPLHILPWSPKDVNTRFLLYTNENPNNFQEVAADSSSISGSNFKTNRKTRFIIRFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCXQMGHYADRYPGKTNDVGQKFYLDTGDASNFARWRYKVSVTLSGKKVTGHILVSLFGNKGNSKQYEIFKGNX

SEQ ID NO: 4157 - protein, 178 aa, Homo sapiens
  SIGNAL -18..-1: score 11.4 seq WTLGLLLLATVRG/KE
  UNSURE 113: Xaa=Gly or Arg
  UNSURE 147: Xaa=Asp or Gly
  UNSURE 160: Xaa=Ala or Asp or Gly or Val
MMLPPWTLGLLLLATVRGKEVCYGQLGCFSDEKPWAGTLQRPVKLLPWSPEDIDTRFLLYTNENPNNFQLITGTEPDTIEASNFQLDRKTRFIIHGFLDKAEDSWPSDMCKKMFEVEKVNCICVDWRHGSXAMYTQAVQNIRVVGAETAFLIQALSTQLGYSLEXVHVIGHSLGAHTX

SEQ ID NO: 4158 - protein, 121 aa, Homo sapiens
  SIGNAL -18..-1: score 11.4 seq WTLGLLLLATVRG/KE
MMLPPWTLGLLLLATVRGKEVCYGQLGCFSDEKPWAGTLQRPVKLLPWSPEDIDTRFLLYTNENPNNFQDEPEEVRLDPSDAVFVDVIHTDSSPIVPSLGFGMSQKVGHLDFFPNGGKEMP

SEQ ID NO: 4159 - protein, 112 aa, Homo sapiens
  SIGNAL -26..-1: score 4.8 seq LIVLLGQFVSIKA/QE
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRK

SEQ ID NO: 4160 - protein, 91 aa, Homo sapiens
  SIGNAL -19..-1: score 7.2 seq LIWTLFFLGTAVS/LQ
MLQTKDLIWTLFFLGTAVSLQVDIVPSQGEISVGESKFFLCQVAGDAKDKDISWFSPNGEKLTPNQQRISVVWNDDSSSTLTIYNANIDDA

SEQ ID NO: 4161 - protein, 140 aa, Homo sapiens
  SIGNAL -15..-1: score 4.9 seq ELVALLLLTLAYL/FW
  UNSURE 105: Xaa=Asp or His or Asn or Tyr
MWELVALLLLTLAYLFWPKRRCPGAKYPKSLLSLPLVGSLPFLPRHGHMHNNFFKLQKKYGPIYSVRMGTKTTVIVGHHQLAKEVLIKKGKDFSGRPQMATLDIASNNRKGIAFADSGAXWQLHRRLAMATFACSRMAIR

SEQ ID NO: 4162 - protein, 100 aa, Homo sapiens
  SIGNAL -16..-1: score 8.5 seq AVLFSGALLGLLA/AQ
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTAT

SEQ ID NO: 4163 - protein, 135 aa, Homo sapiens
  SIGNAL -17..-1: score 13 seq VLCAVCLLPGSLA/LP
  UNSURE 60: Xaa=His or Arg
MRLTVLCAVCLLPGSLALPLPQEAGGMSELQWEQAQDYLKRFYLYDSETKNANSLEAKLKEMQKFFGLPITGMLNSXVIEIMQKPRCGVPDVAEYSLFPNSPKWTSKVVTYRIVSYTRDLPHITVDRLVSKALNM

SEQ ID NO: 4164 - protein, 121 aa, Homo sapiens
  SIGNAL -35..-1: score 4.1 seq ILSKMMLMSTATA/FY
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAY

SEQ ID NO: 4165 - protein, 55 aa, Homo sapiens
  SIGNAL -25..-1: score 6.3 seq AFSLSVMAALTFG/CF
MNTVLSRANSLFAFSLSVMAALTFGCFITTAFKDRSVPVRLHVSRIMLKNVEDFT

SEQ ID NO: 4166 - protein, 80 aa, Homo sapiens
  SIGNAL -16..-1: score 11.5 seq TIILLLLAQVSWA/GP
MKATIILLLLAQVSWAGPFQQRGLFDFMLEDEASGIGPEVPDDRDFEPSLGPVCPFRCQCHLRVVQCSDLGLDKVPKDLP

SEQ ID NO: 4167 - protein, 90 aa, Homo sapiens
  SIGNAL -16..-1: score 11.5 seq TIILLLLAQVSWA/GP
MKATIILLLLAQVSWAGPFQQRGLFDFMLEDEASGIGPEVPDDRDFEPSLGPVCPFRCQCHLRVVQCSDLGLDKVPKDLPPDTTLLDLQN

SEQ ID NO: 4168 - protein, 205 aa, Homo sapiens
  SIGNAL -25..-1: score 10.1 seq LLYVLLLAFCACA/VG
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLV

SEQ ID NO: 4169 - protein, 91 aa, Homo sapiens
  SIGNAL -25..-1: score 10.1 seq LLYVLLLAFCACA/VG
MAVEGGMKCVKFLLYVLLLAFCACAVGLIAVGVGAQLVLSQTIIQGATPGSLLPVVIIAVGVFLFLVAFVGCCGPFQTAKSLTSILTLCQA

SEQ ID NO: 4170 - protein, 58 aa, Homo sapiens
  SIGNAL -32..-1: score 4.7 seq RVLXLCNSRVSFT/RX
  UNSURE -10: Xaa=Ile or Leu
  UNSURE 2: Xaa=Phe or Ile or Leu or Val
  UNSURE 9: Xaa=Asn or Tyr
MSCTHSSSNLGKFSVHREYRVLXLCNSRVSFTRXHVKRPPXRLCVSSKGCLFHLGAGR

SEQ ID NO: 4171 - protein, 166 aa, Homo sapiens
  SIGNAL -33..-1: score 9.9 seq SVFFLLLPGPSAA/DE
  UNSURE 116: Xaa=Ala or Pro or Ser or Thr
  UNSURE 126: Xaa= *  or Ser
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKRHPXGSPSSSSRQXKTAWLDG

SEQ ID NO: 4172 - protein, 132 aa, Homo sapiens
  SIGNAL -31..-1: score 9.1 seq LLLLTMALAGGSG/TA
MAAPKGSLWVRTQLGLPPLLLLTMALAGGSGTASAEAFDSVLGDTASCHRACQLTYPLHTYPKEEELYACQRGCRLFSICQFVDDGIDLNRTKLECESACTEAYSQSDEQYACHLGCQNQLPFAELRQEQLM

SEQ ID NO: 4173 - protein, 111 aa, Homo sapiens
  SIGNAL -17..-1: score 6.4 seq AILAAILPGXAPA/GP
  UNSURE -4: Xaa=Arg or Trp
  UNSURE 8: Xaa=Gly or Arg
  UNSURE 88: Xaa=Ala or Glu
  UNSURE 94: Xaa=Ala or Asp or Glu or Gly or Val
MRTLAILAAILPGXAPAGPRLSHSXQELIEVAAAPEQIAADIPEVVCFPCMGRKLGSKASRLKEKHGLLLQNTSVHCRRTSLWNLHLPGKTLGILLLSLQKKKNXLKICFX

SEQ ID NO: 4174 - protein, 98 aa, Homo sapiens
  SIGNAL -21..-1: score 7.9 seq MMLLLGLLAYGSG/XD
  UNSURE 1: Xaa=Gly or Val
  UNSURE 19: Xaa=Glu or Gly
  UNSURE 28: Xaa=Asn or Ser
  UNSURE 35: Xaa=Cys or Asn or Ser or Tyr
  UNSURE 36: Xaa=Cys or Phe or Ser or Tyr
  UNSURE 37: Xaa= *  or Cys or Trp or Tyr
  UNSURE 48: Xaa=Pro or Thr
MSVPTMAWMMLLLGLLAYGSGXDSQTVVTQEPSFSVSPGXTVTLTCGLXSGSVSTXXXPSWYQQTPGQXPRTLIYNTNTRSSGVPDRFSGSILGNKAA

SEQ ID NO: 4175 - protein, 118 aa, Homo sapiens
  SIGNAL -20..-1: score 7.8 seq LTLLTLCIGSVVS/SE
  UNSURE 5: Xaa=His or Gln
  UNSURE 25: Xaa=Arg or Ser
  UNSURE 27: Xaa=Arg or Thr
  UNSURE 28: Xaa=Asp or His or Asn or Tyr
  UNSURE 30: Xaa=Ser or Tyr
  UNSURE 34: Xaa=Phe or Tyr
  UNSURE 43: Xaa=Ile or Met or Val
  UNSURE 46: Xaa=Phe or Ile
  UNSURE 48: Xaa=Asp or Gly or Asn or Ser
  UNSURE 49: Xaa=Lys or Arg
  UNSURE 50: Xaa=Asp or Asn
  UNSURE 51: Xaa=any one of the twenty amino acids
  UNSURE 54: Xaa=Leu or Ser
  UNSURE 85: Xaa=His or Tyr
MAWTPLWLTLLTLCIGSVVSSELTXDPAVSVALGQTVRITCQGDXLXXYXASWXQQKPGQAPXLVXYXXXXRPXGIPDRFSGSSSGNTASLTITGAQAEDEADYXCNSRDSSGHHLVF

SEQ ID NO: 4176 - protein, 60 aa, Homo sapiens
  SIGNAL -17..-1: score 5.8 seq LWLKLLAFGFAFL/DT
  UNSURE 18: Xaa=Ala or Asp
MTMYLWLKLLAFGFAFLDTEVFVTGQSPTPSPTDXYLNASETTTLSPSGSAVISTTTIAT

SEQ ID NO: 4177 - protein, 129 aa, Homo sapiens
  SIGNAL -26..-1: score 14.3 seq PLLLLLLLRAVLA/VP
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMTPSRIQCTGG

SEQ ID NO: 4178 - protein, 128 aa, Homo sapiens
  SIGNAL -24..-1: score 4.2 seq IWSFPLIIAAVCA/QS
  UNSURE -18: Xaa=Lys or Arg
  UNSURE 74: Xaa=Ile or Lys
MWRVRKXGYFGIWSFPLIIAAVCAQSVNDPSNMSLVKETVDRLLKGYDIRLRPDFGGPPVAVGMNIDIASIDMVSEVNMDYTLTMYFQQAWRDKRLSXNVIPLNLTLDNRVADQLWVPDTYFLNDKKS

SEQ ID NO: 4179 - protein, 58 aa, Homo sapiens
  SIGNAL -14..-1: score 8.6 seq LLAFSQALLVVFS/ER
  UNSURE 41: Xaa=Ala or Glu
MLLAFSQALLVVFSERRLLPSGLSWLMGSCSCLCTHPLLSCQLCPCLRWSYLSRXPSC

SEQ ID NO: 4180 - protein, 77 aa, Homo sapiens
  SIGNAL -32..-1: score 3.7 seq EALILQLFSQIGP/CK
MEDEMPKTLYVGNLSRDVTEALILQLFSQIGPCKNCKMIMDTAGNDPYCFVEFHEHRHAAAALAAMNGRKIMGKEVK

SEQ ID NO: 4181 - protein, 73 aa, Homo sapiens
  SIGNAL -37..-1: score 4.8 seq GIGLLAAATQSLS/MP
  UNSURE -15: Xaa=Ala or Pro or Ser or Thr
MSKSFQQSSLSRDSQGHGRDLSXAGIGLLAAATQSLSMPASLGRMNQGTARLASLMNLGMSSSLNQQGAHSAL

SEQ ID NO: 4182 - protein, 119 aa, Homo sapiens
  SIGNAL -27..-1: score 11.7 seq LLLLLGLIDISQA/QL
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGLKVAQGPWSPGPKGESGDYKATQ

SEQ ID NO: 4183 - protein, 138 aa, Homo sapiens
  SIGNAL -22..-1: score 5.2 seq AGLLILSPLTVIS/DS
MKRLAARCFAGLLILSPLTVISDSRPADSGKAIEGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIK

SEQ ID NO: 4184 - protein, 127 aa, Homo sapiens
  SIGNAL -19..-1: score 10.1 seq TLLLLLLVPLIKP/AP
  UNSURE 67: Xaa=Arg or Ser
MKTLQSTLLLLLLVPLIKPAPPTQQDSRIIYDYGTDNFEESIFSQDYEDKYLDGKNIKEKETVIIPNEKSLQLQKDEAITPLPPKXENDEMPTCLLCVCLSGSVYCEEVDIDAVPPLPRNQPIFTHD

SEQ ID NO: 4185 - protein, 127 aa, Homo sapiens
  SIGNAL -19..-1: score 10.1 seq TLLLLLLVPLIKP/AP
  UNSURE 8: Xaa=Pro or Ser
  UNSURE 67: Xaa=Arg or Ser
MKTLQSTLLLLLLVPLIKPAPPTQQDXRIIYDYGTDNFEESIFSQDYEDKYLDGKNIKEKETVIIPNEKSLQLQKDEAITPLPPKXENDEMPTCLLCVCLSGSVYCEEVDIDAVPPLPRNQPIFTHD

SEQ ID NO: 4186 - protein, 114 aa, Homo sapiens
  SIGNAL -24..-1: score 9.2 seq LVTLSVFLHVLHS/AP
MDYYRKYAAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYH

SEQ ID NO: 4187 - protein, 72 aa, Homo sapiens
  SIGNAL -22..-1: score 8.4 seq SILLLFLTEAALG/DA
  UNSURE 20: Xaa=His or Tyr
MDPARPLGLSILLLFLTEAALGDAAQEPTGNNAEICLLPLDXGPCRALLLRYYYDRYTQSCRQFLYGGCEGN

SEQ ID NO: 4188 - protein, 83 aa, Homo sapiens
  SIGNAL -41..-1: score 6.6 seq LFIFRMLVLGTAA/ES
  UNSURE 33: Xaa=Asp or Asn
  UNSURE 36: Xaa= *  or Tyr
MGDWSFLGNFLEEVHKHSTVVGKVWLTVLFIFRMLVLGTAAESSWGDEQADFRCDTIQPGCQNVCYDQAFPIGXIRXWVLQII

SEQ ID NO: 4189 - protein, 98 aa, Homo sapiens
  SIGNAL -46..-1: score 9.2 seq ILLLGTAVESAWG/DE
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFY

SEQ ID NO: 4190 - protein, 132 aa, Homo sapiens
  SIGNAL -20..-1: score 11.2 seq AFLLLVALSYTLA/RD
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDKHLSPDGQYVPGLCLLT

SEQ ID NO: 4191 - protein, 127 aa, Homo sapiens
  SIGNAL -31..-1: score 10.1 seq SLAFLLSLRGAGA/IK
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEP

SEQ ID NO: 4192 - protein, 127 aa, Homo sapiens; identical to SEQ ID NO: 4191
  SIGNAL -31..-1: score 10.1 seq SLAFLLSLRGAGA/IK

SEQ ID NO: 4193 - protein, 106 aa, Homo sapiens
  SIGNAL -18..-1: score 10.5 seq VLTVLSLLPLLEA/QI
  UNSURE 20: Xaa=Gln or Arg
  UNSURE 56: Xaa=Pro or Thr
  UNSURE 57: Xaa=Glu or Gln
  UNSURE 80: Xaa=Ala or Gly
MALSWVLTVLSLLPLLEAQIPLCANLVPVPITNATLDXITGKWFYIASAFRNEEYNKSVQEIQATFFYFTPNKXXDTIFLREYQTRQDQCIYNTTYPXSSLTLTKK

SEQ ID NO: 4194 - protein, 78 aa, Homo sapiens
  SIGNAL -44..-1: score 6.3 seq WLIFAFFVDTGFC/RV
  UNSURE 24: Xaa=Ala or Glu or Gly or Leu or Pro or Gln or Arg or Val
MAHCSLDHPQGSSDRATSACWVAGTADRHPAWLIFAFFVDTGFCRVAQAGLNLLGSSQQPASASRCVXITGINYYAQL

SEQ ID NO: 4195 - protein, 158 aa, Homo sapiens
  SIGNAL -41..-1: score 4.3 seq VALFCGCGHEALS/GT
MGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVE

SEQ ID NO: 4196 - protein, 84 aa, Homo sapiens
  SIGNAL -20..-1: score 4.4 seq LRYVASAVFGVIG/SQ
  UNSURE 30: Xaa=Arg or Trp
MGLTKQYLRYVASAVFGVIGSQKGNIVFVTLRGEKGRYVAVPACEHVFIXDLRKGEKILILQGLKQEVTCLCPSPDGLHLAVGY

SEQ ID NO: 4197 - protein, 59 aa, Homo sapiens
  SIGNAL -16..-1: score 8.9 seq FLLSLPTPPSASG/HE
MPLFLLSLPTPPSASGHERRQRPEAKTSGSEKKYLRAMQANRSQLHSPPGTGSSEDAST

SEQ ID NO: 4198 - protein, 105 aa, Homo sapiens
  SIGNAL -27..-1: score 5.2 seq WMSALFLGVGVRA/EE
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPR

SEQ ID NO: 4199 - protein, 62 aa, Homo sapiens
  SIGNAL -20..-1: score 9.3 seq LFLCYLLLFTCSG/VE
  UNSURE 30: Xaa=Ala or Glu or Gly or Val
MRQKAVSLFLCYLLLFTCSGVEAGKKKCSESSDSGSGFWKALTFMAVGGXLAVAGLPALGFT

SEQ ID NO: 4200 - protein, 137 aa, Homo sapiens
  SIGNAL -18..-1: score 7.1 seq IFVLLLSAIVSIS/AX
  UNSURE 2: Xaa=Leu or Ser
MYGKIIFVLLLSAIVSISAXSTTGVAMHTSTSSSVTKSYISSQTNDTHKRDTYAATPRAHEVSEISVRTVYPPEEETGERVQLAHHFSEPEITLIIFGVMAGVIGTILLISYGIRRLIKRQVINENLFTKPNVERTQ

SEQ ID NO: 4201 - protein, 81 aa, Homo sapiens [sequence omitted]

SEQ ID NO: 4202 - protein, 144 aa, Homo sapiens
  SIGNAL -24..-1: score 10.9 seq LAGLCCLVPVSLA/ED
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFL

SEQ ID NO: 4203 - protein, 111 aa, Homo sapiens
  SIGNAL -22..-1: score 8.6 seq PLPLLLVLALSQG/IL
  UNSURE 88: Xaa=Lys or Arg
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMXT

SEQ ID NO: 4204 - protein, 184 aa, Homo sapiens
  SIGNAL -14..-1: score 5.9 seq AMRLILFFGALFG/HI
  UNSURE 152: Xaa=Ala or Glu or Gly or Val
MAMRLILFFGALFGHIYCLETFVGDQVLEIVPSNEEQIKNLLQLEAQEHLQLDFWKSPTTPGETAHVRVPFVNVQAVKVFLESQGIAYSIMIEDVQVLLDKENEEMLFNRRRERSGNFNFGAYHTLEEISQEMDNLVAEHPGLVSKVNIGSSFENRPMNVLKFSTXGDKPAIWLDAGIHAREWV

SEQ ID NO: 4205 - protein, 108 aa, Homo sapiens
  SIGNAL -42..-1: score 5.8 seq GLIVGLAVGLTRS/CD
  UNSURE 14: Xaa=Ala or Asp or Gly or His or Leu or Pro or Arg or Val
MNFAEREGSKRYCIQTKHVAILCAVVVGVGLIVGLAVGLTRSCDSSGDGGPGTAPXPSHLPSSTASPSGPPAQDQDICPASEDESGQWKNFRLPDFVNPVHYDLHVKP

SEQ ID NO: 4206 - protein, 96 aa, Homo sapiens
  SIGNAL -28..-1: score 12.5 seq LLLLLLLPLRGQA/NT
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMP

SEQ ID NO: 4207 - protein, 131 aa, Homo sapiens
  SIGNAL -18..-1: score 8.2 seq LLLLLLSFLAPWA/TI
  UNSURE 7: Xaa=Ala or Asp
  UNSURE 81: Xaa=Ala or Cys or Asp or Phe or Gly or His or Ile or Leu or Asn or Pro or Arg or Ser or Thr or Val or Tyr
MGRRALLLLLLSFLAPWATIALRPXLRALGSLHLPTNPTSLPAVAKNYSVLYFQQKVDHFGFNTVKTFNQRYLVADKYWKKNGGSILFYTGNEGDIIWXCNNTGFMWDVAEELKAMLVFAEHRILWKSLSP

SEQ ID NO: 4208 - protein, 61 aa, Homo sapiens
  SIGNAL -20..-1: score 4.8 seq PLTVSLVLEGSEA/RH
MSGIKPLPLTVSLVLEGSEARHHVVRVVYGSRVLGYSWGECRLNGRAARSKRLTRRGHSPR

SEQ ID NO: 4209 - protein, 62 aa, Homo sapiens
  SIGNAL -21..-1: score 8.4 seq CAVLALVLAPAGA/FR
MERGLPLLCAVLALVLAPAGAFRNDKCGDTIKIESPGYLTSPGYPHSYHPSEKCEWLIQAPD

SEQ ID NO: 4210 - protein, 108 aa, Homo sapiens
  SIGNAL -26..-1: score 7.4 seq GVVVLLLLQGGSA/YK
MGATTMDQKSLWAGVVVLLLLQGGSAYKLVCYFTNWSQDRQEPGKFTPENIDPFLCSHLIYSFASIENNKVIIKDKSEVMLYQTINSLKTKNPKLKILLSIGGYCLVP

SEQ ID NO: 4211 - protein, 81 aa, Homo sapiens
  SIGNAL -23..-1: score 4.2 seq YLHLAFLMTTVFS/LS
MPTDMEHTGHYLHLAFLMTTVFSLSPGTKANYTRLWANSTSSWDSVIQNKTGRNQNENINTNPITPEVDYKGNSTNMPETS

SEQ ID NO: 4212 - protein, 151 aa, Homo sapiens
  SIGNAL -46..-1: score 3.9 seq PTLFTSSMSQVLA/NS
  UNSURE 39: Xaa=Gly or Val
  UNSURE 69: Xaa=His or Asn
MDPKYFILILFCGHLNNTFFSKTETITTEKQSQPTLFTSSMSQVLANSQNTTGNPLGQPTQFSDTFSGQSISPAKVTAGQPTPAXYTSSEKPEAHTSAGQPLAYNTKQPNTNSQXLLPASRVHLCQTTTICPYFYHTTTKVICLYFYSTII

SEQ ID NO: 4213 - protein, 79 aa, Homo sapiens
  SIGNAL -23..-1: score 5.5 seq ALALXTVMSXCGG/EX
  UNSURE -15: Xaa=Leu or Met
  UNSURE -9: Xaa=Lys or Asn or Thr
  UNSURE -4: Xaa=Pro or Ser
  UNSURE 2: Xaa=Asp or His
  UNSURE 4: Xaa=Ile or Met or Val
  UNSURE 5: Xaa=Ala or Asp
  UNSURE 12: Xaa=Gly or Ser
  UNSURE 17: Xaa=His or Gln
  UNSURE 18: Xaa=Pro or Ser
  UNSURE 42: Xaa=Lys or Asn
  UNSURE 44: Xaa=Ser or Thr
  UNSURE 54: Xaa=Ile or Leu
MILNKALMXGALALXTVMSXCGGEXIXXDHVASYXVNLYXXYGPSGQFTHEFDGDEEFYVDLERXEXVWKLPLFHRXRF

SEQ ID NO: 4214 - protein, 97 aa, Homo sapiens
  SIGNAL -23..-1: score 6.9 seq ALALTTVMSPCGG/ED
  UNSURE 26: Xaa=Ser or Thr
  UNSURE 34: Xaa=Glu or Gln
  UNSURE 40: Xaa=Glu or Gly
  UNSURE 47: Xaa= *  or Cys or Arg or Trp
  UNSURE 51: Xaa=Leu or Pro
MILNKALMLGALALTTVMSPCGGEDIVADHVASYGVNLYQSYGPSGQYXHEFDGDEXFYVDLXRKETVWXLPVXRFRRFDPQFALTNIAVLKHNLNI

SEQ ID NO: 4215 - protein, 141 aa, Homo sapiens
  SIGNAL -16..-1: score 13.3 seq LLLLLAFLLPTGA/EA
  UNSURE 106: Xaa=Gly or Arg
  UNSURE 107: Xaa=Asp or Asn
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNXXVNPVALLEPGGTETRDAV

SEQ ID NO: 4216 - protein, 137 aa, Homo sapiens
  SIGNAL -17..-1: score 6.9 seq LFLTMLTLALVKS/QD
  UNSURE 39: Xaa= *  or Lys
  UNSURE 51: Xaa= *  or Tyr
  UNSURE 88: Xaa=Ala or Cys or Asp or Phe or Gly or His or Ile or Leu or Asn or Pro or Arg or Ser or Thr or Val or Tyr
  UNSURE 94: Xaa=Ala or Glu or Gly or Val
  UNSURE 97: Xaa=His or Ile or Lys or Leu or Met or Asn or Pro or Gln or Arg or Ser or Thr
MLKALFLTMLTLALVKSQDTEETITYTQCTDGYEWDPVRQQCKDIDECDIVPDACXGGMKCVNHYGGXLCLPKTAQIIVNNEQPQQETQPAEGTSGATTGVVAAXSMATSXVLXGGGFVASAAAVAGPEMQTGRNNF

SEQ ID NO: 4217 - protein, 137 aa, Homo sapiens
  SIGNAL -33..-1: score 8.5 seq LSFCVLLAGLCRG/NS
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPS

SEQ ID NO: 4218 - protein, 124 aa, Homo sapiens
  SIGNAL -17..-1: score 13 seq IFFLLCLAGRALA/AP
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCH

SEQ ID NO: 4219 - protein, 62 aa, Homo sapiens
  SIGNAL -17..-1: score 13 seq IFFLLCLAGRALA/AP
MRAWIFFLLCLAGRALAAPQQEALPDETEVVEETVAEVTEVSVGANPVQVEVGEFILNKQFR

SEQ ID NO: 4220 - protein, 72 aa, Homo sapiens
  SIGNAL -17..-1: score 13 seq IFFLLCLAGRALA/AP
MRAWIFFLLCLAGRALAAPQQEALPDETEVVEETVAEVTEVSVGANPVQNEIHCLLQTSTTKTSVLLLGSHL

SEQ ID NO: 4221 - protein, 88 aa, Homo sapiens
  SIGNAL -46..-1: score 6.5 seq LLIFVLLPKVVNT/SD
MKSSGPPSYFIKRESWGWTDFLMNPMVMMMVLPLLIFVLLPKVVNTSDPDMRREMEQSMNMLNSNHELPDVSEFMTRLFSSKSSGKSS

SEQ ID NO: 4222 - protein, 90 aa, Homo sapiens
  SIGNAL -48..-1: score 4.1 seq VFMLIVSVLALIP/ET
MDNVQPKIKHRPFCFSVKGHVKMLRLDIINSLVTTVFMLIVSVLALIPETTTLTVGGGVFALVTAVCCLADGALIYRKLLFNPSGPYQKK

SEQ ID NO: 4223 - protein, 144 aa, Homo sapiens
  SIGNAL -27..-1: score 8.6 seq ATVLLLSFGSVAA/SH
  UNSURE 108: Xaa=Ile or Leu or Val
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVXTGRIPPSTP

SEQ ID NO: 4224 - protein, 127 aa, Homo sapiens
  SIGNAL -23..-1: score 4.1 seq LHILILILLFVAT/LD
  UNSURE 5: Xaa=Arg or Trp
  UNSURE 91: Xaa=any one of the twenty amino acids
MSLLLLVVSALHILILILLFVATLDKSXWTLPGKESLNLWYDCTWNNDTKTWACSNVSENGWLKAVQVLMVLSLILCCLSFILFMFQLYTMRRGGLFYATGLCQLCTSVAVFTXALIYAIHAEEILE

SEQ ID NO: 4225 - protein, 93 aa, Homo sapiens
  SIGNAL -46..-1: score 9.8 seq VLMVLSLILCCLS/FI
  UNSURE -24: Xaa=His or Asn
  UNSURE 10: Xaa=Ala or Gly or Ser or Thr
  UNSURE 20: Xaa=Ser or Thr
  UNSURE 32: Xaa=Phe or Leu
  UNSURE 34: Xaa=any one of the twenty amino acids
MSLLLLVVSALHILILILLFVGXFGQGWLKAVQVLMVLSLILCCLSFILFMFQLYXMRRGGLFYAXGLCQLCTSVAVXTXALIYAIHAEEILE

SEQ ID NO: 4226 - protein, 137 aa, Homo sapiens
  SIGNAL -39..-1: score 5.5 seq LLLRAAFQSLLDA/QA
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIK

SEQ ID NO: 4227 - protein, 70 aa, Homo sapiens
  SIGNAL -26..-1: score 9.3 seq MXPLLWLLPXXWA/VP
  UNSURE -12: Xaa= *  or Phe or Leu or Ser or Tyr
  UNSURE -4: Xaa=His or Gln
  UNSURE -3: Xaa=Ser or Thr
  UNSURE 4: Xaa=Gly or Arg
  UNSURE 27: Xaa=Phe or Ile
  UNSURE 28: Xaa=Asp or Ile or Asn or Val
  UNSURE 39: Xaa=Lys or Asn
  UNSURE 40: Xaa=Arg or Trp
MGHEQNQGAALLQMXPLLWLLPXXWAVPEXFPIAEVFTLKPLEFGKPNTLVCXXSNLFPPMLTVXXQHHS

SEQ ID NO: 4228 - protein, 162 aa, Homo sapiens
  SIGNAL -16..-1: score 5.6 seq KWLLCMLLVLGTA/IV
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGG

SEQ ID NO: 4229 - protein, 162 aa, Homo sapiens; identical to SEQ ID NO: 4228
  SIGNAL -16..-1: score 5.6 seq KWLLCMLLVLGTA/IV

SEQ ID NO: 4230 - protein, 84 aa, Homo sapiens
  SIGNAL -16..-1: score 11.9 seq VLLSVVLLALSSA/QS
MLLVLLSVVLLALSSAQSTDNDVNYEDFTFTIPDVEDSSQRPDQGPQRPPPEGLLPRPPGDSGNQDDGPQQRPPKPGGHHRHPP

SEQ ID NO: 4231 - protein, 150 aa, Homo sapiens
  SIGNAL -30..-1: score 12.2 seq LLLLLLCVFLVKS/QG
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYL

SEQ ID NO: 4232 - protein, 118 aa, Homo sapiens [sequence omitted]

SEQ ID NO: 4233 - protein, 79 aa, Homo sapiens
  SIGNAL -40..-1: score 4.3 seq LVPVFLLPAKLAS/AQ
MDAEVGWQPSARLPGSRVEAIPTESIWLVPVFLLPAKLASAQVQILCHTYWEHWTSQGQVRMRLFGQRCQKCSWSQYEM

SEQ ID NO: 4234 - protein, 99 aa, Homo sapiens
  SIGNAL -14..-1: score 4 seq ALLTAFSSSVAVT/DK
  UNSURE 40: Xaa=Pro or Gln
  UNSURE 57: Xaa=Glu or Gly
MALLTAFSSSVAVTDKDTFELSTFLDSSKAPQHDRNELPEQRGVGGGLDVPFDXSGLGAEESLGLLDDYLXVAKHFKPHGFSSDKAKAGSSEWLAVDGL

SEQ ID NO: 4235 - protein, 63 aa, Homo sapiens
  SIGNAL -22..-1: score 3.7 seq VGASASATPVVRA/AR
  UNSURE 41: Xaa=Pro or Ser
MARFDSGVGVGASASATPVVRAARAWELTPLTDPQSQSQRCEETSTLPGPQGQRGSASEAPFX

SEQ ID NO: 4236 - protein, 107 aa, Homo sapiens
  SIGNAL -23..-1: score 13.6 seq LVLLLLVLLPTDA/SV
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQV

SEQ ID NO: 4237 - protein, 94 aa, Homo sapiens
  SIGNAL -27..-1: score 9.8 seq LIPLIFLISGAEA/AS
MAEAKTHWLGAALSLIPLIFLISGAEAASFQRNQLLQKEPDLRLENVQKFPSPEMIRALEYIENLRQQAHKEESSPDYNPYQGVSVPLQQKENG

SEQ ID NO: 4238 - protein, 147 aa, Homo sapiens
  SIGNAL -30..-1: score 8.8 seq ALLLALGVERALA/LP
MAPHGPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQ

SEQ ID NO: 4239 - protein, 98 aa, Homo sapiens
  SIGNAL -21..-1: score 7.9 seq GLVLATLLSQVSP/FK
  UNSURE 22: Xaa= *  or Trp
MEHSTFLSGLVLATLLSQVSPFKIPIEELEDRVFVNCNTSITXVEGTVGTLLSDITRLDLGKRILDPRGIYRCNGTDIYKDKESTVQVHYRMCQSCVE

SEQ ID NO: 4240 - protein, 68 aa, Homo sapiens
  SIGNAL -39..-1: score 3.7 seq VFFSPMSMSCALA/MV
MDVLAEANGTFALNLLKTLGKDNSKNVFFSPMSMSCALAMVYMGAKGNTAAQMAQILSFNKSGGGGDT

SEQ ID NO: 4241 - protein, 54 aa, Homo sapiens
  SIGNAL -23..-1: score 4 seq AAAAVAAAAAVTA/GE
MATVAANPAAAAAAVAAAAAVTAGEWHEPQGAGLQEAKIAPLHSSLGDSETPSQ

SEQ ID NO: 4242 - protein, 76 aa, Homo sapiens
  SIGNAL -29..-1: score 7.1 seq LLFLLSAVYLGPG/CQ
MPGGPGVLQALPATIFLLFLLSAVYLGPGCQALWMHKVPASLMVSLGEDAHFQCPHNSSNNANVTWWRVLHGNYTW

SEQ ID NO: 4243 - protein, 76 aa, Homo sapiens
  SIGNAL -41..-1: score 3.6 seq AGAGLPALDLAKA/QR
MGTPGEGLGRCSHALIRGVPESLASGEGAGAGLPALDLAKAQREHGVLGGKLRQRLGLQLLELPPEESLPLGPLLG

SEQ ID NO: 4244 - protein, 117 aa, Homo sapiens
  SIGNAL -29..-1: score 8.5 seq LLGLLMAACFTFC/LS
MAPQSLPSSRMAPLGMLLGLLMAACFTFCLSHQNLKEFALTNPEKSSTKETERKETKAEEELDAEVLEVFHPTHEWQALQPGQAVPAGSHVRLNLQTGEREAKLQYEDKFRNNLKGK

SEQ ID NO: 4245 - protein, 141 aa, Homo sapiens
  SIGNAL -26..-1: score 8.3 seq CLLLCGSITLALG/NA
MRGGKCNMLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSW

SEQ ID NO: 4246 - protein, 85 aa, Homo sapiens
  SIGNAL -23..-1: score 4 seq LLLXLHWKHGAGS/PL
  UNSURE -10: Xaa=Gly or Val
MKVLAAGVVPLLLXLHWKHGAGSPLPITPVNATCAIRHPCHNNLMNQIRSQLAQLNGSANALFILYYTAQGEPFPNNLDKLCGPN

SEQ ID NO: 4247 - protein, 105 aa, Homo sapiens
  SIGNAL -19..-1: score 11.7 seq IALLLTVLQVSRG/QK
MNLAISIALLLTVLQVSRGQKVTSLTACLVDQSLRLDCRHENTSSSPIQYEFSLTRETKKHVLFGTVGVPEHTYRSRTNFTSKYNMKVLYLSASLARTRALHVCT

SEQ ID NO: 4248 - protein, 76 aa, Homo sapiens
  SIGNAL -37..-1: score 3.6 seq PLSLDCGHSFCQA/CI
  UNSURE 24: Xaa=Ser or Thr
  UNSURE 26: Xaa=Phe or Leu
MDFSVKVDIEKEVTCPICLELLTEPLSLDCGHSFCQACITAKIKESVIISRGESSCPVCQXRXQPGNLRPNRHLAN

SEQ ID NO: 4249 - protein, 196 aa, Homo sapiens
  SIGNAL -19..-1: score 11.8 seq ALLVCAVLGLCLA/VP
MRLAVGALLVCAVLGLCLAVPDKTVRWCAVSEHEATKCQSFRDHMKSVIPSDGPSVACVKKASYLDCIRAIAANEADAVTLDAGLVYDAYLAPNNLKPVVAEFYGSKEDPQTFYYAVAVVKKDSGFQMNQLRGKKSCHTGLGRSAGWNIPIGLLYCDLPEPRKPLEKAVANFFSGSCAPCADGTDFPQLCQLCPGC

SEQ ID NO: 4250 - protein, 88 aa, Homo sapiens
  SIGNAL -19..-1: score 7.4 seq LLAAVSILSACQQ/SY
  UNSURE 62: Xaa=Cys or Gly or Arg or Ser
  UNSURE 63: Xaa=His or Leu or Pro or Gln or Arg
MAGNSILLAAVSILSACQQSYFALQVGKARLKYKVTPPAVTGSPEFERVFRAQQNCVEFYPIFIITLWMAGWYFNQVFATXXGLVYIY

SEQ ID NO: 4251 - protein, 104 aa, Homo sapiens
  SIGNAL -28..-1: score 3.9 seq FQSFSSASSPVNC/QW
MKVISLFILVGFIGEFQSFSSASSPVNCQWDFYAPWSECNGCTKTQTRRRSVAVYGQYGGQPCVGNAFETQSCEPTRGCPTEEGCGERFRCFSGQCISKSWFAW

SEQ ID NO: 4252 - protein, 110 aa, Homo sapiens
  SIGNAL -19..-1: score 13.5 seq LLLLLSACLAVSA/GP
  UNSURE 80: Xaa=Arg or Ser
  UNSURE 83: Xaa=Ile or Leu
MRSLGALLLLLSACLAVSAGPVPTPPDNIQVQENFNISRIYGKWYNLAIGSTCPWLKKIMDRMTVSTLVLGEGATEAEISMTSTRWRKGVCERRLELMXKQXLMGSFSIT

SEQ ID NO: 4253 - protein, 84 aa, Homo sapiens
  SIGNAL -21..-1: score 12.9 seq LLLLLLLTLLGLG/LV
MALQRTHSLLLLLLLTLLGLGLVQPSYGQDGMYQRFLRQHVHPEETGGSDRYCNLMMQRRKMTLYHCKRFNTFIHEDIWNIRSI

SEQ ID NO: 4254 - protein, 93 aa, Homo sapiens
  SIGNAL -24..-1: score 11.7 seq FVLGLGLTPPTLA/QD
  UNSURE 46: Xaa=Gly or Ile or Met or Arg or Ser or Val
MVMGLGVLLLVFVLGLGLTPPTLAQDNSRYTHFLTQHYDAKPQGRDDRYCESIMRRRGLTSPCKDINTFXSWQQAQIKAICENKNGNPHRENL

SEQ ID NO: 4255 - protein, 66 aa, Homo sapiens
  SIGNAL -24..-1: score 11.7 seq FVLGLGLTPPTLA/QD
  UNSURE -18: Xaa=Phe or Val
MVMGLGXLLLVFVLGLGLTPPTLAQDNSRYTHFLTQHYDAKPQGRDDRYCESIMRRRGLTSPCKDI

SEQ ID NO: 4256 - protein, 134 aa, Homo sapiens
  SIGNAL -33..-1: score 11.2 seq ILCLLAWAGLAAG/DR
  UNSURE 99: Xaa=Pro or Thr
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANSWASVYMACTVSYGAWSMGPXSS

SEQ ID NO: 4257 - protein, 149 aa, Homo sapiens
  SIGNAL -45..-1: score 3.7 seq EDLLMYLLQLVQA/LK
MDVEDSLELLSSHYTNPTVRRYAVARLRQADDEDLLMYLLQLVQALKYENFDDIKNGLEPTKKDSQSSVSENVSNSGINSAEIDSSQIITSPLPSVSSPPPASKTKEVPDGENLEQDLCTFLISRACKNSTLANYLYWYVIVECEDQDT

SEQ ID NO: 4258 - protein, 121 aa, Homo sapiens
  SIGNAL -17..-1: score 6.5 seq WTITLFLLGAAKG/KE
MLIFWTITLFLLGAAKGKEVCYEDLGCFSDTEPWGGTAIRPLKILPWSPEKIGTRFLLYTNENPNNFQILLLSDPSTIEASNFQMDRKTRFIIHGFIDKGDESWVTDMCKKLFEVEEVNCI

SEQ ID NO: 4259 - protein, 100 aa, Homo sapiens
  SIGNAL -22..-1: score 5.8 seq LGIILLVLIGXQG/TP
  UNSURE -3: Xaa=Met or Val
  UNSURE 65: Xaa= *  or Lys
MKKSGVLFLLGIILLVLIGXQGTPVVRKGRCSCISTNQGTIHLQSLKDLKQFAPSPSCEKIEIIATLKNGVQTCLNPDSADVKELIXKWENRSAKRKSKR

SEQ ID NO: 4260 - protein, 130 aa, Homo sapiens
  SIGNAL -13..-1: score 4.2 seq MLSVRVAAAVVRA/LP
MLSVRVAAAVVRALPRRAGLVSRNALGSSFIAARNFHASNTHLQKTGTAEMSSILEERILGADTSVDLEETGRVLSIGDGIARVHGLRNVQAEEMVEFSSGLKGMSLNLEPDNVGVVVFGNDKLIKEGDI

SEQ ID NO: 4261 - protein, 56 aa, Homo sapiens
  SIGNAL -13..-1: score 4.2 seq MLSVRVAAAVVRA/LP
MLSVRVAAAVVRALPRRAGLVSRNALGSSFIAARNFHASNTHLQKTGKLLFLSLRR

SEQ ID NO: 4262 - protein, 84 aa, Homo sapiens
  SIGNAL -23..-1: score 3.9 seq GWAGSCFWQWSFC/PP
  UNSURE 19: Xaa=Leu or Val
MMIYVSTGAWGWAGSCFWQWSFCPPACVGCIEEAQGSSEQEXHYASLQRLPVPSSEGPDLRGRDKRGTKEDPRADYACIAENKP

SEQ ID NO: 4263 - protein, 96 aa, Homo sapiens
  SIGNAL -32..-1: score 11.3 seq LLLAVVLLSACLC/WL
  UNSURE 11: Xaa=Met or Arg
MLSRNDDICIYGGLGLGGLLLLAVVLLSACLCWLHRRVKRLEXSWAQGSSEQELHYASLQRLPVPSSEGPDLRGRDKRGTKEDPRADYACIAENKP

SEQ ID NO: 4264 - protein, 145 aa, Homo sapiens
  SIGNAL -25..-1: score 8.9 seq IIAVLMSAQESWA/IK
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVT

SEQ ID NO: 4265 - protein, 130 aa, Homo sapiens
  SIGNAL -45..-1: score 5.8 seq ILVAFSFLFTVIT/FP
  UNSURE 30: Xaa=Ala or Gly
MAEKRHTRDSEAQRLPDSFKDSPSKGLGPCGWILVAFSFLFTVITFPISIWMCIKIIKEYERAIIFRLGRILQGXAKGPGLFFILPCTDSFIKVDMRTISFDIPPQEILTKDSVTISVDGVVYYRVQNAP

SEQ ID NO: 4266 - protein, 104 aa, Homo sapiens
  SIGNAL -15..-1: score 4.8 seq SLATAAPVPTTLA/QV
  UNSURE 60: Xaa=Pro or Arg
MHSLATAAPVPTTLAQVDREKIYQWINELSSPETRENALLELSKKRESVPDLAPMLWHSFGTIAALLQEIVNIYXSINPPTLTAHQSNRVCNALALLQCVASHP

SEQ ID NO: 4267 - protein, 86 aa, Homo sapiens
  SIGNAL -20..-1: score 8.5 seq WIGLISSVCCVFA/QT
  UNSURE 4: Xaa=Asp or Glu
MNLQPIFWIGLISSVCCVFAQTDXNRCLKANAKSCGECIQAGPNCGWCTNSTFLQEGMPTSARCDDLEALKKKGCPPDDIENPRGS

SEQ ID NO: 4268 - protein, 69 aa, Homo sapiens
  SIGNAL -20..-1: score 11.3 seq LLLLLVLWGPVCP/LH
MVLCFPLLLLLLVLWGPVCPLHAWPKRLTKAHWFEIQHIQPSPLQCNRAMSGINNYTQHCKHQNTFLHD

SEQ ID NO: 4269 - protein, 70 aa, Homo sapiens
  SIGNAL -18..-1: score 7 seq VLGLVLLSVTVQG/KV
MKALIVLGLVLLSVTVQGKVFERCELARTLKRLGMDGYRGISLANCKSTLHNSRELATYGTDTRREGRRR

SEQ ID NO: 4270 - protein, 125 aa, Homo sapiens
  SIGNAL -44..-1: score 5.8 seq MVFLLGLMFEITA/KA
  UNSURE 66: Xaa=His or Leu or Pro or Arg
  UNSURE 71: Xaa=Ala or Glu or Gly or Ile or Lys or Arg or Thr or Val
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMXFSKTXHSKFNESGQL

SEQ ID NO: 4271 - protein, 114 aa, Homo sapiens
  SIGNAL -28..-1: score 6.1 seq AVGFLSSLLRTRG/CV
MSHGKGTDMLPEIAAAVGFLSSLLRTRGCVSEQRLKVFSGALQEALTEHYKHHWFPEKPSKGSGYRCIRINHKMDPIISRVASQIGLSQPQLHQLLPSELTLWVDPMRCPTHWE

SEQ ID NO: 4272 - protein, 86 aa, Homo sapiens
  SIGNAL -22..-1: score 10 seq FLLALTIIASTWA/LT
  UNSURE 13: Xaa=Glu or Gly
MAPPGSSTVFLLALTIIASTWALTPTHYLTKHDVXRLKASLDRPFTNLESAFYSIVGLSSLGAQVPDAKVRLLLSWWSGWFRRTFI

SEQ ID NO: 4273 - protein, 94 aa, Homo sapiens
  SIGNAL -38..-1: score 4.5 seq IIAVIALXAVGLT/QN
  UNSURE -26: Xaa=Cys or Tyr
  UNSURE -24: Xaa=Lys or Arg
  UNSURE -21: Xaa=Leu or Pro or Gln or Arg
  UNSURE -16: Xaa=Phe or Ile or Leu or Val
  UNSURE -15: Xaa=Ala or Pro or Ser or Thr
  UNSURE -14: Xaa=Ala or Pro or Ser or Thr
  UNSURE -6: Xaa=His or Leu or Pro or Arg
  UNSURE 32: Xaa=Asp or Glu or Val
  UNSURE 40: Xaa=Asp or Glu
MEDTKESNVKTFXSXNIXAILGXXXIIAVIALXAVGLTQNKALPENVKYGIVLDAGSSHTSLYIYKWPAXKENDTGVXHQVEECRVKGPGISKF

SEQ ID NO: 4274 - protein, 70 aa, Homo sapiens
  SIGNAL -26..-1: score 5.2 seq LIFLPVLLSYIGP/SI
  UNSURE 7: Xaa=His or Gln or Arg
MYLAMVLLGATHGLIFLPVLLSYIGPSIPEHAXPSGSTVGKTHGCIKPPGLTAQQETKGESLTSENALQP

SEQ ID NO: 4275 - protein, 105 aa, Homo sapiens
  SIGNAL -42..-1: score 5.8 seq FSPICLSTSLSLA/QV
  UNSURE 45: Xaa=Lys or Arg
MDALQLANSAFAVDLFKQLCEKEPLGNVLFSPICLSTSLSLAQVGAKGDTANEIGQVLHFENVKDVPFGFQTVTSDVNKLSSFYSLXLIKRLYVDKSLNLSTEFI

SEQ ID NO: 4276 - protein, 120 aa, Homo sapiens
  SIGNAL -23..-1: score 9.6 seq LLLALLHPTIILA/QQ
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRN

SEQ ID NO: 4277 - protein, 97 aa, Homo sapiens
  SIGNAL -21..-1: score 3.9 seq VVALLVNLTRLDS/SM
  UNSURE 48: Xaa=Asp or Tyr
MGSGWVPWVVALLVNLTRLDSSMTQGTDSPEDFVIQAKADCYFTNGTEKVQFVVRFIFNLEEYVRFDSXVGMFVALTKLGQPDAEQWNSRLDLLERS

SEQ ID NO: 4278 - protein, 130 aa, Homo sapiens
  SIGNAL -27..-1: score 11.6 seq ILLLSTLTGRSYG/QP
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHN

SEQ ID NO: 4279 - protein, 98 aa, Homo sapiens
  SIGNAL -18..-1: score 16.3 seq LLLLAGLFSLSQA/QY
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLK

SEQ ID NO: 4280 - protein, 98 aa, Homo sapiens
  SIGNAL -20..-1: score 10.7 seq LTLLLLLLAGDRA/SS
  UNSURE 77: Xaa=His or Gln
MASRLTLLTLLLLLLAGDRASSNPNATSSSSQDPESLQDRGEGKVATTVISKMLFVEPILEVSSLPTTNSTTNSATKITANTTDEPTTQPTTEPTTXH

SEQ ID NO: 4281 - protein, 101 aa, Homo sapiens
  SIGNAL -20..-1: score 10.7 seq LTLLLLLLAGDRA/SS
  UNSURE 75: Xaa=Ile or Lys or Met or Asn or Arg or Ser or Thr
MASRLTLLTLLLLLLAGDRASSNPNATSSSSQDPESLQDRGEGKVATTVISKMLFVEPILEVSSLPTTNSTTNSATKITANTTDEPTTQPTTEPXTQPTIQ

SEQ ID NO: 4282 - protein, 59 aa, Homo sapiens
  SIGNAL -34..-1: score 4 seq IAVLYLHLYDVFG/DP
MERGLKSADPRDGTGYTGWAGIAVLYLHLYDVFGDPAYLQLAHGYVKQSLNCLTKRSIT

SEQ ID NO: 4283 - protein, 119 aa, Homo sapiens
  SIGNAL -42..-1: score 7.4 seq SLSVLVLLLTIIA/VT
  UNSURE -29: Xaa=Ile or Asn
  UNSURE -19: Xaa=Gly or Trp
  UNSURE 34: Xaa=Lys or Asn
MGKSESQMDITDIXTPKPKKKQRXTPLEISLSVLVLLLTIIAVTMIALYATYDDGICKSSDCIKSAARLIQNMDAXTEPCTDFFKYACGGWLKRNVIPETSSRYGTFGILRDELEVVLK

SEQ ID NO: 4284 - protein, 119 aa, Homo sapiens
  SIGNAL -42..-1: score 7.4 seq SLSVLVLLLTIIA/VT
  UNSURE -40: Xaa=Lys or Asn
  UNSURE 29: Xaa=His or Gln
  UNSURE 30: Xaa=Cys or Asp or Gly or His or Asn or Arg or Ser or Tyr
MGXSESQMDITDINTPKPKKKQRWTPLEISLSVLVLLLTIIAVTMIALYATYDDGICKSSDCIKSAARLIXXMDATTEPCTDFFKYACGGWLKRNVIPETSSRYGTFGILRDELEVVLK

SEQ ID NO: 4285 - protein, 99 aa, Homo sapiens
  SIGNAL -24..-1: score 4.6 seq QGMLLAILEXCGA/IP
  UNSURE -4: Xaa=Glu or Lys
MVKSVIFLSFWQGMLLAILEXCGAIPKIHSARVSVGEGTVAAGYQDFIICVEMFFAALALRHAFTYKVYADKRLDAQVPTYGPYGRCAPMKSISSSLKE

SEQ ID NO: 4286 - protein, 135 aa, Homo sapiens
  SIGNAL -18..-1: score 12.7 seq LWVLLPLVTMAWG/QY
MDLSLLWVLLPLVTMAWGQYGDYGYPYQQYHDYSDDGWVNLNRQGFSYQCPQGQVIVAVRSIFSKKEGSDRQWNYACMPTPQSLGEPTECWWEEINRAGMEWYQTCSNNGLVAGFQSRYFESVLDREWQFYCCRY

SEQ ID NO: 4287 - protein, 124 aa, Homo sapiens
  SIGNAL -22..-1: score 9.1 seq LLLLSGALALTET/WA
  UNSURE -19: Xaa=Met or Thr
  UNSURE -14: Xaa=Leu or Val
  UNSURE 13: Xaa=Ala or Ser
  UNSURE 14: Xaa=Met or Val
  UNSURE 26: Xaa=Ala or Pro or Ser or Thr
  UNSURE 34: Xaa=Leu or Gln
  UNSURE 43: Xaa=Ala or Thr
  UNSURE 47: Xaa=Lys or Met or Arg or Thr
  UNSURE 48: Xaa=Ala or Glu
  UNSURE 65: Xaa=Asp or Glu or Lys or Asn
MRVXAPRTXLLLLSGALALTETWAGSHSMRYFYTXXSRPGRGEPRFIXVGYVDDTXFVRFDSDAXSPRXXPRAPWIEQEGPEYWDRXTQISKTNTQTYRENLRTALRYYNQSEAGSHIIQRMYG

SEQ ID NO: 4288 - protein, 99 aa, Homo sapiens
  SIGNAL -24..-1: score 9.4 seq LLSGALALTETWA/XS
  UNSURE -21: Xaa=Met or Thr
  UNSURE -16: Xaa=Leu or Val
  UNSURE 1: Xaa=Cys or Gly
  UNSURE 24: Xaa=Ala or Ser
  UNSURE 45: Xaa=Lys or Met or Arg or Thr
  UNSURE 67: Xaa=Cys or Phe or Ser or Tyr
MRVXAPRTXLLLLSGALALTETWAXSHSMRYFYTAVSRPGRGEPRFIXVGYVDDTQFVRFDSDAASPRXEPRAPWIEQEGPEYWDRNTQIXKTNTLRRR

SEQ ID NO: 4289 - protein, 156 aa, Homo sapiens
  SIGNAL -22..-1: score 9.9 seq XLLLSGALALTQT/WA
  UNSURE -13: Xaa=Leu or Val
  UNSURE 11: Xaa=Phe or Ser
  UNSURE 16: Xaa=Gly or Arg or Trp
MAVMAPRTLXLLLSGALALTQTWAGSHSMRYFXTSVSXPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRS

SEQ ID NO: 4290 - protein, 120 aa, Homo sapiens
  SIGNAL -17..-1: score 9.3 seq SLLLLLSGALALT/DT
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMN

SEQ ID NO: 4291 - protein, 137 aa, Homo sapiens
  SIGNAL -17..-1: score 8.4 seq TLLLLLSEALALT/QT
MVDGTLLLLLSEALALTQTWAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPEGASSAGMTVR

SEQ ID NO: 4292 - protein, 67 aa, Homo sapiens
  SIGNAL -21..-1: score 10.5 seq VLGLCLLSVGVWG/QD
MQSGTHWRVLGLCLLSVGVWGQDGNEEMGGITQTPYKVSISGTTVILTCPQYPGSEILWQHNDKNIG

SEQ ID NO: 4293 - protein, 104 aa, Homo sapiens
  SIGNAL -20..-1: score 7.4 seq FGMVFSLLQVVSG/ES
  UNSURE 46: Xaa=Ile or Thr
MTILGTTFGMVFSLLQVVSGESGYAQNGDLEDAELDDYSFSCYSQLEVNGSQHSLTCAFEDPDVNXTNLEFEICGALVEVKCLNFRKLQEIYFIETKKFLLIGK

SEQ ID NO: 4294 - protein, 149 aa, Homo sapiens
  SIGNAL -24..-1: score 3.8 seq LLRLLQSGRRVHS/VA
  UNSURE 47: Xaa=Phe or Ile or Leu or Val
MAMGLMCGRRELLRLLQSGRRVHSVAGPSQWLGKPLTTRLLFPVAPCCCRPHYLFLAASGPRSLSTSAISXAEVQVQAPPVVAATPSPTAVPEVASGETADVVQTAAEQSFAELGLGSYTPVGLIQNLLEFMHVDLGLPWWGAIAACTV

SEQ ID NO: 4295 - protein, 75 aa, Homo sapiens
  SIGNAL -45..-1: score 6.5 seq LLLLVLHPSRXSA/VS
  UNSURE -20: Xaa=Phe or Leu
  UNSURE -3: Xaa=His or Leu
MLGCSFKLRTTHHAYPGAEGPDHHSXKNRGGCLLLLVLHPSRXSAVSCLGVAAAMARKVLPPTHLGQSWFCSCCR

SEQ ID NO: 4296 - protein, 59 aa, Homo sapiens
  SIGNAL -17..-1: score 8.9 seq ILIIGILLPQSLA/HP
MIWYILIIGILLPQSLAHPGFFTSIGQMTDLIHTEKDLVTSLKDYIKAEEDKLEQIKKW

SEQ ID NO: 4297 - protein, 210 aa, Homo sapiens
  SIGNAL -32..-1: score 8.1 seq FLLFFWLDRSVLA/KE
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVY

SEQ ID NO: 4298 - protein, 178 aa, Homo sapiens
  SIGNAL -32..-1: score 8.1 seq FLLFFWLDRSVLA/KE
  UNSURE 36: Xaa=Ala or Glu or Gly or Val
MRAAPLLLARAASLSLGFLFLLFFWLDRSVLAKELKFVTLLGMEQHYELGEYIRKRYRKFLNESYKHXQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVY

SEQ ID NO: 4299 - protein, 53 aa, Homo sapiens
  SIGNAL -20..-1: score 11.3 seq VLLLWGILGAIQA/QQ
MLQGTCSVLLLWGILGAIQAQQQEVISPDTTERNNNCPEKTDCPIHVYFVLDT

SEQ ID NO: 4300 - protein, 106 aa, Homo sapiens
  SIGNAL -13..-1: score 6.4 seq MWGDLWLLPXASA/NP
  UNSURE -4: Xaa=Leu or Pro
  UNSURE 21: Xaa= *  or Glu or Lys
  UNSURE 45: Xaa=Lys or Asn
  UNSURE 46: Xaa=Ala or Ser
  UNSURE 51: Xaa= *  or Ala or Glu or Gly or Lys or Leu or Met or Pro or Gln or Arg or Ser or Thr or Val or Trp
MWGDLWLLPXASANPGTGTEAEFEKAAEEVRHLXTKPSDEEMLFIYGHYKQATVGDIXXERPGXLDFTGKAKWDAWNELKGTSKEDANESLHQQSRRAKEKIRDNE

SEQ ID NO: 4301 - protein, 89 aa, Homo sapiens
  SIGNAL -20..-1: score 11.6 seq ILGLLTAVPPASC/QQ
  UNSURE 31: Xaa=Ala or Cys or Asp or Phe or Gly or His or Ile or Leu or Asn or Pro or Arg or Ser or Thr or Val or Tyr
MSALSLLILGLLTAVPPASCQQGLGNLQPWMQGLIAVAVFLVLVAIAFAVXHFWCQEEPEPAHMILTVGNKADGVLVGNRWKGTLRWRA

SEQ ID NO: 4302 - protein, 97 aa, Homo sapiens
  SIGNAL -17..-1: score 5.7 seq LLYYALCFSLSKA/SA
MRWLLLYYALCFSLSKASAHTVELNNMFGQIQSPGYPDSYPSDSEVTWNITVPDGFRIKLYFMHFNLESSYLCEYDYVKVRLLMSLTGPGSLLGFRQ

SEQ ID NO: 4303 - protein, 53 aa, Homo sapiens
  SIGNAL -21..-1: score 8.9 seq VLLFSGFWGLAMG/AF
MRIISRQIVLLFSGFWGLAMGAFPSSVQIGGLFIRNTDQEYTAFRLAIFLHNT

SEQ ID NO: 4304 - protein, 129 aa, Homo sapiens
  SIGNAL -48..-1: score 4.7 seq LFTLSHITQLVLS/HN
  UNSURE 33: Xaa= *  or Glu or Lys or Gln
MSKSLKKLVEESREKNQPEVDMSDRGISNMLDVNGLFTLSHITQLVLSHNKLTMVPPNIAELKNLEVLNFFNNQIEELPTXISSLQKLKHLNLGMNRLNTLPRGFGSLPALEVLDLTYNNLSENSLPGN

SEQ ID NO: 4305 - protein, 115 aa, Homo sapiens
  SIGNAL -20..-1: score 4.3 seq VGCLPVLCSGTAG/HL
  UNSURE 57: Xaa=Arg or Ser
MATAVRAVGCLPVLCSGTAGHLLGRQCSLNTLPAASILAWKSVLGNGHLSSLGTRDTHPYASLSRALQTQCCISSPXHLMSQQYRPYSFFTKLTADELWKGALAETGAGAKKGRG

SEQ ID NO: 4306 - protein, 54 aa, Homo sapiens
  SIGNAL -36..-1: score 8.3 seq LCLLVFVCLQSLS/AM
MHTFNFVRFTHATMSFQTPAVKRLCLLVFVCLQSLSAMALAGCWKAACGGRWFR

SEQ ID NO: 4307 - protein, 78 aa, Homo sapiens
  SIGNAL -32..-1: score 11 seq LGLLLSVLAATLA/QA
  UNSURE 19: Xaa=Arg or Thr
MELTSRERGRGQPLPWELRLGLLLSVLAATLAQAPAPDVPGCSRGSCYPAXGDLLVGRADRLTASSTCGLNGPSLLHR

SEQ ID NO: 4308 - protein, 126 aa, Homo sapiens
  SIGNAL -21..-1: score 7.7 seq GFVVLVLLQCCSA/YK
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPF

SEQ ID NO: 4309 - protein, 147 aa, Homo sapiens
  SIGNAL -20..-1: score 9.1 seq LLLLLLVFPATVL/FR
  UNSURE 8: Xaa=Leu or Ser
MRLLPRLLLLLLLVFPATVLFRGGPRGXLAVAQDLTEDEETVEDSIIEDEDDEAEVEEDEPTDLVEDKEEEDVSGEPEASPSADTTILFVKGEDFPANNIVKFLVGFTNKGTEDFIVESLDASFRYPQDYQFYIQNFTALPLNTVVP

SEQ ID NO: 4310 - protein, 98 aa, Homo sapiens
  SIGNAL -14..-1: score 3.7 seq GLTISSLFSRLFG/KK
MGLTISSLFSRLFGKKQMRILMVGLDAAGKTTILYKLKLGEIVTTIPTIGFNVETVEYKNICFTVWDVGGQDRIRPLWKHYFQNTQGLIFVVDSNDRE

SEQ ID NO: 4311 - protein, 107 aa, Homo sapiens
  SIGNAL -20..-1: score 8.4 seq AVVGCLLVPPAEA/NK
  UNSURE 43: Xaa=Leu or Pro or Gln or Arg
  UNSURE 64: Xaa=Arg or Thr
MKLLSLVAVVGCLLVPPAEANKSSEDIRCKCICPPYRNISGHIYNQNVSQKDCNCLHVVEPMXVPGHDVEAYCLLCECRYEERXPPPSRSSLSSTCPWWVPVALHGF

SEQ ID NO: 4312 - protein, 118 aa, Homo sapiens
  SIGNAL -38..-1: score 6.3 seq GLSISLRLTGSSA/QE
MAAGIVASRRLRDLLTRRLTGSNYPGLSISLRLTGSSAQEAASGVALGEAPDHSYESLRVTSAQKHVLHVQLNRPNKRNAMNKVFWREMVECFNKISRDADCRAVVISGAGKMFTAGI

SEQ ID NO: 4313 - protein, 105 aa, Homo sapiens
  SIGNAL -21..-1: score 9.5 seq LGLVLCLAQTIHT/QE
  UNSURE 47: Xaa= *  or Tyr
MSPHPTALLGLVLCLAQTIHTQEEDLPRPSISAEPGTVIPLGSHVTFVCRGPVGVQTFRLERESRSTXNDTEDVSQASPSESEARFRIDSVSEGNAGPYRCIYYK

SEQ ID NO: 4314 - protein, 100 aa, Homo sapiens
  SIGNAL -18..-1: score 11.7 seq VLLLLLLVEQAAA/LG
MIPAVVLLLLLLVEQAAALGEPQLCYILDAILFLYGIVLTLLYCRLKIQVRKAAITSYEKSDGVYTMESPSITRLECSGMIWAHCNLCLPGSRDSRASAS

SEQ ID NO: 4315 - protein, 111 aa, Homo sapiens
  SIGNAL -26..-1: score 8.9 seq GLLWAFCAPGARA/EE
  UNSURE 80: Xaa=Ser or Thr
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGXEQAPL

SEQ ID NO: 4316 - protein, 128 aa, Homo sapiens
  SIGNAL -24..-1: score 3.8 seq VVALAGVLQSGFQ/EL
  UNSURE 100: Xaa= *  or Tyr
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAXLLAG

SEQ ID NO: 4317 - protein, 63 aa, Homo sapiens
  SIGNAL -35..-1: score 5.1 seq FLLFRSLPRXXFG/LV
  UNSURE -4: Xaa=His or Gln
  UNSURE -3: Xaa=Ala or Asp or Gly or Ile or Asn or Ser or Thr or Val
  UNSURE 3: Xaa=His or Gln
  UNSURE 10: Xaa= *  or Tyr
  UNSURE 11: Xaa=Phe or Leu
  UNSURE 12: Xaa=Asp or His
MVHLLVLSGAWGMQMWVTFVSGFLLFRSLPRXXFGLVXGKLFPFXXXISMGCASSTSASWLHS

SEQ ID NO: 4318 - protein, 75 aa, Homo sapiens
  SIGNAL -24..-1: score 6.6 seq KMVHLLVLSGAWG/MQ
MEEGGNLGGLIKMVHLLVLSGAWGMQMWVTFVSGFLLFRSLPRHTFGLVQSKLFPFYFHISMGCASSTSASWLHS

SEQ ID NO: 4319 - protein, 124 aa, Homo sapiens
  SIGNAL -19..-1: score 7.4 seq LIWASSFFTLSLQ/KP
MRLLWGLIWASSFFTLSLQKPRLLLFSPSVVHLGVPLSVGVQLQDVPRGQVVKGSVFLRNPSRNNVPCSPKVDFTLSSERDFALLSLQVPLKDAKSCGLHQLLRGPEVQLVAHSPWLKDSLSRT

SEQ ID NO: 4320 - protein, 98 aa, Homo sapiens
  SIGNAL -39..-1: score 4.9 seq IILVGLLHMVLLS/IP
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTLP

SEQ ID NO: 4321 - protein, 92 aa, Homo sapiens
  SIGNAL -20..-1: score 3.5 seq IVLGTGLTECILS/GI
  UNSURE 43: Xaa=Pro or Thr
  UNSURE 51: Xaa=Asp or Glu
MNEEYDVIVLGTGLTECILSGIMSVNGKKVLHMDRNPYYGGESASITPLEDLYKRFKIPGSPXESMGRGRXWNVDLIPKFLMANGQLVKMLL

SEQ ID NO: 4322 - protein, 88 aa, Homo sapiens
  SIGNAL -15..-1: score 9.6 seq EYVLLLFLALCSA/KP
MKEYVLLLFLALCSAKPFFSPSHIALKNMMLKDMEDTDDDDDDDDDDDDDEDNSLFPTREPRSHFFPFDLFPMCPFGCQCYSRVVHCS

SEQ ID NO: 4323 - protein, 130 aa, Homo sapiens
  SIGNAL -23..-1: score 11.2 seq GLLLLLWGSCTFG/LP
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLF

SEQ ID NO: 4324 - protein, 115 aa, Homo sapiens
  SIGNAL -32..-1: score 5 seq LCLLSLLPSGFMS/LD
  UNSURE 33: Xaa=Gly or Ser
  UNSURE 60: Xaa=Ala or Glu or Gly or Leu or Pro or Gln or Arg or Val
  UNSURE 64: Xaa=Ser or Thr
  UNSURE 68: Xaa=Ser or Thr
MLVRRGARAGPRMPRGWTALCLLSLLPSGFMSLDNNGTATPELPTQGTFSNVSTNVSYQETTTPXTLGSTSLHPVSQHGNEATTNITETTVXFTSXSVIXSVYGNTNSSVQSQTS

SEQ ID NO: 4325 - protein, 80 aa, Homo sapiens
  SIGNAL -35..-1: score 3.6 seq LEPGLSSSAACNG/KE
MPFQFGTQPRRFPVEGGDSSIELEPGLSSSAACNGKEMSPTRQLRRCPGSHCLTITDVPVTVYATTRKPPAQSSKEMHPK

SEQ ID NO: 4326 - protein, 81 aa, Homo sapiens
  SIGNAL -26..-1: score 8.8 seq AVLVLLFVSTIVS/QW
MLLLLLSIIVLHVAVLVLLFVSTIVSQWIVGNGHATDLWQNCSTSSSGKCPPLFFIITKRMAAVCPGHHDPVDHLQHSVSV

SEQ ID NO: 4327 - protein, 51 aa, Homo sapiens
  SIGNAL -26..-1: score 8.8 seq AVLVLLFVSTIVS/QW
MLLLLLSIIVLHVAVLVLLFVSTIVSQWIVGNGHATDLWQNCSTSSSGNAH

SEQ ID NO: 4328 - protein, 66 aa, Homo sapiens
  SIGNAL -16..-1: score 10.5 seq LWRLVSLLALSQA/LP
  UNSURE 34: Xaa=Leu or Met or Val
MWPLWRLVSLLALSQALPFEQRGFWDFTLDDGPFMMNDEEASGADTSGVXDPDSVTPTHVTINYLY

SEQ ID NO: 4329 - protein, 146 aa, Homo sapiens
  SIGNAL -20..-1: score 6.6 seq SALAARLLQPAHS/CS
  UNSURE 13: Xaa=Ala or Asp or Gly or Val
MAATSLMSALAARLLQPAHSCSLRLRPFHLAAXRNEAVVISGRKLAQQIKQEVRQEVEEWVASGNKRPHLSGSWLARILQVTPMSSTKPRAAAVVGINSETIMKPASISEEELLNLINKLNNDDNVDGLLVQLPLPEHIDERRICN

SEQ ID NO: 4330 - protein, 72 aa, Homo sapiens
  SIGNAL -20..-1: score 10.6 seq LLLLLPLVHVSAT/TP
MERASCLLLLLLPLVHVSATTPEPCELDDEDFRCVCNFSEPQPDWSEAFQCVSAVEVEIHAGGLNLEPFLKR

SEQ ID NO: 4331 - protein, 104 aa, Homo sapiens
  SIGNAL -15..-1: score 12.6 seq WLLLLGLVALSEC/IM
  UNSURE 79: Xaa=Asp or His or Asn or Tyr
MKWLLLLGLVALSECIMYKVPLIRKKSLRRTLSERGLLKDFLKKHNLNPARKYFPQWEAPTLVDEQPLENYLDMEYFGTIGIGTPAQDFTVVFXTGSSNLWVPS

SEQ ID NO: 4332 - protein, 97 aa, Homo sapiens
  SIGNAL -19..-1: score 5.9 seq ALMYLGSLAFLGA/DT
MKLVSVALMYLGSLAFLGADTARLDVASEFRKKWNKWALSRGKRELRMSSSYPTGLADVKAGPAQTLIRPQDMKGASRSPEDSSPDAARIRVKRYRG

SEQ ID NO: 4333 - protein, 83 aa, Homo sapiens
  SIGNAL -24..-1: score 10.5 seq LVLVSMLALGTLA/EA
MATMENKVICALVLVSMLALGTLAEAQTETCTVAPRERQNCGFPGVTPSQCANKGCCFDDTVRGVPWCFYPNTIDVPPEEECE

SEQ ID NO: 4334 - protein, 104 aa, Homo sapiens
  SIGNAL -28..-1: score 5.3 seq ASCLVLAARHASA/SS
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKL

SEQ ID NO: 4335 - protein, 65 aa, Homo sapiens
  SIGNAL -17..-1: score 11.5 seq LLPILLLSGWAFC/SQ
MLTTLLPILLLSGWAFCSQDASDGLQRLHMLQISYFRDPYHVWYQGNASLGGHLTHVLEGPDTNT

SEQ ID NO: 4336 - protein, 68 aa, Homo sapiens
  SIGNAL -27..-1: score 5.7 seq LVSLFCSCFLADP/LN
  UNSURE 33: Xaa= *  or Gly or Arg
MTLAAYKEKMKELPLVSLFCSCFLADPLNKSSYKYEGWCGRQCRRKDESQRKDSADWREXRAQADTVD

SEQ ID NO: 4337 - protein, 129 aa, Homo sapiens
  SIGNAL -23..-1: score 10.6 seq CMLLLAFSSWSLC/SD
  UNSURE 87: Xaa=Ile or Lys or Met or Asn or Arg or Ser or Thr
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKXCHSRAFQHWELIQEDILDT

SEQ ID NO: 4338 - protein, 131 aa, Homo sapiens
  SIGNAL -31..-1: score 11.5 seq LLLFLLGPRLVLA/IS
  UNSURE 41: Xaa=Ser or Thr
MSGLSGPPARRGPFPLALLLLFLLGPRLVLAISFHLPINSRKCLREEIHKDLLVTGAYEISDQSGGAGGLRXTSRSQILLAIFSTPKRMQPRGNLPLPLKIMTCLKCVLRAREQGTGRIPDQLVILDMKHG

SEQ ID NO: 4339 - protein, 107 aa, Homo sapiens
  SIGNAL -13..-1: score 3.5 seq MAATLLAARGAGP/AP
  UNSURE 22: Xaa=Pro or Ser
MAATLLAARGAGPAPAWGPEGSLQTGKAEKFPLGXYIANRVTDKLTPIHDRIFCCRSGSAADTQAVADAVTYQLGFHSIELNEPPLVHTAASLFKEMCYRYREDLMA

SEQ ID NO: 4340 - protein, 90 aa, Homo sapiens
  SIGNAL -14..-1: score 15 seq LLPLLLLLPMCWA/VE
MLLPLLLLLPMCWAVEVKRPRGVSLTNHHFYDESKPFTCLDGSATIPFDQVNDDYCDCKDGSDEPGTAACPNGSFHCTNTGYKPLYIPSN

SEQ ID NO: 4341 - protein, 109 aa, Homo sapiens
  SIGNAL -19..-1: score 8.1 seq LLGVLVVSPDALG/ST
  UNSURE 85: Xaa= *  or Ser
MATLLLLLGVLVVSPDALGSTTAVQTPTSGEPLVSTSEPLSSKMYTTSITSDPKADSTGDQTSALPPSTSINEGSPLWTSIGASTGSPLPEPTTYQEVSIKMSXVPQET

SEQ ID NO: 4342 - protein, 59 aa, Homo sapiens
  SIGNAL -21..-1: score 11.2 seq LLCLFSLLTQVTT/EP
MELWGAYLLLCLFSLLTQVTTEPPTQKPKKIVNAKKDVVNTKMFEELKSRLDTLAQEVA

SEQ ID NO: 4343 - protein, 51 aa, Homo sapiens
  SIGNAL -36..-1: score 5.4 seq LLCYPGWSAVAQS/QL
MIQATSLSSLILGFSFLFFEDGVLLCYPGWSAVAQSQLTAASVFWDQVILP

SEQ ID NO: 4344 - protein, 155 aa, Homo sapiens
  SIGNAL -36..-1: score 10.1 seq SFVVLALFAVTQA/EE
MLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSALDREESWLS

SEQ ID NO: 4345 - protein, 148 aa, Homo sapiens
  SIGNAL -36..-1: score 10.1 seq SFVVLALFAVTQA/EE
MLTLSSCLCGSGKAFGMPTMRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKALGIPLHLAYNSSLVTFQEPPGVNTTELPS

SEQ ID NO: 4346 - protein, 86 aa, Homo sapiens
  SIGNAL -41..-1: score 3.9 seq ALFLCGCYVVALG/AH
MAHAHIQGGRRAKSRFVVCIMSGARSKLALFLCGCYVVALGAHTGEESVADHHEAEYYVAAVYEHPSILSLNPLALISRQEALELM

SEQ ID NO: 4347 - protein, 59 aa, Homo sapiens
  SIGNAL -16..-1: score 4.3 seq ALPAAGFLYWVGA/GT
MESALPAAGFLYWVGAGTVAYLALRISYSLFTALRVWGVGNEAGVGRGSENGQLSQVVL

SEQ ID NO: 4348 - protein, 102 aa, Homo sapiens
  SIGNAL -30..-1: score 7.3 seq LKLLILSMAAVLS/FS
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHV

SEQ ID NO: 4349 - protein, 78 aa, Homo sapiens
  SIGNAL -33..-1: score 9.5 seq LLLGLVMPLAIIA/QV
MGTMKTQRDGHSLGRWSLVLLLLGLVMPLAIIAQVLSYKEAVLRAIDGINQRSSDANLYRLLDLDPRPTMVSFGGHSA

SEQ ID NO: 4350 - protein, 118 aa, Homo sapiens
  SIGNAL -27..-1: score 7.2 seq VLWLSGLSEPGAA/RQ
  UNSURE 48: Xaa=Asp or Glu
  UNSURE 53: Xaa=Ile or Lys or Met or Asn or Arg or Ser or Thr
  UNSURE 59: Xaa=Ala or Thr
MQRVSGLLSWTLSRVLWLSGLSEPGAARQPRIMEEKALEVYDLIRTIRDPEKPNTLEELEVVSESCVEVQEINEXEYLVXIRFTPXVPHCSLATLIGLCLRVKLQRCLPFKHKLEIYI

SEQ ID NO: 4351 - protein, 106 aa, Homo sapiens
  SIGNAL -24..-1: score 10 seq LLLLQALPSPLSA/RA
MERRRLLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYR

SEQ ID NO: 4352 - protein, 51 aa, Homo sapiens
  SIGNAL -21..-1: score 14.3 seq LLLCAVLLSLASA/SS
MRVRIGLTLLLCAVLLSLASASSGQYPPPRAEGPEPPPPSLYSRRGRGDSR

SEQ ID NO: 4353 - protein, 144 aa, Homo sapiens
  SIGNAL -47..-1: score 7.1 seq SLLFLLMGLRASG/KD
  UNSURE 82: Xaa= *  or Tyr
  UNSURE 89: Xaa=Gly or Arg
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSXKAQINQXNFEVTTEE

SEQ ID NO: 4354 - protein, 115 aa, Homo sapiens
  SIGNAL -26..-1: score 10 seq LWLALVSCILTQA/SA
MPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVMPTCETQLQQHLA

SEQ ID NO: 4355 - protein, 99 aa, Homo sapiens
  SIGNAL -26..-1: score 10 seq LWLALVSCILTQA/SA
  UNSURE 7: Xaa=Asn or Tyr
  UNSURE 9: Xaa=Asp or Asn
  UNSURE 59: Xaa= *  or Leu or Ser
  UNSURE 72: Xaa=Gly or Arg
MPHLMERMVGSGLLWLALVSCILTQASAVQRGXGXPIEASMYGLDLDSGAPGTPEAHVCFDPCQNYTILDEPFRSTENSAGGVRXKHERLVPLCRGRXS

SEQ ID NO: 4356 - protein, 51 aa, Homo sapiens [sequence omitted]

SEQ ID NO: 4357 - protein, 92 aa, Homo sapiens
  SIGNAL -23..-1: score 9.1 seq GLLAAGFCPAVLC/HP
  UNSURE -15: Xaa=Ala or Thr
MERMLPLLXLGLLAAGFCPAVLCHPNSPLDEENLTQENQDRGTHVDLGLASANVDFAFSLYKLGVRLRDRGVLGRWEAQGEEESEEGIHCGG

SEQ ID NO: 4358 - protein, 162 aa, Homo sapiens
  SIGNAL -23..-1: score 9.1 seq GLLAAGFCPAVLC/HP
  UNSURE -15: Xaa=Ala or Thr
  UNSURE 113: Xaa=Gly or Ser
  UNSURE 119: Xaa=Asp or Val
  UNSURE 121: Xaa= *  or Leu or Pro or Gln or Arg or Ser
MERMLPLLXLGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLXMGKCHXCXRATQSAGQVHGGCQEAVW

SEQ ID NO: 4359 - protein, 92 aa, Homo sapiens
  SIGNAL -23..-1: score 9.1 seq GLLAAGFCPAVLC/HP
MERMLPLLTLGLLAAGFCPAVLCHPNSPLDEENLTQENQDRGTHVDLGLASANVDFAFSLYKLGVRLRDRGVLGRWEAQGEEESEEGIHCGG

SEQ ID NO: 4360 - protein, 162 aa, Homo sapiens
  SIGNAL -23..-1: score 9.1 seq GLLAAGFCPAVLC/HP
  UNSURE 113: Xaa=Gly or Ser
  UNSURE 119: Xaa=Asp or Val
  UNSURE 121: Xaa= *  or Leu or Pro or Gln or Arg or Ser
MERMLPLLTLGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLXMGKCHXCXRATQSAGQVHGGCQEAVW

SEQ ID NO: 4361 - protein, 72 aa, Homo sapiens
  SIGNAL -19..-1: score 9.8 seq LLILQALLLPSLA/DG
MDMWTALLILQALLLPSLADGATPALRFVAVGDWGGVPNAPFHTAREMANAKEIARTVQILGADFILSLGDN

SEQ ID NO: 4362 - protein, 113 aa, Homo sapiens
  SIGNAL -45..-1: score 6.8 seq IMVLVVAAESVWG/DE
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGMGT

SEQ ID NO: 4363 - protein, 57 aa, Homo sapiens
  SIGNAL -16..-1: score 3.7 seq VVIGAGVIGLSTA/LC
  UNSURE 25: Xaa=Pro or Gln
  UNSURE 40: Xaa=Leu or Val
MRVVVIGAGVIGLSTALCIHERYHSVLQPLDIKVYADRFTXLTTTDVAAGLWQPYXS

SEQ ID NO: 4364 - protein, 121 aa, Homo sapiens
  SIGNAL -22..-1: score 6.5 seq SLLFLQLPLLGVG/LN
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKE

SEQ ID NO: 4365 - protein, 78 aa, Homo sapiens
  SIGNAL -21..-1: score 8.6 seq FTLCLLLSEMASG/GN
MRTSYLLLFTLCLLLSEMASGGNFLTGLGHRSDHYNCVSSGGQCLYSACPIFTKIQGTCYEGRPSAASELGVTRRNDA

SEQ ID NO: 4366 - protein, 54 aa, Homo sapiens
  SIGNAL -18..-1: score 7.7 seq AFLFLLGVLGALT/EM
MRHLGAFLFLLGVLGALTEMCEIPEMDSHLVEKLGQHLLPWMDRLSLEHLNPSI

SEQ ID NO: 4367 - protein, 71 aa, Homo sapiens [sequence omitted]

SEQ ID NO: 4368 - protein, 142 aa, Homo sapiens
  SIGNAL -24..-1: score 5.3 seq CLPVLAAAGRARG/RA
  UNSURE 93: Xaa=Met or Val
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSXRRALTHIDHSLSRQTVLSWLGRQNL

SEQ ID NO: 4369 - protein, 100 aa, Homo sapiens
  SIGNAL -19..-1: score 5.7 seq GLLVLTTPLASLA/PR
  UNSURE 36: Xaa=Ser or Tyr
MAVFRSGLLVLTTPLASLAPRLASILTSAARLVNHTLYVHLQPGMSLEGPAQPQXSPVQATFEVLDFITHLYAGADVHRHLDVRILLTNIRTKSTFLPPL

SEQ ID NO: 4370 - protein, 96 aa, Homo sapiens
  SIGNAL -16..-1: score 7.7 seq TLLLSLLGAVGLA/AV
MQPTLLLSLLGAVGLAAVNSMPVDNRNHNEGMVTRCIIEVLSNALSKSSAPPITPECRQVLKTSRKDVKDKETTENENTKFEVRLLRDPADATEAH

SEQ ID NO: 4371 - protein, 92 aa, Homo sapiens
  SIGNAL -13..-1: score 3.8 seq MAHCVTLVQLSIS/CD
MAHCVTLVQLSISCDHLIDKDIGSKSDPLCVLLQDVGGGSWAELGRTERVRNCSSPEFSKTLQLEYRFETVQKLRFGIYDIDNKTPELRDDD

SEQ ID NO: 4372 - protein, 79 aa, Homo sapiens
  SIGNAL -15..-1: score 5.2 seq WSCLVTGAGGLLG/QR
  UNSURE 56: Xaa=Ala or Gly
MGWSCLVTGAGGLLGQRIVRLLVEEKELKEIRALDKAFRPELREEFSKLQNRTKLTVLEGDILDEPFLKRXCQDVSVVI

SEQ ID NO: 4373 - protein, 132 aa, Homo sapiens
  SIGNAL -21..-1: score 13.2 seq VLLLSLFLLGGQA/QH
MCSTMRALVLLLSLFLLGGQAQHVSDWTYSEGALDEAHWPQHYPACGGQRQSPINLQRTKVRYNPSLKGLNMTGYETQAGEFPMVNNGHTVQISLPSTMRMTVADGTVYIAQQMHFHWGGASSEISGSEHTV

SEQ ID NO: 4374 - protein, 63 aa, Homo sapiens
  SIGNAL -20..-1: score 5.1 seq FILLWSAVGIAKA/AK
MKSYTPYFILLWSAVGIAKAAKIIIVPPIMFESHMYIFKTLASALHERGHHTVFLLSEGRDIA

SEQ ID NO: 4375 - protein, 83 aa, Homo sapiens
  SIGNAL -21..-1: score 7.6 seq LTPLLCVLHGACP/RA
  UNSURE 49: Xaa=Asn or Ser
MEFEGTFSLTPLLCVLHGACPRASANSSISSHSVLGTIPGLCWRDETAVEMKTGCRGWHSWPAFLHLGNXPTPRTLHTSSSHR

SEQ ID NO: 4376 - protein, 120 aa, Homo sapiens
  SIGNAL -19..-1: score 7.6 seq LPVLLVPFLLCQA/LV
  UNSURE 89: Xaa=Ile or Met
MARKSNLPVLLVPFLLCQALVRCSSPLPLVVNTWPFKNATEAAWRALASGGSALDAVESGCAMCEREQCDGSVGFGGSPDELGETTLDAMIMDGTTMDVGAVGDLRRXKNAIGVARKVLE

SEQ ID NO: 4377 - protein, 53 aa, Homo sapiens
  SIGNAL -31..-1: score 4.5 seq LLSLPSWASLAYS/YL
MEPPPADSKPAEGRRHPGLLSLPSWASLAYSYLPGPLHSCLGGPYEGSPAPAP

SEQ ID NO: 4378 - protein, 76 aa, Homo sapiens
  SIGNAL -39..-1: score 4.8 seq IILFSAIVGFIYG/YV
  UNSURE 32: Xaa=His or Arg
MLEHLSSLPTQMDYKGQKLAEQMFQGIILFSAIVGFIYGYVAEQFGWTVYIVMAGFAFSCLLTLPPWPIYXRHPLK

SEQ ID NO: 4379 - protein, 112 aa, Homo sapiens
  SIGNAL -41..-1: score 4.3 seq RVVSWLFSIVVFG/SI
MEGGAYGAGKAGGAFDPYTLVRQPHTILRVVSWLFSIVVFGSIVNEGYLNSASEGEEFCIYNRNPNACSYGVAVGVLAFLTCLLYLALDVYFPQISSVKDRKKAVLSDIGVS

SEQ ID NO: 4380 - protein, 68 aa, Homo sapiens
  SIGNAL -15..-1: score 7 seq LLFLLPLVMQGVS/RA
MALLFLLPLVMQGVSRAEMGTADLGPSSVPTPTNVTIESYNMNPIVYWEYQIMPQVPVFTVEVKNYGV

SEQ ID NO: 4381 - protein, 68 aa, Homo sapiens
  SIGNAL -33..-1: score 11.5 seq LLSLCCLLPSCLP/AG
MDMMLLVQGACCSNQWLAAVLLSLCCLLPSCLPAGQSVDFPWAAVDNMMVRKGDTAVLRCYLEDGASK

SEQ ID NO: 4382 - protein, 82 aa, Homo sapiens
  SIGNAL -47..-1: score 6.8 seq PLGLLRLLQLVST/CV
MPVTVTRTTITTTTTSSSGLGSPMIVGSPRALTQPLGLLRLLQLVSTCVAFSLVASVGAWTGSMGNWSMFTWCFCFSVTLII

SEQ ID NO: 4383 - protein, 72 aa, Homo sapiens
  SIGNAL -15..-1: score 11.7 seq SLVLLLCLAQLWG/CH
MKSLVLLLCLAQLWGCHSAPHGPGLIYRQPNCDDPETEEAALVAIDYINQNLPWGYKHTLNQIDEVKVWPQQ

SEQ ID NO: 4384 - protein, 69 aa, Homo sapiens
  SIGNAL -19..-1: score 5.4 seq LSHLLPSLRQVIQ/EP
  UNSURE 10: Xaa=Leu or Met or Pro or Thr
  UNSURE 32: Xaa= *  or Tyr
MAMAQKLSHLLPSLRQVIQEPQLSLQPEXVFTVDRAEVPPLFWKPYIYAGXRPLHQTWRFYFRTLFQQH

SEQ ID NO: 4385 - protein, 83 aa, Homo sapiens
  SIGNAL -23..-1: score 7.9 seq LGLWSLCWSLAIA/TP
  UNSURE 51: Xaa=Cys or Phe
MARVLGAPVALGLWSLCWSLAIATPLPPTSAHGNVAEGETKPDPDVTERCSDGWSFDATTLDDNGTMLFFKGEXVWKSHKWDR

SEQ ID NO: 4386 - protein, 83 aa, Homo sapiens
  SIGNAL -19..-1: score 7.6 seq FALFSCLFGICDA/VT
MAGIFYFALFSCLFGICDAVTGSRVYPANEVTLLDSRSVQGELGWIASPLEGGWEEVSIMDEKNTPIRTYLGGCCFEGSYAYF

SEQ ID NO: 4387 - protein, 89 aa, Homo sapiens
  SIGNAL -39..-1: score 11.6 seq GLLLLQAVSWASG/AR
MEFSSPSREECPKPLSRVSIMAGSLTGLLLLQAVSWASGARPCIPKSFGYSSVVCVCNATYCDSFDPPTFPALGTFSRYESTRSGDGWS

SEQ ID NO: 4388 - protein, 68 aa, Homo sapiens
  SIGNAL -37..-1: score 5 seq PACLSPSPHLSSA/AN
MANRYTMDLTAIYEVSPRRTASPVPACLSPSPHLSSAANSSPGRLPPFSNWGSLAPRPPAWGPCLPLR

SEQ ID NO: 4389 - protein, 136 aa, Homo sapiens
  SIGNAL -17..-1: score 8.7 seq RLVCAFLLAACCC/CP
  UNSURE 100: Xaa=Lys or Met or Arg or Thr
  UNSURE 101: Xaa= *  or Leu or Ser or Trp
  UNSURE 102: Xaa= *  or Glu or Lys or Gln
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCXXXAPSVPGVPHPAPRLQSS

SEQ ID NO: 4390 - protein, 59 aa, Homo sapiens
  SIGNAL -21..-1: score 4 seq AACTAAAPLQAHG/AD
  UNSURE 23: Xaa=Gly or Arg
  UNSURE 25: Xaa=Leu or Met
MMRTTARVAACTAAAPLQAHGADIQQDPDSLCSRRLSREGLSAXRXHQSETEAELEAPG

SEQ ID NO: 4391 - protein, 123 aa, Homo sapiens
  SIGNAL -20..-1: score 3.5 seq IVLGTGLTECILS/GI
MDEEYDVIVLGTGLTECILSGIMSVNGKKVLHMDRNPYYGGESSSITPLEELYKRFQLLEGPPESMGRGRDWNVDLIPKFLMANGQLVKMLLYTEVTRYLDFKVVEGSFVYKGGKIYKVPSTE

SEQ ID NO: 4392 - protein, 58 aa, Homo sapiens
  SIGNAL -25..-1: score 12.2 seq LLTACALLPFAQG/QT
MLPAATASLLGPLLTACALLPFAQGQTPNYTRPVFLCGGDVKGESGYVASEGFPNLYP

SEQ ID NO: 4393 - protein, 65 aa, Homo sapiens
  SIGNAL -43..-1: score 4.1 seq VLITQLCLGKGQS/EP
MLWETDLSTNKTPVSCTAGSACALSLLQFPVLITQLCLGKGQSEPIGPLQDFVSLESTSHFYSFF

SEQ ID NO: 4394 - protein, 81 aa, Homo sapiens
  SIGNAL -16..-1: score 6 seq LTALPLFWIMISA/SR
MIFLTALPLFWIMISASRGGHWGAWMPSSISAFEGTCVSIPCRFDFPDELRPAVVHGVWYFNSPYPKNYPPVVFKSRTQVV

SEQ ID NO: 4395 - protein, 85 aa, Homo sapiens
  SIGNAL -18..-1: score 11.9 seq ALLFLILANGAQA/FR
MHYPTALLFLILANGAQAFRICAFNAQRLTLAKVAREQVMDTLVRILARCDIMVLQEVVDSSGSAIPLLLRELNRFDGSGPYSTL

SEQ ID NO: 4396 - protein, 110 aa, Homo sapiens
  SIGNAL -18..-1: score 9.9 seq SLLLAALLLLLSG/DG
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEE

SEQ ID NO: 4397 - protein, 80 aa, Homo sapiens
  SIGNAL -16..-1: score 4.6 seq LFPLIFPAEPAQA/SG
  UNSURE 42: Xaa=His or Gln
  UNSURE 44: Xaa=Ser or Thr
  UNSURE 45: Xaa=Ile or Met
  UNSURE 59: Xaa=Ser or Tyr
MDELFPLIFPAEPAQASGPYVEIIEQPKQRGMRFRYKCEGRSAGSIPGERSTDTTKTXPXXKINGYTGPGTVRIXLVTKD

SEQ ID NO: 4398 - protein, 108 aa, Homo sapiens
  SIGNAL -32..-1: score 7.2 seq YMLVSLLLIGVAA/WG
  UNSURE 25: Xaa=Leu or Val
  UNSURE 26: Xaa=Leu or Arg
  UNSURE 39: Xaa=His or Gln
MVCGGFACSKNALCALNVVYMLVSLLLIGVAAWGKGLGLVSSIHIIGGVIAVGVFLXXIAVAGLVGAVNHXQVLLFFYMIILGLVFIFQFVISCSCLAINEANRQMSS

SEQ ID NO: 4399 - protein, 72 aa, Homo sapiens
  SIGNAL -41..-1: score 4.3 seq VASFFHLFFRVSA/II
MMTLKMFHCFDAEEETTNRPRKAKIRHPVASFFHLFFRVSAIIVYLLCGLLSSSFITCMVTIILLLSCDFWA

SEQ ID NO: 4400 - protein, 54 aa, Homo sapiens
  SIGNAL -29..-1: score 3.6 seq VMLLVALPCFLQN/CP
MYVIVDKTPRDSFQQKVMLLVALPCFLQNCPWSSRVLETLCLLNGPLFLCCALD

SEQ ID NO: 4401 - protein, 103 aa, Homo sapiens
  SIGNAL -24..-1: score 4.3 seq LXFLGMFLSGMVA/QI
  UNSURE -20: Xaa=Gly or Val
  UNSURE -18: Xaa=Ala or Thr
  UNSURE -14: Xaa=Ala or Ser
  UNSURE -12: Xaa=Leu or Arg
  UNSURE 45: Xaa=Gly or Arg
MFVSXTXFFFXLXFLGMFLSGMVAQIDANWNFLDFAYHFTVFVFYFGAFLLEAAATSLHDLHCNTTITXQPLLSDNQYNINVAASIFAFMTTACYGCSLGLAL

SEQ ID NO: 4402 - protein, 58 aa, Homo sapiens
  SIGNAL -19..-1: score 9.6 seq FCILLAAVSGAEG/WG
  UNSURE 7: Xaa=Asp or His or Asn or Tyr
MMHLRLFCILLAAVSGAEGWGYYGCXEELVGPLYARSLGASSYYSLLTAPRFARLHGI

SEQ ID NO: 4403 - protein, 92 aa, Homo sapiens
  SIGNAL -28..-1: score 5.5 seq FLAIVYFCTIVQG/QV
  UNSURE -16: Xaa=His or Leu or Pro or Arg
MKIFQRKMRYWLXPPFLAIVYFCTIVQGQVAPPTRLRYNVISHDSIQISWKAPRGKFGGYKLLVTPTSGGKTNQLNLQNTATKAIIQGLMPD

SEQ ID NO: 4404 - protein, 95 aa, Homo sapiens [sequence omitted]

SEQ ID NO: 4405 - protein, 61 aa, Homo sapiens
  SIGNAL -14..-1: score 3.8 seq LLVSAAPLGFGQG/VW
  UNSURE 12: Xaa= *  or Tyr
MLLVSAAPLGFGQGVWNRASQLQQGXDPLGLEGAGEASASCHRLLVLALAQAFTHTHAHTH

SEQ ID NO: 4406 - protein, 51 aa, Homo sapiens
  SIGNAL -36..-1: score 4.4 seq WLLFCTNQSLSLS/PP
MSTSAPPLSLILGGCPILFLQFYWLLFCTNQSLSLSPPHLSPLPSPSPSPA

SEQ ID NO: 4407 - protein, 66 aa, Homo sapiens
  SIGNAL -26..-1: score 12 seq LLLALLLPTQIYS/SE
MGRAMVARLGLGLLLLALLLPTQIYSSETTTGTSSNSSQSTSNSGLAPNPTNATTKAAGGALQSTA

SEQ ID NO: 4408 - protein, 89 aa, Homo sapiens
  SIGNAL -40..-1: score 6.4 seq RGSLLLAVAGATS/LV
MKAPCSGSGSVSMGALGLEGRGGRLQGRGSLLLAVAGATSLVTLLLAVPITVLAVLALVPQDQGGLVTETADPGAQAQQGLGFQKLPEE

SEQ ID NO: 4409 - protein, 65 aa, Homo sapiens
  SIGNAL -34..-1: score 7.5 seq FVFFVFFLRQSLA/LL
  UNSURE -31: Xaa=Cys or Ser
MAHXATLPCDHVSQFSLINFFFVFFVFFLRQSLALLPRLECRGTISAHCNLHLPGSRHSPASAPA

SEQ ID NO: 4410 - protein, 105 aa, Homo sapiens
  SIGNAL -42..-1: score 8.1 seq LFCFLLLCLSAAS/LL
MVPWVRTMGQKLKQRLRLDVGREICRQYPLFCFLLLCLSAASLLLNRYIHILMIFWSFVAGVVTFYCSLGPDSLLPNIFFTIKYKPKQLGLQELFPQGHSCAVCG

SEQ ID NO: 4411 - protein, 51 aa, Homo sapiens
  SIGNAL -47..-1: score 3.5 seq CLXFGILASEVYS/WN
  UNSURE -11: Xaa=Gly or Val
MYHNLFALLLIDIHVVLVFYCLDLLMIHIFYCKYCLXFGILASEVYSWNIY

SEQ ID NO: 4412 - protein, 72 aa, Homo sapiens
  SIGNAL -21..-1: score 3.5 seq WLCVCVFSCVGFL/KK
MFLLGNKRWLCVCVFSCVGFLKKWEEEKKILRPFPRSRSPLRFFRPVPPPFFVLFCFVLLRVHIPVCNPWFA

SEQ ID NO: 4413 - protein, 55 aa, Homo sapiens
  SIGNAL -20..-1: score 7.9 seq FLFFIYFLRWSLA/LS
  UNSURE 22: Xaa=Pro or Ser
MAYLVVYFLFFIYFLRWSLALSPRLECSGAILSHCNLCHLGXRNSPASAYLVAGC

SEQ ID NO: 4414 - protein, 78 aa, Homo sapiens [sequence omitted]

SEQ ID NO: 4415 - protein, 65 aa, Homo sapiens [sequence omitted]

SEQ ID NO: 4416 - protein, 163 aa, Homo sapiens
  SIGNAL -28..-1: score 4.2 seq CLETLAVPSECSA/FS
  UNSURE 133: Xaa=Leu or Pro or Gln or Arg
MLIMPKALKEESEDTCLETLAVPSECSAFSENIEDPGEGPSNPCLDTSQNQPSMESEMGAAACPGSCSRECEVSFSASNPVWDYSHLMSSERNFQRLDFEELEEEGQASDKSLLPSRINLSLLDDDEEDEELPRFILHYETHPFETGMIVWFKYQKYPFWXAE

SEQ ID NO: 4417 - protein, 77 aa, Homo sapiens
  SIGNAL -31..-1: score 4.5 seq VAFGLYNPSLCHA/CT
MPLPKPSFSNNHLIRLITVAFGLYNPSLCHACTRCSTASVSHQIAHSPKQKPSNLGAIQGLAQCLVEHMCCRINIDT

SEQ ID NO: 4418 - protein, 69 aa, Homo sapiens
  SIGNAL -32..-1: score 3.8 seq IRTATLVISLARG/WQ
MAPGEKESGEGPAKSALRKIRTATLVISLARGWQQWANENSIRQAQEPTGWLPGGTQDSPQAPKPITPR

SEQ ID NO: 4419 - protein, 72 aa, Homo sapiens
  SIGNAL -36..-1: score 6.7 seq LELLSSGCLPASA/SQ
MESHLSIFVFLVETSFCHVGQAGLELLSSGCLPASASQSAGITGVSHRTQPDWLKKIFLIKKRKENYIEKGR

SEQ ID NO: 4420 - protein, 91 aa, Homo sapiens
  SIGNAL -20..-1: score 7.9 seq TVTLALVLAVAWA/ME
MRAGPGPTVTLALVLAVAWAMELKPTAPPIFTGRPFVVAWDVPTQDCGPRLKVPLDLNAFDVQASPNEGFVNQNITIFYRDRLGLYPRFDS

SEQ ID NO: 4421 - protein, 92 aa, Homo sapiens
  SIGNAL -26..-1: score 6.5 seq LALGSAGLLWCLA/GF
  UNSURE 41: Xaa=Asp or Asn
MVFATIGFSLKSGLALGSAGLLWCLAGFFGYDTQQPTAPNAIEGYRVMSSFGVGALFAACTICLLAXKLNKQTTLKMADDLAQRRQQADLAP

SEQ ID NO: 4422 - protein, 57 aa, Homo sapiens
  SIGNAL -20..-1: score 4.3 seq FNFLFLVQLCILA/CD
MLTNRNYFNFLFLVQLCILACDNAYLQSCPLTSKTPLLQTHSALFYNSTYGIFLLLG

SEQ ID NO: 4423 - protein, 111 aa, Homo sapiens
  SIGNAL -28..-1: score 9.8 seq LLPLSLLVTSIQG/HL
  UNSURE 45: Xaa=Glu or Gly or Lys or Arg
  UNSURE 78: Xaa=Ser or Thr
MCSRGWDSCLALELLLLPLSLLVTSIQGHLVHMTVVSGSNVTLNISESLPENYKQLTWFYTFDQKIVEWDSRXSKYFESKFKGRVRLDPQSGALYISKVQKEDNSXYIMRV

SEQ ID NO: 4424 - protein, 56 aa, Homo sapiens
  SIGNAL -19..-1: score 4.8 seq ATYLVQSSACCPA/IV
  UNSURE 8: Xaa=Leu or Ser or Trp
  UNSURE 20: Xaa=Asp or Glu
MASPAAATYLVQSSACCPAIVRHLCQXYRSMPVFLDPAXIATLEGISWRLPSAPSD

SEQ ID NO: 4425 - protein, 64 aa, Homo sapiens
  SIGNAL -14..-1: score 4.4 seq HIFFLSFFIETDS/HS
  UNSURE 10: Xaa= *  or Trp
  UNSURE 29: Xaa=Leu or Val
  UNSURE 41: Xaa=Pro or Ser
MHIFFLSFFIETDSHSVAQAGVQXRDLGSLQAPLPGFTPFSCXSLPSSWDYRCPXPCPANFFCI

SEQ ID NO: 4426 - protein, 115 aa, Homo sapiens
  SIGNAL -23..-1: score 3.7 seq FLPPLXRAFACRG/CQ
  UNSURE -8: Xaa=Cys or Ser
MVVLRAGKKTFLPPLXRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHS

SEQ ID NO: 4427 - protein, 55 aa, Homo sapiens
  SIGNAL -34..-1: score 3.8 seq RWASSCLHPSARS/SN
  UNSURE 12: Xaa=Ser or Trp
MEAATTLHPGPRPALPLGARARWASSCLHPSARSSNPAGKSSRTPXLSSTRSGPG

SEQ ID NO: 4428 - protein, 102 aa, Homo sapiens
  SIGNAL -37..-1: score 8.5 seq LLVLLLYAPVGFC/LL
  UNSURE 5: Xaa=Gly or Arg
MELPSGPGPERLFDSHRLPGDCFLLLVLLLYAPVGFCLLVLXLFLGIHVFLVSCALPDSVLRRFVVRTMCAVLGLVARQEDSGLRDHSVRVLISNHVTPFDH

SEQ ID NO: 4429 - protein, 61 aa, Homo sapiens
  SIGNAL -20..-1: score 10.5 seq PLALCLLAAPASA/LV
MQPSSLLPLALCLLAAPASALVRIPLHKFTSIRRTMSEVGGSVEDLIAKGPSHTHPHTRPP

SEQ ID NO: 4430 - protein, 52 aa, Homo sapiens
  SIGNAL -25..-1: score 6.5 seq LGSLSXXVWPAWP/CR
  UNSURE -8: Xaa=Gly or Val
  UNSURE -7: Xaa= *  or Leu or Gln
  UNSURE 18: Xaa=Lys or Gln
  UNSURE 19: Xaa=Asn or Thr
MAHLGAESQASSLGSLSXXVWPAWPCRSPMKATPWSDGHEASXXPWQKTESA

SEQ ID NO: 4431 - protein, 53 aa, Homo sapiens
  SIGNAL -14..-1: score 3.8 seq YCFFAKFVSLSHS/LP
MYCFFAKFVSLSHSLPDEKHPLFTRKSKPRVSPQTFPTYTSMSFLPSPPVQPQ

SEQ ID NO: 4432 - protein, 100 aa, Homo sapiens
  SIGNAL -16..-1: score 10.9 seq RVLLLTALTLCHG/FN
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPP

SEQ ID NO: 4433 - protein, 108 aa, Homo sapiens
  SIGNAL -20..-1: score 8.4 seq FSLTVLFLRQSFA/HV
MSRTQLQFSLTVLFLRQSFAHVTQAGVQWHGLGSLQPPPPRFKLLSCLSPQVGGITGTCHHAQLIFVFLIEMGFHHVGQAGLELLTSGDPPTSASQPAGIIGMNHHAQ

SEQ ID NO: 4434 - protein, 56 aa, Homo sapiens
  SIGNAL -20..-1: score 8.4 seq FSLTVLFLRQSFA/HV
  UNSURE 9: Xaa=Gly or Leu or Val or Trp
  UNSURE 16: Xaa=Ala or Glu
MSRTQLQFSLTVLFLRQSFAHVTQAGVQXAWSWITXTSTSQVQAIVLPQPPSRWDT

SEQ ID NO: 4435 - protein, 87 aa, Homo sapiens
  SIGNAL -23..-1: score 4.6 seq LELLTSGGSPASA/SQ
MGFLHVGQAGLELLTSGGSPASASQNAGITGMSHRTWPHFLFLIQNLTLSPRLEYSGAVSAHCNFCLWNSSSHLSLLSSWDYRYVPP

SEQ ID NO: 4436 - protein, 62 aa, Homo sapiens
  SIGNAL -25..-1: score 4 seq LLQELGLCMCLLS/AE
MSHCAQPKACPELLQELGLCMCLLSAEPSLHPWRWLRPLHTHNLLGPPGEVFFPFLSAKPPL

SEQ ID NO: 4437 - protein, 58 aa, Homo sapiens
  SIGNAL -29..-1: score 5.9 seq FSYISXFLSPVCG/CS
  UNSURE -8: Xaa=Cys or Gly
  UNSURE 26: Xaa=Phe or Leu
MKCLKVNPFLFLVFNFFSYISXFLSPVCGCSVCNLKHWENELLFPSPHFLPYKFXFLF

SEQ ID NO: 4438 - protein, 83 aa, Homo sapiens
  SIGNAL -36..-1: score 7.4 seq LCLLGSSDSPASA/SR
  UNSURE -20: Xaa= *  or Glu
MGGWILALSSKLECSSXILAHCNLCLLGSSDSPASASRVAGITGMCHHAWLIFVFLVEMGFHHVSQSGLKLLTSSNLPASASH

SEQ ID NO: 4439 - protein, 59 aa, Homo sapiens
  SIGNAL -19..-1: score 8.2 seq QVLALVLVAALWG/GT
MAASLGQVLALVLVAALWGGTQPLLKRASAGLQRVHEPTWAQQLLQEMKTLFLNTEYLM

SEQ ID NO: 4440 - protein, 55 aa, Homo sapiens
  SIGNAL -24..-1: score 3.8 seq XVFXFXFLXRXLX/XX
  UNSURE -13: Xaa=Phe or Leu
  UNSURE -10: Xaa=Cys or Gly
  UNSURE -8: Xaa=Leu or Trp
  UNSURE -5: Xaa=Lys or Arg
  UNSURE -3: Xaa=Ser or Thr
  UNSURE 0: Xaa=Leu or Pro
  UNSURE 1: Xaa=Leu or Trp
  UNSURE 2: Xaa=Pro or Ser
  UNSURE 11: Xaa=Ile or Thr
  UNSURE 15: Xaa= *  or Cys
  UNSURE 22: Xaa=Pro or Ser
MISNGKFFCFFXVFXFXFLXRXLXXXPRLECNGKXSAHXNLRLLSXSNSLASAPR

SEQ ID NO: 4441 - protein, 52 aa, Homo sapiens
  SIGNAL -37..-1: score 4.3 seq LELMASSDLPASA/SQ
MRHHTQLIFVFLVEMGFHYIGQADLELMASSDLPASASQSAGITGVTTMPRR

SEQ ID NO: 4442 - protein, 52 aa, Homo sapiens
  SIGNAL -22..-1: score 4.4 seq LVIPALWEAEVGG/SP
  UNSURE 16: Xaa=Glu or Lys or Gln
MFGRAWWLMLVIPALWEAEVGGSPELTSSSNPSVSASXSAGIAGMSHHAQTL

SEQ ID NO: 4443 - protein, 54 aa, Homo sapiens [sequence omitted]

SEQ ID NO: 4444 - protein, 52 aa, Homo sapiens
  SIGNAL -37..-1: score 4.3 seq LELMASSDLPASA/SQ
  UNSURE 10: Xaa=Ser or Thr
MRHHTQLIFVFLVEMGFHYIGQADLELMASSDLPASASQSAGITGVXTMPRR

SEQ ID NO: 4445 - protein, 77 aa, Homo sapiens
  SIGNAL -39..-1: score 4.2 seq SLALASLRLGITG/TR
  UNSURE 16: Xaa=Glu or Gly
MLLSPRLECSDAISAHCNLRLLGSNDSLALASLRLGITGTRRHPWLIFVFLVETXFRHVSQAGLELLTSGDPPTSAS

SEQ ID NO: 4446 - protein, 53 aa, Homo sapiens
  SIGNAL -32..-1: score 4.7 seq FVCLFVFKTESHS/VT
MTFKTPQNQERTALPQFCFFVCLFVFKTESHSVTQAGVQWCDLGSLQPLPPGF

SEQ ID NO: 4447 - protein, 57 aa, Homo sapiens
  SIGNAL -43..-1: score 4.5 seq LELLTSGDPPALA/SQ
MHHHAWLFIYLFLFLFFFSRDRFFHVGQAGLELLTSGDPPALASQTAGIIGMSHRAR

SEQ ID NO: 4448 - protein, 51 aa, Homo sapiens
  SIGNAL -33..-1: score 5.5 seq SLCLLTVAVLVLT/FK
  UNSURE 9: Xaa= *  or Leu
MGKKKIWTPSSYPMPSHKHVSLCLLTVAVLVLTFKSLIHFEXIFAYEIGVQ

SEQ ID NO: 4449 - protein, 70 aa, Homo sapiens
  SIGNAL -35..-1: score 6.3 seq LFFLDGVSLRAQA/GV
  UNSURE 11: Xaa=His or Leu or Gln or Arg
  UNSURE 12: Xaa=Pro or Ser
  UNSURE 32: Xaa=Arg or Ser
MSHHARPVMPFCFIFFVFQIFFLFFLDGVSLRAQAGVQWHDIGSLXXPPPWFKQFACLSLPSSWDYXRTP

SEQ ID NO: 4450 - protein, 53 aa, Homo sapiens
  SIGNAL -13..-1: score 4.9 seq MVVCACSSSCLRG/LR
  UNSURE 25: Xaa=Lys or Arg
  UNSURE 26: Xaa=Ala or Val
  UNSURE 28: Xaa=His or Gln
MVVCACSSSCLRGLRRENHLNLGSGSHSEPRSCHYTSXXGXQNETPSQKKKKK

SEQ ID NO: 4451 - protein, 54 aa, Homo sapiens
  SIGNAL -43..-1: score 3.7 seq VWCLXLKLVPALC/IS
  UNSURE -39: Xaa=Lys or Pro or Gln or Thr
  UNSURE -33: Xaa=Gly or Arg
  UNSURE -31: Xaa=Asn or Ser
  UNSURE -9: Xaa=Ser or Tyr
MRGWXAPAWRXLXTRRLPMGSRHGASPASAVWCLXLKLVPALCISGLTLGIQGF

SEQ ID NO: 4452 - protein, 54 aa, Homo sapiens
  SIGNAL -35..-1: score 8.7 seq LLLSVAFNQLVFA/LY
  UNSURE 8: Xaa=Phe or Leu or Val
  UNSURE 12: Xaa= *  or Glu or Gly or Ile or Lys or Leu or Arg or Val
MDFTQCHSLLLRVEYSPVSVCFLLLSVAFNQLVFALYPIQATXCFSXVSLPFPA

SEQ ID NO: 4453 - protein, 59 aa, Homo sapiens
  SIGNAL -40..-1: score 3.5 seq SLAHCSLCLPGSS/DS
  UNSURE -30: Xaa=Ile or Met
  UNSURE -29: Xaa=Cys or Phe or Leu or Trp
  UNSURE -28: Xaa=Gly or Arg
  UNSURE -21: Xaa=His or Leu or Pro or Arg
MVMLMLIYIYXXXRSLALLXRLEWQDLSLAHCSLCLPGSSDSPASASWVAEIIGMHHHA

SEQ ID NO: 4454 - protein, 61 aa, Homo sapiens
  SIGNAL -15..-1: score 5.4 seq LLEALAPSGGSRG/KK
  UNSURE 11: Xaa=Leu or Val
MKLLEALAPSGGSRGKKYVSLTFQPXQAHSIPACSPMSCHLSSWCCHCHNAFFLTLSFLAS

SEQ ID NO: 4455 - protein, 62 aa, Homo sapiens
  SIGNAL -17..-1: score 3.6 seq VIFVSLXXYSIYS/RX
  UNSURE -15: Xaa= *  or Leu
  UNSURE -14: Xaa=Phe or Leu
  UNSURE -7: Xaa=Met or Arg
  UNSURE -6: Xaa=Leu or Trp
  UNSURE 2: Xaa=Pro or Ser
  UNSURE 4: Xaa=Cys or Phe
  UNSURE 6: Xaa=Leu or Trp
  UNSURE 9: Xaa=Ile or Lys
  UNSURE 20: Xaa= *  or Cys or Phe or Leu or Trp or Tyr
  UNSURE 33: Xaa=Leu or Arg
MIXXVIFVSLXXYSIYSRXFXVXFSXQSFALVTRLEXNGTISAHCNLHLXGSSDSPASASQV

SEQ ID NO: 4456 - protein, 52 aa, Homo sapiens [sequence omitted]

SEQ ID NO: 4457 - protein, 84 aa, Homo sapiens
  SIGNAL -23..-1: score 4.5 seq LELLTSGDPPALA/SQ
MGFHHVSQAGLELLTSGDPPALASQSAGITDVSHRARPQNKNVENIDFGGSILTTIFLREKLQLFLLLRVHLLKCPVGIIVQNH

SEQ ID NO: 4458 - protein, 63 aa, Homo sapiens
  SIGNAL -23..-1: score 5.4 seq LELLTSTDPPASA/SQ
  UNSURE 10: Xaa=Arg or Ser
MGFHHVGQAGLELLTSTDPPASASQSAGITCVXHCAPPFCFVYEFDCSGYLTKAELVGRSGSR

SEQ ID NO: 4459 - protein, 74 aa, Homo sapiens
  SIGNAL -31..-1: score 4 seq FLSFLKILRQGLA/LS
  UNSURE 33: Xaa=Leu or Val
MCSIFLTKIEISHLLLGIFLSFLKILRQGLALSLRLECRGAIMAQCNIHLPGSSDPAPSPSGVXGPQVRTTMPG

SEQ ID NO: 4460 - protein, 73 aa, Homo sapiens
  SIGNAL -33..-1: score 8.1 seq LFCFVLFCFVLFC/FV
MATVTRIPCECQLLVLHWCVLFCFVLFCFVLFCFVLFETGSQSVAQAGVQSCDLCSLQPPPPGLKRFSQLSLP

SEQ ID NO: 4461 - protein, 81 aa, Homo sapiens
  SIGNAL -40..-1: score 4.4 seq LNLGVLMCIECSG/IH
MALQSIQNMRGNSHCVDCETQNPKWASLNLGVLMCIECSGIHRSLGTRLSRVRSLELDDWPVELRKVMSSIGNDLANSIRE

SEQ ID NO: 4462 - protein, 56 aa, Homo sapiens
  SIGNAL -28..-1: score 7.6 seq LLFLLTXPHSCXP/PS
  UNSURE -7: Xaa=Cys or Phe
  UNSURE -2: Xaa=Asp or Gly or Asn or Ser
  UNSURE 10: Xaa=Leu or Val
MPVMSQLLSVHSEPSLLFLLTXPHSCXPPSLPSSSLSXSLTHTHTHTHTHTHTHTH

SEQ ID NO: 4463 - protein, 68 aa, Homo sapiens
  SIGNAL -23..-1: score 3.6 seq VLFVAVCFLVLFX/IY
  UNSURE 0: Xaa=Cys or Phe
  UNSURE 3: Xaa= *  or Gly or Leu or Val
  UNSURE 11: Xaa=Lys or Asn
  UNSURE 12: Xaa=Phe or Leu
MINSGSTPPRVLFVAVCFLVLFXIYXFIYFFETXXTLVPQAGVQWCNLSSLQPPPPGFRQFSCLKPPE

SEQ ID NO: 4464 - protein, 124 aa, Homo sapiens
  SIGNAL -30..-1: score 5.2 seq SLCFIFWDGVSLC/RS
  UNSURE 55: Xaa=Cys or Phe
MECSVYGMPGDGKRREKSLCFIFWDGVSLCRSGWSLAMSLRLECSSTVLAHCNLHLLSSGEFPASASEVAEITGACHHTQQIFVXLLEMGFHHVGQAVLKLLMTSDLLSWPPKVLELPAGVSHR

SEQ ID NO: 4465 - protein, 136 aa, Homo sapiens
  SIGNAL -24..-1: score 7.8 seq VALLLAAAGTAVG/DR
  UNSURE 49: Xaa=Phe or His or Ile or Leu or Asn or Pro or Ser or Thr or Tyr
MGPWGWKLRWTVALLLAAAGTAVGDRCERNEFQCQDGKCISYKWVCDGSAECQDGSDESQETCLSVTCKSGDXSCGGRVNRCIPQFWRCDGQVDCDNGSDEQGCPPKTCSQDEFRCHDGKCISRQFVCDSDRDCLD

SEQ ID NO: 4466 - protein, 77 aa, Homo sapiens
  SIGNAL -24..-1: score 11 seq LVLLFTLVQRSNG/EC
  UNSURE 47: Xaa= *  or Tyr
MKAPAVLAPGILVLLFTLVQRSNGECKEALAKSEMNVNMKYQLPNFTAETPIQNVILHEHHIFLGATNYIXVLNEED

SEQ ID NO: 4467 - protein, 55 aa, Homo sapiens
  SIGNAL -48..-1: score 4.1 seq FTTLSNLSLPSQT/KD
  UNSURE -36: Xaa=Leu or Arg
  UNSURE -35: Xaa=His or Asn
MCYLAELSLTTFXXGYIVTSRATTTTTLAIQPGLPFTTLSNLSLPSQTKDELHPP

SEQ ID NO: 4468 - protein, 54 aa, Homo sapiens
  SIGNAL -24..-1: score 4.6 seq SLLLYSLPLNIIG/LN
  UNSURE 21: Xaa=His or Pro or Arg
MYPSLLVDYFPSLLLYSLPLNIIGLNCAYPLINNFLKNNSYTCVXVPLAFPSMP

SEQ ID NO: 4469 - protein, 60 aa, Homo sapiens
  SIGNAL -40..-1: score 6.1 seq ICIGILVLPFIRC/CC
MIHLRIIQRCYMAGLENKKNVVFEAKQICIGILVLPFIRCCCLVQITFSLSLHFLIYNMR

SEQ ID NO: 4470 - protein, 90 aa, Homo sapiens
  SIGNAL -26..-1: score 5.5 seq AMFLLSYAXPSCG/RS
  UNSURE -5: Xaa=Leu or Met or Val
MTMQRRLVQQWSVAMFLLSYAXPSCGRSVEGLSRRLKRAVSEHQLLHDKGKSIQDLRRRFFLHHLIAEIHTAEIRATSEVSPNSKPSPNN

SEQ ID NO: 4471 - protein, 61 aa, Homo sapiens
  SIGNAL -44..-1: score 3.8 seq AIASLTLNEEILA/RV
  UNSURE -18: Xaa=Cys or Tyr
MEICADPQFIIGGATRTDICQGALGDXWLLAAIASLTLNEEILARVVPLNQSFQENYAGIF

SEQ ID NO: 4472 - protein, 97 aa, Homo sapiens
  SIGNAL -22..-1: score 5.9 seq LIYILWQLTGSAA/SG
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKK

SEQ ID NO: 4473 - protein, 88 aa, Homo sapiens
  SIGNAL -37..-1: score 6.5 seq LLVFFLIVRTLSC/RS
  UNSURE -24: Xaa=Ile or Leu
MMVTYRWGFGVDVXFVAVDAIPFCLLVFFLIVRTLSCRSVGVCWRSTPDPVCLGITSRGCRTEILQNSKCCSLILPLEASSQRGTECM

SEQ ID NO: 4474 - protein, 132 aa, Homo sapiens
  SIGNAL -27..-1: score 4.4 seq TSLLSPAAGPSFC/IV
MCHCHGGIRQEPTWTSLLSPAAGPSFCIVYIASWMGRFSYATCCSQEEEGMAGTGQTVNLPRDAIPFHTFGCLSGIRLAAAPTRGTEEKRDATGHCPASSGLQGAPSGAPACFPERVAVAPWGPELLWPPLA

SEQ ID NO: 4475 - protein, 64 aa, Homo sapiens
  SIGNAL -19..-1: score 5.2 seq LLVAFRVFLGLFS/LP
MYMWSKLLVAFRVFLGLFSLPSNHNTYCPFQPWGIPCSLRIGGLLHLQCPLPPSLHPLPSLLTS

SEQ ID NO: 4476 - protein, 51 aa, Homo sapiens
  SIGNAL -26..-1: score 4.7 seq TALSLVSSAFSFC/DM
MPLAFLRPCENHGTALSLVSSAFSFCDMPSSQINYRYLFRREEDFTSQRVR

SEQ ID NO: 4477 - protein, 65 aa, Homo sapiens
  SIGNAL -32..-1: score 5.9 seq WTAMLISLAIVIA/LP
MNWQKKLRGTLEPHWSGLLWTAMLISLAIVIALPKPHGIRALIASTILRLIFSVGLQPTLFLLGA

SEQ ID NO: 4478 - protein, 74 aa, Homo sapiens
  SIGNAL -37..-1: score 4.4 seq LELLTSGDPPASA/SQ
MHHHTRLIFVFLVEMGFHHIGQASLELLTSGDPPASASQSAGITGVKHHAQPEIIFYLLLCAFCVLLRKSSPTL

SEQ ID NO: 4479 - protein, 68 aa, Homo sapiens
  SIGNAL -15..-1: score 8 seq FISFLCLIALAGT/SS
  UNSURE 17: Xaa=Leu or Trp
  UNSURE 18: Xaa=Lys or Arg
  UNSURE 22: Xaa=Asp or Glu
  UNSURE 25: Xaa=Asn or Tyr
  UNSURE 27: Xaa= *  or Cys or Gly
  UNSURE 30: Xaa=Pro or Gln
  UNSURE 46: Xaa= *  or Leu
MPFISFLCLIALAGTSSTMLRSALAGTSSTMXXRSGXSGXPXLVXVLRGNAFSFFPFSLMXAMGCHRW

SEQ ID NO: 4480 - protein, 61 aa, Homo sapiens
  SIGNAL -26..-1: score 7.9 seq RVCLLSLSLFLWA/NR
MLRTWSSLPWTRFRVCLLSLSLFLWANRLEDSRSCQPNPMSLTTLPGHRLKEAVWLPAPSL

SEQ ID NO: 4481 - protein, 51 aa, Homo sapiens [sequence omitted]

SEQ ID NO: 4482 - protein, 61 aa, Homo sapiens
  SIGNAL -28..-1: score 8.3 seq ILFLINILPGTTG/QG
MIITQTSHCYMTSLGILFLINILPGTTGQGESRRQEPGDFVKQDIGGLSPKHAPDIPDDST

SEQ ID NO: 4483 - protein, 76 aa, Homo sapiens
  SIGNAL -20..-1: score 5.4 seq WFVHSSALGLVLA/PP
MNLHFPQWFVHSSALGLVLAPPFSSPGTDPTFPCIYCRLLNMIMTRLAFSFITCLCPNLKEVCLILPEKNCNSRHA

SEQ ID NO: 4484 - protein, 73 aa, Homo sapiens
  SIGNAL -34..-1: score 4.4 seq SLHLLWSRTVTTG/ET
  UNSURE 18: Xaa= *  or Gly or Arg
MHGPSPRKAAFCIMNPTGRAPSLHLLWSRTVTTGETGFHYVGRAGLELLTSXSACLGLPNCWDYRREPPHPDI

SEQ ID NO: 4485 - protein, 96 aa, Homo sapiens
  SIGNAL -29..-1: score 11.2 seq GLLVVLLVGGCAA/EE
  UNSURE 54: Xaa=Cys or Phe
MAPTWGPGMVSVVGPMGLLVVLLVGGCAAEEPPRFIKEPKDQIGVSGGVASFVCQATGDPKPRVTWNKKGKKVNSQRFETIEXDESAGAVLRIQPL

SEQ ID NO: 4486 - protein, 108 aa, Homo sapiens
  SIGNAL -26..-1: score 3.6 seq TQAFGALLSGAGS/QV
  UNSURE 50: Xaa=Pro or Arg
  UNSURE 69: Xaa=Leu or Met
MYLTCLQPCLKSLTQAFGALLSGAGSQVLAPTSSTLNWPLSSQMGRLPQAAPAGTQQLPGVQAAPTALHPPLGRRXREELEALSYARHFQPFARXHQRGECPGSWGCA

SEQ ID NO: 4487 - protein, 51 aa, Homo sapiens
  SIGNAL -49..-1: score 4.4 seq CLFSILFPLFIIS/AK
MHQRLSNIERNWPYYFRFGLPLAFLTAMQSSYIISGCLFSILFPLFIISAK

SEQ ID NO: 4488 - protein, 53 aa, Homo sapiens
  SIGNAL -39..-1: score 4.4 seq LELLTSGDPPASA/SQ
MGMCHHAQLIFVFLVETGFHHVGQAGLELLTSGDPPASASQSAGITGLSHHAT

SEQ ID NO: 4489 - protein, 87 aa, Homo sapiens
  SIGNAL -19..-1: score 10.8 seq SLCCLLVLANARS/RP
  UNSURE 4: Xaa=Cys or Phe
MWQLWASLCCLLVLANARSRPSXHPVSDELVNYVNKRNTTWQAGHNFYNVDMGYLKRLCGTFLGGPKPPQRVMFTEDLKLPASFDAR

SEQ ID NO: 4490 - protein, 124 aa, Homo sapiens
  SIGNAL -30..-1: score 6.6 seq LVWVMAAVVLCTA/QV
MERLVIRMPFCHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFN

SEQ ID NO: 4491 - protein, 71 aa, Homo sapiens
  SIGNAL -47..-1: score 4.5 seq PIFGLLVPSQIFS/SL
  UNSURE -20: Xaa=Ala or Gly or Ser or Thr
MCTLTDTHTHVQVHKSKPCQLLSPPPPXHGPLLLPIFGLLVPSQIFSSLLNSLHLGLPSFPKMPLMIFLPR

SEQ ID NO: 4492 - protein, 75 aa, Homo sapiens
  SIGNAL -19..-1: score 8 seq LLLLVATAWHGQG/IP
MGPGVLLLLLVATAWHGQGIPVIEPSVPELVVKPGATVTLRCVGNGSVEWDGPPSPHWTLYSDGSSSILSTNNAT

SEQ ID NO: 4493 - protein, 63 aa, Homo sapiens
  SIGNAL -18..-1: score 4.7 seq LFFCFCFCFVLRQ/SL
MVQGDLFFCFCFCFVLRQSLPLSPRLECSGAISAHCNLYLLDSDDSYALVSLVAGTTGICHHT

SEQ ID NO: 4494 - protein, 63 aa, Homo sapiens
  SIGNAL -24..-1: score 5.1 seq IFIYLLFSRQGLA/LS
  UNSURE 19: Xaa=Ile or Leu
MYVCDMQVVGEIFIYLLFSRQGLALSPRLECSCVNIAHYSLQXLGSNNPPISASQVSSGTTGM

SEQ ID NO: 4495 - protein, 67 aa, Homo sapiens
  SIGNAL -34..-1: score 4 seq VIFLSIFVIIVTC/LM
MFYKGSMKQDKIWSKEGFYAVVIFLSIFVIIVTCLMILYRLKERFQLSLRQDKEKNQEIHLSPITFQ

SEQ ID NO: 4496 - protein, 90 aa, Homo sapiens
  SIGNAL -28..-1: score 4.2 seq LACGXGXXHPTXA/FV
  UNSURE -9: Xaa=Lys or Thr
  UNSURE -7: Xaa=Ala or Gly
  UNSURE -6: Xaa=Phe or Leu
  UNSURE -2: Xaa= *  or Cys or Tyr
  UNSURE 4: Xaa=Met or Val
MNFVKLLHAYNRTHLLACGXGXXHPTXAFVEXGHRAEEPVLRLDPGRIEDGKGKSPYDPRHRAASVLVGEELYSGVAADLRTRLYHLSQP

SEQ ID NO: 4497 - protein, 53 aa, Homo sapiens
  SIGNAL -18..-1: score 6.3 seq LFLLFFFFHFSFL/NW
MLFLFLFLLFFFFHFSFLNWSLTLLPRLECSGAILAHCSLHLLGSSDSPASAP

SEQ ID NO: 4498 - protein, 129 aa, Homo sapiens
  SIGNAL -17..-1: score 9.2 seq PALLLAFLPLASQ/KS
MRWAPALLLAFLPLASQKSSNLQGRRKSVTRPAGSSAVITCDLTVINTFYIHWYLHQAGKAPQHLPYYDPYYSRVVLESRISRGKYFTYASMRRSWKLILQNLIENDSGSITVPPGTGTVIHTCPTPHW

SEQ ID NO: 4499 - protein, 94 aa, Homo sapiens
  SIGNAL -33..-1: score 5 seq LELLGLSGPPASG/SL
MGSLLCCPSWSAVVIIVHCNLELLGLSGPPASGSLVGRTTGVCQHAPLIKKNFFFVETGVSLCLTRLVWNSGPQAKHWDYRSKPLCQVQEECAP

SEQ ID NO: 4500 - protein, 109 aa, Homo sapiens
  SIGNAL -43..-1: score 11 seq VFVLLLVLSLAIG/LY
  UNSURE -37: Xaa=Ile or Thr
  UNSURE -36: Xaa= *  or Ala or Gly or Leu or Pro or Arg or Ser or Val
  UNSURE 15: Xaa=Asp or Glu
  UNSURE 49: Xaa=Ile or Leu or Pro or Arg or Ser or Thr
  UNSURE 55: Xaa= *  or Glu or Gln
MSVGVSXXAPLSPTSGTSVGMSTFSIMDYVVFVLLLVLSLAIGLYHACRGWGRHTVGXLLMADRKMGCLPVALSLLATFQSAVAILGVPSEXYRFGTXYWFLGCCYFLG

SEQ ID NO: 4501 - protein, 88 aa, Homo sapiens
  SIGNAL -47..-1: score 5.8 seq LMCFGALIGLCAC/IC
MEKFVDPGNHNSGIDLLRTYLWRCQFLLPFVSLGLMCFGALIGLCACICRSLYPTIATGILHLLAGLCTLGSVSCYVAGIELLHQKLE

SEQ ID NO: 4502 - protein, 102 aa, Homo sapiens
  SIGNAL -25..-1: score 7.1 seq LFVMAFLLSGAAP/LK
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQI

SEQ ID NO: 4503 - protein, 54 aa, Homo sapiens
  SIGNAL -36..-1: score 4.4 seq LWFFLPSLXCPEC/CP
  UNSURE -5: Xaa=His or Pro
MWTLPSLSASFQPFLGSLRPSHILWFFLPSLXCPECCPPDPGSPASRDPNVACE

SEQ ID NO: 4504 - protein, 59 aa, Homo sapiens
  SIGNAL -19..-1: score 4.1 seq FLWLSSIPSYIYT/HT
MPLIHSFLWLSSIPSYIYTHTHMYVYTYIYTRTYMYVYTYTHTNTPTHHSFFILSLIAG

SEQ ID NO: 4505 - protein, 69 aa, Homo sapiens [sequence omitted]

SEQ ID NO: 4506 - protein, 72 aa, Homo sapiens
  SIGNAL -17..-1: score 4.2 seq LAFLLVSLYWSHM/HP
MDWSLAFLLVSLYWSHMHPCYWSWPCSCGFVDSPCICTASTRCCCSSLCCLWRLALWDWTSNGSRSGIACVC

SEQ ID NO: 4507 - protein, 66 aa, Homo sapiens
  SIGNAL -14..-1: score 3.7 seq CSLLSGWGQLLRC/VQ
  UNSURE 14: Xaa=Leu or Pro or Arg
MCSLLSGWGQLLRCVQTPAEPRDVNKKXEKKEKYMPLVDSLCGGLGTRNSDCLRGGAGRGRDGRRI

SEQ ID NO: 4508 - protein, 64 aa, Homo sapiens
  SIGNAL -48..-1: score 5.8 seq LHLLGSSNSPASA/SS
  UNSURE -40: Xaa=Leu or Val
  UNSURE -39: Xaa=Phe or Ser
  UNSURE -36: Xaa=Asp or Val
MTFYLFVCXXIYXLRWSLALSPRLECSGAISAHCSLHLLGSSNSPASASSANFCIFSRDGISLC

SEQ ID NO: 4509 - protein, 67 aa, Homo sapiens
  SIGNAL -22..-1: score 7.2 seq IIYALQFLFLVFA/PS
MNRSCRNTGIIYALQFLFLVFAPSSLGYFEWIVAINQDLVLFVFCLSFSLRISIIQGKRKAAFPTPP

SEQ ID NO: 4510 - protein, 60 aa, Homo sapiens
  SIGNAL -43..-1: score 4 seq AAWCSLVLSFCRL/HK
MAMSFEWPWQYRFPPFFTLQPNVDTRQKQLAAWCSLVLSFCRLHKQSSMTVMEAQESPLR

SEQ ID NO: 4511 - protein, 51 aa, Homo sapiens
  SIGNAL -33..-1: score 6 seq LAHFLIGLTVCFG/EG
  UNSURE 3: Xaa=Arg or Trp
MYLYLLSICMSSLKKCLFKFLAHFLIGLTVCFGEGXLMSYRSSYLLLKGPP

SEQ ID NO: 4512 - protein, 54 aa, Homo sapiens
  SIGNAL -27..-1: score 5 seq CVLTASSWAVLWS/AR
  UNSURE 15: Xaa=Ala or Gly or Ile or Ser or Thr or Val
MFADADRRDPNESQCVLTASSWAVLWSARCEGLAWGHTADSXRGMPMVLSIGRT

SEQ ID NO: 4513 - protein, 51 aa, Homo sapiens
  SIGNAL -17..-1: score 3.6 seq WIYAFISLGYILG/SG
  UNSURE -16: Xaa=Arg or Ser
  UNSURE -15: Xaa=Phe or Ile or Leu or Val
MXXCWIYAFISLGYILGSGIVGLFGNFMFKLLRNCQTVFQDGYAILPFPPT

SEQ ID NO: 4514 - protein, 54 aa, Homo sapiens
  SIGNAL -28..-1: score 4.5 seq FLPFLLSLPLDQT/LP
  UNSURE -27: Xaa=Cys or Phe
  UNSURE -26: Xaa=Ala or Pro
  UNSURE -15: Xaa=Asp or Glu
MXXKACRTLAWLPXPFLPFLLSLPLDQTLPRQGPGQSLSFPENYQTLPKSTRHP

SEQ ID NO: 4515 - protein, 76 aa, Homo sapiens
  SIGNAL -13..-1: score 4.9 seq MLTASLAFQLVDG/VS
  UNSURE 55: Xaa=Ala or Gly
MLTASLAFQLVDGVSWNFSVSKMLASPSTSGQLSQFGASLYGQQSALGLPMRGMSNNTPQLNRSLSQXLSYRATSR

SEQ ID NO: 4516 - protein, 68 aa, Homo sapiens
  SIGNAL -48..-1: score 5.2 seq EVVTLPLTSHCLA/QV
MGLHISLIKFLLANGPHIPSHQRPFEPKGEKSCRIEVVTLPLTSHCLAQVASSDLIHRMRTITGTSSH

SEQ ID NO: 4517 - protein, 99 aa, Homo sapiens
  SIGNAL -46..-1: score 6.9 seq VTMLMGFLGCIGA/VN
MSELETACGKPMRHKTSSSSLRMGAYVFIGVGAVTMLMGFLGCIGAVNEVRCLLGLYFAFLLLILIAQVTAGALFYFNMGKLKQEMGGIVTELIRDYNS

SEQ ID NO: 4518 - protein, 66 aa, Homo sapiens [sequence omitted]

SEQ ID NO: 4519 - protein, 66 aa, Homo sapiens
  SIGNAL -36..-1: score 5.5 seq LHFVYCFLCCAEA/FL
MFQLLILCQMNSLKIFSPILGWSLHFVYCFLCCAEAFLLDMIPFMQFYFGYLCLWGITLKIFAQSN

SEQ ID NO: 4520 - protein, 56 aa, Homo sapiens
  SIGNAL -32..-1: score 10.6 seq VVFLLLLVSTLSS/VV
MTYFPLGRYPVMGLLDQMVVVFLLLLVSTLSSVVVLLVCIPTSSVKLFPFHHIHTN

SEQ ID NO: 4521 - protein, 68 aa, Homo sapiens
  SIGNAL -31..-1: score 6.4 seq GFMVLLMIPWGSA/AK
  UNSURE 21: Xaa=Leu or Gln
  UNSURE 24: Xaa=Gly or Arg
  UNSURE 25: Xaa=Leu or Val
  UNSURE 31: Xaa=His or Lys or Asn or Gln
MGCSLPLSCIMVRSVAWAGFMVLLMIPWGSAAKLVCYFTNWAQYRQGEARFXAQXXGPQPLXPPHLRL

SEQ ID NO: 4522 - protein, 53 aa, Homo sapiens
  SIGNAL -48..-1: score 3.5 seq LIIHLMGTTGLCA/SL
  UNSURE -43: Xaa=Glu or Gly or Lys or Arg
MRVCLXKKEQSCVCVCAHVFVGIILTQSLKLTLKSLIIHLMGTTGLCASLSGL

SEQ ID NO: 4523 - protein, 58 aa, Homo sapiens
  SIGNAL -22..-1: score 4.3 seq LFFETGSPSVAQS/GV
  UNSURE 28: Xaa=Arg or Ser
  UNSURE 29: Xaa= *  or Glu or Gly or Lys or Arg or Trp
MVVVSAFIYLFFETGSPSVAQSGVQWCDLGLLQPPPPGFKRFSCLSLLGXXDCRRAPP

SEQ ID NO: 4524 - protein, 56 aa, Homo sapiens
  SIGNAL -36..-1: score 5.3 seq SLLIATSTSRVQA/TL
MLVRCFFLRWSLTLSPDWSTVAQSLLIATSTSRVQATLLPQPCEYLELQACATTPG

SEQ ID NO: 4525 - protein, 67 aa, Homo sapiens
  SIGNAL -40..-1: score 4.9 seq SLKICGLVFGILA/LT
MAKNPPENCEDCHILNAEAFKSKKICKSLKICGLVFGILALTLIVLFWGSKHFWPEVPKKAYDMEHT

SEQ ID NO: 4526 - protein, 79 aa, Homo sapiens
  SIGNAL -45..-1: score 14 seq LLLLLLLPSPLHP/HP
MGLEERRTESSGTLEDALCLRRSFCLPVLMPLLLLLLLLPSPLHPHPICEVSKVASHLEVNCDKRNLTALPPDLPKDTN

SEQ ID NO: 4527 - protein, 56 aa, Homo sapiens
  SIGNAL -30..-1: score 7.4 seq LFPLLTHSEPSQG/QS
MCRISCSNLSNTLMRNLLFPLLTHSEPSQGQSAKIAGIVCSCLGFMPLNFTFYYTA

SEQ ID NO: 4528 - protein, 60 aa, Homo sapiens
  SIGNAL -38..-1: score 4 seq FKPXSCLSLLSNX/DY
  UNSURE -26: Xaa=Pro or Arg or Ser or Trp
  UNSURE -25: Xaa=His or Gln
  UNSURE -10: Xaa=Phe or Leu
  UNSURE 0: Xaa= *  or Ser
  UNSURE 13: Xaa= *  or Cys or Gly
MESHSVAQARMRXXNLSSLQPLPPGFKPXSCLSLLSNXDYRHAPPFLANFXIFHRDGVSP

SEQ ID NO: 4529 - protein, 84 aa, Homo sapiens
  SIGNAL -20..-1: score 6.9 seq LYLLGMLVPGGLG/YD
MKPLLETLYLLGMLVPGGLGYDRSLAQHRQEIVDKSVSPWSLETYSYNIYHPMGEIYEWMREISEKYKEVVTQHFLGVTYETQP

SEQ ID NO: 4530 - protein, 79 aa, Homo sapiens
  SIGNAL -24..-1: score 4.6 seq FFIFCSLNTLLLG/GV
MKSAKLGFLLRFFIFCSLNTLLLGGVNKIAEKICGDLKDPCKLDMNFGSCYEVHFRYFYNRTSKRCETFVFSSCNGNLN

SEQ ID NO: 4531 - protein, 73 aa, Homo sapiens
  SIGNAL -39..-1: score 5.9 seq SAWWCVLLEWSQG/AS
MELTNKQTGTDRHEQVLRRVKQDKRISAWWCVLLEWSQGASLRRQHRGETSPKSGERLSRQREQQKPQMSDKS

SEQ ID NO: 4532 - protein, 55 aa, Homo sapiens
  SIGNAL -23..-1: score 9.4 seq SLLFICFFGESFC/IC
  UNSURE 9: Xaa= *  or Lys or Leu or Met
  UNSURE 11: Xaa= *  or Glu or Gly
MSNQRLPLIFSLLFICFFGESFCICDGTVWTXVXWEILPEEVHYWKVKGSPSHCL

SEQ ID NO: 4533 - protein, 66 aa, Homo sapiens
  SIGNAL -35..-1: score 7.3 seq LDLLGSSSPPTSA/SQ
  UNSURE 20: Xaa=Phe or Val
  UNSURE 22: Xaa= *  or Arg
MMLDFALSPRLERSGLIMACCTLDLLGSSSPPTSASQVAGTGHVPPHPASFFYFXVXQVYYVSQLI

SEQ ID NO: 4534 - protein, 55 aa, Homo sapiens
  SIGNAL -21..-1: score 9.5 seq LLVLFVLLANVQG/PG
MGSSGLLSLLVLFVLLANVQGPGLTDWLFPRRCPKIREECEFQERDVCTKDRQCR

SEQ ID NO: 4535 - protein, 88 aa, Homo sapiens [sequence omitted]

SEQ ID NO: 4536 - protein, 51 aa, Homo sapiens
  SIGNAL -43..-1: score 6.8 seq ALSAXTFVSFLHA/AP
  UNSURE -9: Xaa=Ala or Pro
MKQWLCWVLRLEGRQGLGVGEPRGLRLCLGALSAXTFVSFLHAAPHSHPAL

SEQ ID NO: 4537 - protein, 82 aa, Homo sapiens
  SIGNAL -16..-1: score 10.1 seq LVLTLCTLPLAVA/SA
MERLVLTLCTLPLAVASAGCATTPARNLSCYQCFKVSSWTECPPTWCSPLDQVCISNEVVVSFKWSVRVLLSKRCAPRCPNS

SEQ ID NO: 4538 - protein, 51 aa, Homo sapiens
  SIGNAL -30..-1: score 4.8 seq CLFLNARLAGTLC/QL
MRVGRREGHPLFPNVPRCLFLNARLAGTLCQLKLLQFGRLGNTESHLHGLA

SEQ ID NO: 4539 - protein, 64 aa, Homo sapiens
  SIGNAL -19..-1: score 3.9 seq SVCLCPCLNKGQS/EN
  UNSURE 37: Xaa= *  or Trp
MFSCCISVCLCPCLNKGQSENLSRDCGHWLNPHHRRLWPFGRRHPQDCGLFQDSQXYGESKDWN

SEQ ID NO: 4540 - protein, 51 aa, Homo sapiens
  SIGNAL -37..-1: score 5.6 seq LVASFLMSSVVRT/SS
MTNTVKTFVHHHLLMEDPRLSLQKLVASFLMSSVVRTSSLEENVKVHPIPT

SEQ ID NO: 4541 - protein, 73 aa, Homo sapiens
  SIGNAL -18..-1: score 3.7 seq VCWGHLLPARVST/RS
  UNSURE 54: Xaa=His or Gln
MCGYWVCWGHLLPARVSTRSSEQPRVTPRDEDAMMSASLLTWRYVTFMVPMPLSPCRSVWVCFRQKILEYVXA

SEQ ID NO: 4542 - protein, 125 aa, Homo sapiens
  SIGNAL -30..-1: score 13.2 seq LLLLSTLVIPSAA/AP
  UNSURE 73: Xaa=His or Asn
  UNSURE 78: Xaa= *  or Ala or Glu or Gly or Lys or Leu or Met or Pro or Gln or Arg or Ser or Thr or Val or Trp
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSXLQIDXMTDNKTGEVLISENVVA

SEQ ID NO: 4543 - protein, 78 aa, Homo sapiens
  SIGNAL -23..-1: score 11.8 seq CLFVCLFLSQSFA/FV
MPSYKVCGVFCLFVCLFLSQSFAFVLQAGVQWRDLCSLQPQLPRFGPSSCLSLPSGWDCRRPPPRLANSCVFGGDGVS

SEQ ID NO: 4544 - protein, 101 aa, Homo sapiens
  SIGNAL -19..-1: score 11 seq SLVLLLCLTCSYA/FM
  UNSURE 46: Xaa=Phe or Val
MWTLKSSLVLLLCLTCSYAFMFSSLRQKTSEPQGKVQYGEHFRIRQNLPEHTQGWLGSKWLWLLXVVVPFVILQCQRDSEKNKEQSPPGLRGGQLHSPLKK

SEQ ID NO: 4545 - protein, 80 aa, Homo sapiens
  SIGNAL -44..-1: score 3.7 seq RFLLFCVHGDGHA/EN
  UNSURE 34: Xaa=Arg or Thr
MKTTSSMDPGDMMREIRKVLDANNCDYEQRERFLLFCVHGDGHAENLVQWEMEVCKLPRLSLNGVRFKRISGTSIAFXNI

SEQ ID NO: 4546 - protein, 55 aa, Homo sapiens
  SIGNAL -30..-1: score 4.3 seq LLPTLPWLPSTRL/LS
  UNSURE 15: Xaa=Ala or Ser or Thr
MQRNATFIHLQLAIRPSLLPTLPWLPSTRLLSPTPLGQLRGPPGXQRAMPTAHLR

SEQ ID NO: 4547 - protein, 71 aa, Homo sapiens
  SIGNAL -27..-1: score 8.8 seq VLLLLPFTTTSLC/EL
  UNSURE 11: Xaa=Lys or Gln
  UNSURE 13: Xaa=Lys or Thr
  UNSURE 14: Xaa=Asp or Glu
  UNSURE 16: Xaa=His or Asn
  UNSURE 38: Xaa=His or Leu or Pro or Arg
MKVKEDFPLLSRKSVLLLLPFTTTSLCELGFSILTQLXTXXRXGLNCAAVMRVALSSCVPDWNEXMNRQAH

SEQ ID NO: 4548 - protein, 60 aa, Homo sapiens
  SIGNAL -43..-1: score 4.7 seq GIFLVIFCSESFS/LL
  UNSURE -20: Xaa=Cys or Phe or Leu or Trp
MINLLVGNCIYLLGAIRASCMCRXMSFAKFGIFLVIFCSESFSLLLWNFSSIYVKTFWPV

SEQ ID NO: 4549 - protein, 64 aa, Homo sapiens
  SIGNAL -24..-1: score 7.8 seq FLLCLCIAYWAST/AV
MCSLLYPLVTFFLLCLCIAYWASTAVFLSTSNEAVYKIFDDSPCPFTAKTCNPETFPSSNEPRH

SEQ ID NO: 4550 - protein, 101 aa, Homo sapiens
  SIGNAL -46..-1: score 7.8 seq LVLLGTRVPLSGG/GP
  UNSURE -40: Xaa=Asp or Glu
  UNSURE 22: Xaa=His or Asn
MKQSKRXMVKRRRSPALGEERFSPSSILHPRLPLVLLGTRVPLSGGGPGEPDQGRSAPSWKSLASTHXHSRPAAGATPARPATQSQLGPFAPPLPGVRPAP

SEQ ID NO: 4551 - protein, 55 aa, Homo sapiens [sequence omitted]

SEQ ID NO: 4552 - protein, 58 aa, Homo sapiens
  SIGNAL -17..-1: score 7.5 seq FLFLFLLXXLIVA/VT
  UNSURE -6: Xaa=Asp or Asn or Tyr
  UNSURE -5: Xaa=Cys or Gly
  UNSURE 24: Xaa=Asp or Gly or Val
MNKHFLFLFLLXXLIVAVTSLQCITCHLRTRTDRCRRGFGXCTAQKGEACMLLRIHQR

SEQ ID NO: 4553 - protein, 83 aa, Homo sapiens
  SIGNAL -41..-1: score 3.6 seq LHTSVTLFLLSYC/DC
  UNSURE 19: Xaa=Lys or Asn or Arg or Ser or Thr
MKAIKKSLTEEEYLYLDFSHQTEGCIFPLHTSVTLFLLSYCDCKIFKICLVVTKEVSRDXSLLRDDLIQDVEIQIISRQELPP

SEQ ID NO: 4554 - protein, 67 aa, Homo sapiens
  SIGNAL -36..-1: score 5.6 seq SFLLFXXVLKTES/CS
  UNSURE -16: Xaa=Pro or Arg
  UNSURE -15: Xaa=Cys or Phe or Ser or Tyr
  UNSURE -8: Xaa= *  or Cys
  UNSURE -7: Xaa=Cys or Phe or His or Leu or Pro or Arg or Ser or Tyr
  UNSURE 21: Xaa=Pro or Ser
MKLGAEEEERLESGLSSSIKXXTSFLLFXXVLKTESCSVAQAGLQWCDLSSLQLPAXWVQSDSPASA

SEQ ID NO: 4555 - protein, 53 aa, Homo sapiens
  SIGNAL -15..-1: score 10.9 seq LSVCLLLVTLALC/CY
MKLSVCLLLVTLALCCYQANAEFCPALVSELLDFFFISEPLFKLSLAKFDAPR

SEQ ID NO: 4556 - protein, 61 aa, Homo sapiens [sequence omitted]

SEQ ID NO: 4557 - protein, 51 aa, Homo sapiens
  SIGNAL -23..-1: score 6.9 seq SLILVCLPIYCRS/LF
  UNSURE -19: Xaa=Phe or Leu
  UNSURE -18: Xaa=Gly or Arg
MMQMXXLGAISLILVCLPIYCRSLFWRSEPADDLQRQDNRVVTGLKKQRRN

SEQ ID NO: 4558 - protein, 64 aa, Homo sapiens [sequence omitted]

SEQ ID NO: 4559 - protein, 92 aa, Homo sapiens
  SIGNAL -44..-1: score 4.8 seq SGLMQMLLLKVSA/HI
  UNSURE -18: Xaa=Lys or Gln
  UNSURE 3: Xaa=Ser or Thr
  UNSURE 17: Xaa=Ala or Gly
  UNSURE 29: Xaa=Cys or Phe or Tyr
  UNSURE 47: Xaa=Phe or Leu or Val
MLKMDESTLLREAQELSLEKLQQAVRXNGLMSGLMQMLLLKVSAHIXEQLGMAPGGEFREXFKEASKVPFCKXHLGDRPIPVTFKRAIAAXS

SEQ ID NO: 4560 - protein, 58 aa, Homo sapiens [sequence omitted]

SEQ ID NO: 4561 - protein, 55 aa, Homo sapiens
  SIGNAL -40..-1: score 9.1 seq RLMLSLCLPPILS/GT
  UNSURE 9: Xaa=Cys or Ser
MSQPAQPGSLCPGRKCPIPHAPYGEGGRLMLSLCLPPILSGTGDGGSPXEPFSCC

SEQ ID NO: 4562 - protein, 66 aa, Homo sapiens
  SIGNAL -35..-1: score 8.5 seq FVLFCSVLRRSLA/RS
  UNSURE -30: Xaa=His or Gln
MEAGKXWPMGKSCPPHFFVLFCFVLFCSVLRRSLARSPRLECSGAILAHCNLCTLGSSDYPASASL

SEQ ID NO: 4563 - protein, 51 aa, Homo sapiens
  SIGNAL -34..-1: score 3.8 seq FHQMALXPGTSRA/QA
  UNSURE -7: Xaa=Phe or Ser
MCPAWLPCWTAQTEHLDRYRKFHQMALXPGTSRAQALLYNEVLERFMFTRL

SEQ ID NO: 4564 - protein, 55 aa, Homo sapiens
  SIGNAL -35..-1: score 4.8 seq PWVLDIFLTLVFA/LG
MENLPFPLKLLSASSLNTPSSTPWVLDIFLTLVFALGFFFLLLPYFSYLRCDNPP

SEQ ID NO: 4565 - protein, 65 aa, Homo sapiens
  SIGNAL -19..-1: score 6.6 seq MLMVVLLCQVLLG/GA
  UNSURE 36: Xaa=Gln or Arg
  UNSURE 37: Xaa=Asp or Asn
MIPGNRMLMVVLLCQVLLGGASHASLIPETGKKKVAEIQGHAGGRRSGQSHELLXXFEATLLQMF

SEQ ID NO: 4566 - protein, 57 aa, Homo sapiens
  SIGNAL -29..-1: score 6 seq LFMALPPVLSSHG/SR
MRDPLADMVHSYLSSSLFMALPPVLSSHGSRNLRIWGSPFGGALTKGKAPPTPAQPA

SEQ ID NO: 4567 - protein, 54 aa, Homo sapiens
  SIGNAL -19..-1: score 6.2 seq FLFLIIPISRSHG/KV
MRFFKFFLFLIIPISRSHGKVRKHNYSRPGAVAHACNPSTLGGQGKVDGLSPGV

SEQ ID NO: 4568 - protein, 57 aa, Homo sapiens
  SIGNAL -15..-1: score 4.7 seq RCACFPFFPFAFC/HD
  UNSURE 25: Xaa= *  or Gly
MVRCACFPFFPFAFCHDCKFLGASQSCFLLSRQNCVSTGXPSSKSDINSRSGSCSLA

SEQ ID NO: 4569 - protein, 104 aa, Homo sapiens
  SIGNAL -18..-1: score 3.5 seq ALEVIVTLSETAA/AM
MQRQLALEVIVTLSETAAAMLRKHTNIVAQTIPQMLAMMVDLEEDEDWANADELEDDDFDSNAVAGESALDRMACGLGGKLVLPMIKEHIMQMLQNRKLCPSML

SEQ ID NO: 4570 - protein, 71 aa, Homo sapiens
  SIGNAL -43..-1: score 6.2 seq LALGIPSITQAWG/LW
MNQADPRLRAVCLWTLTSAAMSRGDNCTDLLALGIPSITQAWGLWVLLGAVTLLFLISLAAHLSQWTRGRS

SEQ ID NO: 4571 - protein, 63 aa, Homo sapiens
  SIGNAL -44..-1: score 5.2 seq XIYXFNFLRWSLA/LS
  UNSURE -13: Xaa=Cys or Phe
  UNSURE -10: Xaa=Leu or Val
MSLYLNLGSCRQHLCGSCFHIQSENLCLLCYXIYXFNFLRWSLALSLRLECSGTIPSHCNLRL

SEQ ID NO: 4572 - protein, 85 aa, Homo sapiens
  SIGNAL -26..-1: score 4.9 seq FYLFFVVVHFILC/HD
MVHFCVLVPLMTSFYLFFVVVHFILCHDFTLLVFHFSSLKYFLERVSFLFCFVSETESRSVVQARVQWCNLGSLQPLPLGFKQFS

SEQ ID NO: 4573 - protein, 56 aa, Homo sapiens
  SIGNAL -46..-1: score 6.5 seq WLFFLMLSLCTPP/DR
MCRMCRFVTWINVCHGDLLHRSSRRLGVKPSTHWLFFLMLSLCTPPDRPWCVLFPP

SEQ ID NO: 4574 - protein, 54 aa, Homo sapiens
  SIGNAL -27..-1: score 6.6 seq LAFSFSFFPSSFS/SF
  UNSURE 5: Xaa=Phe or Val
MVAHDYQNIISLFFLAFSFSFFPSSFSSFFLXFLSFFSSFFLSLLSFPSFLPPG

SEQ ID NO: 4575 - protein, 67 aa, Homo sapiens
  SIGNAL -29..-1: score 8.8 seq VLFCFVFLRQSLA/LS
MDEELVLMNEQRNCFSVLFCFVFLRQSLALSARLKRSGTVSAHCNLRLPGSSISSASASLVAGITGV

SEQ ID NO: 4576 - protein, 64 aa, Homo sapiens
  SIGNAL -33..-1: score 6 seq LHQACLLLAPSHP/QC
MHLLHPLLPILWYHHWGLGFLHQACLLLAPSHPQCHLLEPSHLGYPQPCPHHLCLLGLQDMAPH

SEQ ID NO: 4577 - protein, 80 aa, Homo sapiens
  SIGNAL -30..-1: score 5.4 seq GLCWACXSSLGSC/EY
  UNSURE -7: Xaa=Cys or Trp
MTTFVGLRPQPGGRGRSGLCWACXSSLGSCEYACFPGMSFSIFNTQAGLSTGKESGTEASRLREEGGRVTIYRARSFCGE

SEQ ID NO: 4578 - protein, 62 aa, Homo sapiens
  SIGNAL -27..-1: score 5 seq LSCFYLLAIVSNA/VM
MYHILFIHSFIDRYLSCFYLLAIVSNAVMNMGVQMSVLSPCFAFVHSIKNVKVLCFLLFFLF

SEQ ID NO: 4579 - protein, 57 aa, Homo sapiens
  SIGNAL -27..-1: score 7.6 seq LLFLGFLIIAIQT/DV
  UNSURE 4: Xaa=Arg or Trp
MYVGVPVSPQPRQHLLFLGFLIIAIQTDVRXYLIVVLICIYLMISDVEFFFIRFLAT

SEQ ID NO: 4580 - protein, 115 aa, Homo sapiens
  SIGNAL -46..-1: score 9.8 seq LLALLQGLSWSFS/LF
  UNSURE -17: Xaa=Phe or Leu or Val
MVSKIVHTLGMKIIVKKRKKQEYLNKSLRXMEQLLALLQGLSWSFSLFSILVQVKQPRKKVMACKTAFNKTGFQEVFDPPHYELFSLRDKEISADLADLSEELDNYQKMRRSSTA

SEQ ID NO: 4581 - protein, 61 aa, Homo sapiens
  SIGNAL -16..-1: score 7.5 seq LFCLSVCLFEVES/HS
MELLFCLSVCLFEVESHSVTQAGVQWHSLGPLNSLPPGFKRFSCLSLSSSWDYRHAPPPPA

SEQ ID NO: 4582 - protein, 109 aa, Homo sapiens
  SIGNAL -23..-1: score 6.6 seq VRLLLXLXLLLIA/LE
  UNSURE -8: Xaa=Cys or Phe or Tyr
  UNSURE -6: Xaa=Leu or Gln
MRRISLTSSPVRLLLXLXLLLIALEIMVGGHSLCFNFTIKSLSRPGQPWCEAHVFLNKNLFLQYNSDNNMVKPLGLLGKKVYATSTWGELTQTLGEVGRDLRMLLCDIK

SEQ ID NO: 4583 - protein, 52 aa, Homo sapiens
  SIGNAL -48..-1: score 7.4 seq SLMFLPIFFPSFS/SY
MSHCAWPSVYFLKGLSCLFWTSDRLFQYGKFSCILSLMFLPIFFPSFSSYNI

SEQ ID NO: 4584 - protein, 61 aa, Homo sapiens
  SIGNAL -28..-1: score 4.5 seq RFLSLSAADGXDX/SX
  UNSURE -3: Xaa=Ser or Thr
  UNSURE 0: Xaa=Ala or Gly
  UNSURE 2: Xaa=His or Gln
MVLTLGESWPVLVGRRFLSLSAADGXDXSXDSWDVERVAEWPWLSGTIRAVSHTDVTKKDL

SEQ ID NO: 4585 - protein, 58 aa, Homo sapiens
  SIGNAL -49..-1: score 7 seq FGLFVSLVFLGQA/FT
MIFLYRYCRMLEEGSFRGRTADFVFMFLFGGFLMTLFGLFVSLVFLGQAFTIMLVYVW

SEQ ID NO: 4586 - protein, 100 aa, Homo sapiens
  SIGNAL -18..-1: score 15.9 seq LLCCLVLLTGVRA/SP
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPKLRT

SEQ ID NO: 4587 - protein, 57 aa, Homo sapiens
  SIGNAL -48..-1: score 8.5 seq FSVLSGLVLNSWA/QT
MDGSMDGWMTGCHSVTQAGVQWCDHRSLQLQPPADFSVLSGLVLNSWAQTIILLRPP

SEQ ID NO: 4588 - protein, 54 aa, Homo sapiens
  SIGNAL -36..-1: score 5 seq SFSIXTLLWGLNC/KR
  UNSURE -14: Xaa= *  or Cys or Phe or Ile or Lys or Leu or Met or Asn or Arg or Ser or Thr or Trp or Tyr
  UNSURE -9: Xaa= *  or Cys or Phe or Leu or Trp
  UNSURE 12: Xaa=Ala or Gly
MTFSFFCFFPGFKPLLFHYFLFXSFSIXTLLWGLNCKRSWNINLRIVXSYSSGY

SEQ ID NO: 4589 - protein, 72 aa, Homo sapiens
  SIGNAL -24..-1: score 7.8 seq LMAGSSLSAGVSG/ED
  UNSURE 12: Xaa=Ala or Pro
MNEDEKEMKEILMAGSSLSAGVSGEDKTEILNPTPXMAKSLTIDCLELALPPELAFQLNELFGPVGIDSGSL

SEQ ID NO: 4590 - protein, 108 aa, Homo sapiens
  SIGNAL -23..-1: score 10 seq PLLGLLLSLPAGA/DV
  UNSURE 31: Xaa=Gly or Trp
MPSWIGAVILPLLGLLLSLPAGADVKARSCGEVRQAYGAKGFSLADIPYQEIAXEHLRICPQEYTCCTTEMEDKLSQQSKLEFENLVEETSHFVRTTFVSRHKKFDGR

SEQ ID NO: 4591 - protein, 70 aa, Homo sapiens
  SIGNAL -25..-1: score 4.6 seq LPTLLLLPVGAPG/KK
MVLGALNLPSQELPTLLLLPVGAPGKKKGMEGKTPLDLFAHFGPEPGDHSDPLPPSAPSPTREGALTPPP

SEQ ID NO: 4592 - protein, 96 aa, Homo sapiens
  SIGNAL -38..-1: score 4.8 seq MLMLAQSNPQLFA/LM
  UNSURE 17: Xaa=His or Leu or Pro or Gln or Arg
  UNSURE 58: Xaa=Asp or Tyr
MEQCASLEELRLAFRPQMDPRQLSMMLMLAQSNPQLFALMGTRAGIARELERVEXQSRLEQLSAAELQSRNQGHWADWLQAYRARLDKDLEGAGDX

SEQ ID NO: 4593 - protein, 100 aa, Homo sapiens
  SIGNAL -39..-1: score 5.4 seq ILLTSCFYTLVSS/TF
  UNSURE 32: Xaa= *  or Lys
  UNSURE 46: Xaa=Leu or Arg
  UNSURE 51: Xaa=Cys or Gly
MISSCGVKYLFSHASLFFMVGSTGSLILLTSCFYTLVSSTFLQKLSSLLLILFTETSVLMLKTFVANSCCXLWSHNCINFFKKVXPSYCXSSLLFLAVPR

SEQ ID NO: 4594 - protein, 58 aa, Homo sapiens
  SIGNAL -15..-1: score 4.5 seq LLGAAAVAALGRG/RA
MRLLGAAAVAALGRGRAPASLGWQRKQVNWKACRWSSSGVIPNEKIRNIGISAHIDSG

SEQ ID NO: 4595 - protein, 126 aa, Homo sapiens
  SIGNAL -15..-1: score 4 seq PTCATCAHPVTLA/QR
  UNSURE 62: Xaa=His or Leu or Pro or Gln
MGPTCATCAHPVTLAQRPWPLIAQRRFLKIPAALNRAAFAAAPAVGPCFRRRPGRGLTTRLGSLAPPFPWPEHPCGXPLLLRRRQSLCTLVFRGQKGQKGHFGATRAVFTCVCNGGRGAPGFPLFS

SEQ ID NO: 4596 - protein, 63 aa, Homo sapiens
  SIGNAL -39..-1: score 4.6 seq AFLSCLAFLVLDT/QE
  UNSURE 19: Xaa=Cys or Phe or Ile or Leu or Arg or Ser
MESPQLHCILNSNSVACSFAVGAGFLAFLSCLAFLVLDTQETRIAGTRFKTAFQLLDXILAVL

SEQ ID NO: 4597 - protein, 53 aa, Homo sapiens
  SIGNAL -26..-1: score 6.3 seq RQLLLPLPPFSFP/AP
MPQQPVEQGSPLLRQLLLPLPPFSFPAPSPCPSWPVALGSHGVAYWGSCSLGH

SEQ ID NO: 4598 - protein, 68 aa, Homo sapiens
  SIGNAL -40..-1: score 3.9 seq CVYVCVCISVCAC/VY
  UNSURE -28: Xaa=Ile or Met
  UNSURE -22: Xaa=Leu or Val
MRVCAHQCLHVCXCVYVCXCARICVCACVYVCVCISVCACVYVCVHLCVCACVHACVCVCACVHLCVC

SEQ ID NO: 4599 - protein, 56 aa, Homo sapiens
  SIGNAL -16..-1: score 11.3 seq PLLLSSLLGGSQA/MD
  UNSURE 24: Xaa=Ala or Ser
MLLPLLLSSLLGGSQAMDGRFWIRVQESVMVPEGLCISVXLLFLLPPTRLDRVYPS

SEQ ID NO: 4600 - protein, 66 aa, Homo sapiens
  SIGNAL -37..-1: score 4.5 seq CTTLLVYVRYAWQ/DD
MLITRLQSGIDFAIQLDESTDIGSCTTLLVYVRYAWQDDFLEDFLCFLNLTSHLSGLDIFTELERR

SEQ ID NO: 4601 - protein, 92 aa, Homo sapiens
  SIGNAL -34..-1: score 5.2 seq LWSSCWLAPLADG/ML
  UNSURE 8: Xaa=Pro or Gln or Arg
  UNSURE 11: Xaa=Gly or Arg or Trp
  UNSURE 28: Xaa= *  or Trp
  UNSURE 36: Xaa=Ile or Arg or Ser
  UNSURE 37: Xaa=Ile or Leu
  UNSURE 55: Xaa=His or Arg
MVGGLDPPGRRRFQKGFDWRNLWSSCWLAPLADGMLRYMGQXQRXASNPEGSTLEARPPAPXASVSPSVXXPHRPWAAKMETVSPATSXIAG

SEQ ID NO: 4602 - protein, 52 aa, Homo sapiens
  SIGNAL -47..-1: score 3.6 seq FLCLSLPRTGITG/MC
MVEKKTSGSLSVAQAGMQWRDLSSLQPPPPGFKRFLCLSLPRTGITGMCHHT

SEQ ID NO: 4603 - protein, 51 aa, Homo sapiens
  SIGNAL -40..-1: score 4.2 seq LLSGLCVAVCAQX/GH
  UNSURE 0: Xaa= *  or Gln
MSRGPCRSGLRGSPWVAVSAGAFLDTPLLSGLCVAVCAQXGHVGVMGFGSD

SEQ ID NO: 4604 - protein, 57 aa, Homo sapiens
  SIGNAL -44..-1: score 4 seq XLMVAMRCLGASP/XP
  UNSURE -38: Xaa=Ala or Glu or Gly or Pro or Gln or Arg
  UNSURE -23: Xaa=Lys or Arg
  UNSURE -13: Xaa=Ala or Asp
  UNSURE 1: Xaa=Arg or Thr
  UNSURE 8: Xaa=His or Leu or Pro or Gln or Arg
MAKFLSXDQINEYKECFSLYDXQQRGKIKATXLMVAMRCLGASPXPGEVQRXCRPTG

SEQ ID NO: 4605 - protein, 73 aa, Homo sapiens
  SIGNAL -14..-1: score 3.8 seq LDSLLALGGLVLL/RD
  UNSURE 16: Xaa=Gly or Val
  UNSURE 35: Xaa=Asp or Glu
  UNSURE 41: Xaa=Gly or Ser
  UNSURE 45: Xaa=Asp or His
  UNSURE 47: Xaa=Asn or Ser
  UNSURE 54: Xaa=Asp or Gly
MLDSLLALGGLVLLRDSVEWEGRSLLKALXKKSALCGEQVHILGCEVSXEEFREXFDSXIXNRLVYHXFFRDP

SEQ ID NO: 4606 - protein, 61 aa, Homo sapiens
  SIGNAL -22..-1: score 3.8 seq FGLLLGNLCSVKS/TE
  UNSURE 3: Xaa=Ile or Lys or Met or Asn or Arg or Ser or Thr
MTLAMYKTYFGLLLGNLCSVKSTEXLLPLLASSTLSPFISKMESCSCYPGWSAMAQSRLTA

SEQ ID NO: 4607 - protein, 114 aa, Homo sapiens
  SIGNAL -38..-1: score 3.5 seq LAMMNSILRGLNS/KQ
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTP

SEQ ID NO: 4608 - protein, 55 aa, Homo sapiens [sequence omitted]

SEQ ID NO: 4609 - protein, 106 aa, Homo sapiens
  SIGNAL -34..-1: score 3.6 seq XLALSLRLXCXGX/IS
  UNSURE -32: Xaa=Ala or Pro
  UNSURE -25: Xaa=Gly or Val
  UNSURE -15: Xaa=Lys or Arg
  UNSURE -13: Xaa=Gly or Ser
  UNSURE -5: Xaa=Asp or Glu
  UNSURE -3: Xaa=Ile or Ser
  UNSURE 0: Xaa=Ala or Thr
  UNSURE 26: Xaa=Lys or Thr
  UNSURE 34: Xaa=Leu or Gln
  UNSURE 39: Xaa= *  or Leu
  UNSURE 41: Xaa=Asp or Glu
  UNSURE 49: Xaa=Lys or Gln
  UNSURE 53: Xaa=Glu or Gly
  UNSURE 55: Xaa=His or Leu or Pro
  UNSURE 58: Xaa=Met or Val
MFXLCFLTVXFIISNLFFLXRXLALSLRLXCXGXISAHCNLRLPGSSNSPASASRVAGIXGVHHHARXIFVFXVXTGFHHVGXAGLXVXDLXILLPPPPKVLGLQA

SEQ ID NO: 4610 - protein, 58 aa, Homo sapiens
  SIGNAL -19..-1: score 5.9 seq PXXLLILAHITQS/CP
  UNSURE -12: Xaa= *  or Cys or Tyr
  UNSURE -11: Xaa=Met or Val
MMNQTHPXXLLILAHITQSCPWAHVGAAPSALLIHRWELRGCSYLKLFLVMVLIFEML

SEQ ID NO: 4611 - protein, 63 aa, Homo sapiens
  SIGNAL -26..-1: score 5.6 seq LWCLLPPASFTHS/LG
  UNSURE 6: Xaa=Ala or Asp or Gly or Val
MQTFEEGHLPENFLWCLLPPASFTHSLGFCQXLHCSFLNFFPSLPLFYFVVPCLSMAFPSLSC

SEQ ID NO: 4612 - protein, 55 aa, Homo sapiens
  SIGNAL -35..-1: score 4.9 seq LFIFIGSLQPVPT/RF
  UNSURE 9: Xaa=Asp or Gly or Val
MLLHYLKLKGDQWKLSSVSTLILFIFIGSLQPVPTRFKRFSCLXHLSSRDHRQAL

SEQ ID NO: 4613 - protein, 119 aa, Homo sapiens
  SIGNAL -18..-1: score 11 seq LLLWASLLTGAWP/SF
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFV

SEQ ID NO: 4614 - protein, 65 aa, Homo sapiens
  SIGNAL -22..-1: score 4.2 seq TAYWLSFMSWAQS/SS
  UNSURE 7: Xaa=Phe or Ile or Leu
MPPQSCCSKTAYWLSFMSWAQSSSFGSRXESTSPCTDHCSGPREEQLCSSRVFHCITHPNGRIHR

SEQ ID NO: 4615 - protein, 73 aa, Homo sapiens
  SIGNAL -22..-1: score 6.2 seq ILVLTLNVNGLNA/SN
MTESNSHISILVLTLNVNGLNASNKRHRVASWIMKQNTMVCCIQETHPPCNDAHRLKVKEWRKICQANRKQKK

SEQ ID NO: 4616 - protein, 87 aa, Homo sapiens
  SIGNAL -48..-1: score 3.8 seq NSLLLLLCLYIYP/HS
  UNSURE 7: Xaa=Asp or Glu
  UNSURE 8: Xaa= *  or Cys or Phe or Leu or Trp or Tyr
  UNSURE 21: Xaa=Ala or Asp or Glu or Gly or Ile or Lys or Met or Asn or Arg or Ser or Thr or Val
  UNSURE 22: Xaa=Cys or Phe
MRKRKISVCQQTWALLCKNFLKKWRMKRESLMEWLNSLLLLLCLYIYPHSHQVNXXSSLLTMDLGRVDXXNESRFSVVYTPVTNTTP

SEQ ID NO: 4617 - protein, 100 aa, Homo sapiens
  SIGNAL -40..-1: score 5.9 seq VVLAWGLLNVSMA/GM
  UNSURE 26: Xaa=Ile or Asn or Ser
MMQGEAHPSASLIDRTIKMRKETEARKVVLAWGLLNVSMAGMIYTEMTGKLISSYYNVTYWPLWYXELALASLFSLNALFDFWRYFKYTVAPTSLVVSPG

SEQ ID NO: 4618 - protein, 55 aa, Homo sapiens
  SIGNAL -34..-1: score 7.2 seq LLLFSLLVSPPTC/KV
  UNSURE 16: Xaa=His or Leu or Pro
MKYLRHRRPNATLILAIGAFTLLLFSLLVSPPTCKVQEQPPAIPEALAWXTPPTR

SEQ ID NO: 4619 - protein, 65 aa, Homo sapiens [sequence omitted]

SEQ ID NO: 4620 - protein, 86 aa, Homo sapiens
  SIGNAL -44..-1: score 3.5 seq AVVMLMVAIFAGT/MQ
  UNSURE 21: Xaa=Lys or Asn
  UNSURE 22: Xaa=Ala or Ser
MFTLAEVASLNDIQPTYRILKPWWDVFMDYLAVVMLMVAIFAGTMQLTKDQVVCLPVLPSPVNSXXHTPPGNAEVTTNIPKMEAAT

SEQ ID NO: 4621 - protein, 60 aa, Homo sapiens
  SIGNAL -33..-1: score 3.8 seq WSLALSSRLECNG/AI
MSSCRKYSSTDVADFAPWQKWSLALSSRLECNGAISAYCNLCFPGSSESASRVQAILLPQ

SEQ ID NO: 4622 - protein, 56 aa, Homo sapiens
  SIGNAL -23..-1: score 6.2 seq LCNLSIFFCCSVS/QP
MVISFLLICKLCNLSIFFCCSVSQPLCQIKNHPGQTQWLMLVIPTLWEAKVGELLE

SEQ ID NO: 4623 - protein, 80 aa, Homo sapiens [sequence omitted]

SEQ ID NO: 4624 - protein, 57 aa, Homo sapiens
  SIGNAL -19..-1: score 4.2 seq LLSLAAYLSGPHQ/EP
MMDLRPLLSLAAYLSGPHQEPSVPTRDGDVNNLPKPNPARSVKQGGIWKAEQERVEV

SEQ ID NO: 4625 - protein, 98 aa, Homo sapiens
  SIGNAL -29..-1: score 5.8 seq LHAXAGAAASVIA/AD
  UNSURE -10: Xaa=Phe or Leu
MSLRLDTTPSCNSARPLHAXAGAAASVIAADCSGFLHQRTTKRNLAKGKEESLDSDLYAELRCMCIKTTSGIHPKNIQSLEVIGKGTHCNQVEVIATL

SEQ ID NO: 4626 - protein, 101 aa, Homo sapiens
  SIGNAL -27..-1: score 5.9 seq ALALAXAPDLAQA/PL
  UNSURE -8: Xaa=Ile or Leu
  UNSURE 66: Xaa=Ile or Met
  UNSURE 67: Xaa=Phe or Ile or Leu or Val
MDSAACAAAATPVPALALAXAPDLAQAPLALPGLLSPSCLLSSGQEVNGSERGTCLWRPWLSSTNDSPRQMRKLVDLAAGGATAAEVTKAESXXHHPVRLF

SEQ ID NO: 4627 - protein, 99 aa, Homo sapiens
  SIGNAL -41..-1: score 6.5 seq IAVLVLYFLFVLA/VG
  UNSURE 9: Xaa=Ser or Thr
  UNSURE 31: Xaa=Ala or Thr
MESGTSSPQPPQLDPLDAFPQKGLEPGDIAVLVLYFLFVLAVGLWSTVKXKRDTVKGYFLAGGDMVWWPVGXSLFASNVGSGHFIGLAGSGAATGISVS

SEQ ID NO: 4628 - protein, 75 aa, Homo sapiens
  SIGNAL -25..-1: score 4.8 seq LWFPSMLFSLSLL/SN
  UNSURE 47: Xaa=His or Leu or Pro or Arg
MTQAGQSSGCTALWFPSMLFSLSLLSNLNQIGSSHLDRPHIPGQSAQLFIYQMSSQQLQQQPSANKKAGKIXNTP

SEQ ID NO: 4629 - protein, 84 aa, Homo sapiens
  SIGNAL -31..-1: score 3.6 seq LFIYLVFVECLLC/TR
  UNSURE 4: Xaa= *  or Trp
  UNSURE 5: Xaa=Asp or Glu
  UNSURE 6: Xaa=Arg or Ser
  UNSURE 9: Xaa= *  or Gly
MGIDIFYPSHIPDFHPIHLFIYLVFVECLLCTRNXXXLSXFNCDNAQIIFTTGSSSSGGNKPFKSSLCTVHRGQERERIECQGN

SEQ ID NO: 4630 - protein, 57 aa, Homo sapiens
  SIGNAL -44..-1: score 6.9 seq LNLLSSWSSMAQS/RL
MEPCSVTQAGVQWHNLDSLQPPSPRFKLFSCLNLLSSWSSMAQSRLTATSISKPPPP

SEQ ID NO: 4631 - protein, 64 aa, Homo sapiens
  SIGNAL -47..-1: score 7.6 seq LXLGEGLTFLCLC/QV
  UNSURE -12: Xaa=Ile or Leu
  UNSURE 6: Xaa=Lys or Asn
MPVCFYSLICFFIYFCLLSPRETIEEVALFQFSLLXLGEGLTFLCLCQVMTNXMQLLFLSGVVC

SEQ ID NO: 4632 - protein, 95 aa, Homo sapiens [sequence omitted]

SEQ ID NO: 4633 - protein, 61 aa, Homo sapiens
  SIGNAL -38..-1: score 4.4 seq LELLTSGDPLASA/SQ
MLHHAWLILYLVLVEMGFLHVGQAGLELLTSGDPLASASQSAGDTGMNPCARPNFCIFSRD

SEQ ID NO: 4634 - protein, 102 aa, Homo sapiens
  SIGNAL -25..-1: score 4.4 seq VVSWLVSAEGSHP/DP
  UNSURE -14: Xaa=Gly or Arg
  UNSURE 6: Xaa= *  or Cys or Trp
MTMPSYHASMAXVVSWLVSAEGSHPDPAPFXADNPSELPPPMERTGGIGDSRPPSFHPHAGGGSQENLDNDTETDSLVSAQRERPRRRDGPEHATRLNGTAK

SEQ ID NO: 4635 - protein, 115 aa, Homo sapiens
  SIGNAL -23..-1: score 5.9 seq TLKFLTLLQKSNA/KR
  UNSURE 3: Xaa=Ala or Pro
MMTAPVLAAQTLKFLTLLQKSNAKRXNLDRLHDELWYNDPGQMNDGPLCKCSAKARRTGIRHSIYPGEEAIKPCRPMTNNAGRLFHYRITVSPPTNFLTDRPTVIEYDDHEYIFE

SEQ ID NO: 4636 - protein, 60 aa, Homo sapiens
  SIGNAL -28..-1: score 7.7 seq LVMCFLSYFGTFA/VE
MAQSIHMYAARVQWGLVMCFLSYFGTFAVEFRHYRYEIVCSEYQENFLSFSESLSEASEY

SEQ ID NO: 4637 - protein, 135 aa, Homo sapiens
  SIGNAL -20..-1: score 10.6 seq LLTLLALLAHTSA/VA
  UNSURE 5: Xaa=Lys or Arg or Thr
  UNSURE 72: Xaa= *  or Cys or Phe or His or Ile or Lys or Leu or Met or Asn or Pro or Gln or Arg or Ser or Thr or Trp or Tyr
  UNSURE 75: Xaa=Arg or Thr
  UNSURE 91: Xaa=Ala or Glu
  UNSURE 97: Xaa=Cys or Ser
MQHRGFLLLTLLALLAHTSAVAKKXDKVKKGGPGLGLGGGDCRVKIATKANPWDGKSLKPDSVRSQLETSLKRLQCPQVDLFYLHAPDHGTXGGXDAACLPAAAPGGKFVXLGLSKXASWEVAEICTSARAMAGS

SEQ ID NO: 4638 - protein, 51 aa, Homo sapiens
  SIGNAL -40..-1: score 3.9 seq CVNLLLGFEPVIS/RS
  UNSURE 4: Xaa=Arg or Ser
MRYFQGPSPYSEIEIELCDHVYSFQGLCVNLLLGFEPVISRSRXSSLAVES

SEQ ID NO: 4639 - protein, 136 aa, Homo sapiens
  SIGNAL -29..-1: score 11.4 seq LCLLGCLLSHAAA/AP
  UNSURE 16: Xaa=Lys or Thr
  UNSURE 17: Xaa=Asp or Val
  UNSURE 19: Xaa=Glu or Lys
  UNSURE 22: Xaa=Leu or Val
  UNSURE 26: Xaa=Lys or Asn
  UNSURE 27: Xaa=Ile or Asn or Ser or Thr
  UNSURE 33: Xaa=Lys or Asn
  UNSURE 34: Xaa=Glu or Lys
  UNSURE 66: Xaa=Asp or Glu
  UNSURE 67: Xaa=Ala or Pro or Ser or Thr
  UNSURE 75: Xaa=Lys or Asn
  UNSURE 80: Xaa=Lys or Asn or Arg or Ser
  UNSURE 88: Xaa=Ala or Cys or Asp or Phe or Gly or His or Ile or Leu or Asn or Pro or Arg or Ser or Thr or Val or Tyr
  UNSURE 104: Xaa=Ala or Pro
MEALMARGALTGPLRALCLLGCLLSHAAAAPSPIIKFPGDVAPKXXKXLAXQYLXXFYGCPXXSCNLFVLKDTLKKMQKFFGLPQTGDLDQNTIXXMRKPRCGXPDVAXYNFFPRKXKWDKNQITYRIIGYTXDLD

SEQ ID NO: 4640 - protein, 91 aa, Homo sapiens
  SIGNAL -38..-1: score 6.3 seq PCVSLLWAPRXFA/SS
  UNSURE -3: Xaa=Ala or Gly
  UNSURE 11: Xaa=His or Gln
  UNSURE 12: Xaa=Cys or Gly
MNHLMPLTVLHSVLEMLRTPRTPPWPCVSLLWAPRXFASSCSQAFTTLXXNCLLTNPSPTLDCDLPEGSEILNSSLYPHCLLSAWNTRHST

SEQ ID NO: 4641 - protein, 59 aa, Homo sapiens
  SIGNAL -25..-1: score 4.3 seq ALYLSLNLYFANS/LY
  UNSURE -21: Xaa=Lys or Arg
  UNSURE 15: Xaa=Cys or Phe
  UNSURE 18: Xaa=Phe or Leu or Val
  UNSURE 20: Xaa=Cys or Phe or Gly or Val
  UNSURE 24: Xaa=Ile or Lys or Met or Asn or Arg or Ser or Thr
  UNSURE 25: Xaa= *  or Ala or Glu or Gly or Lys or Leu or Met or Arg or Ser or Thr or Val or Trp
MYCLXCVEKIAKALYLSLNLYFANSLYYMCVCSYIYFYLXIYXYXLIKXXSYYVAQTGL

SEQ ID NO: 4642 - protein, 70 aa, Homo sapiens
  SIGNAL -38..-1: score 7.9 seq LPFLSLFWPWAPG/AV
  UNSURE 15: Xaa= *  or Ala or Gly or Ser
MGGFFPPTEVREVCANQGAAHNRDRLPFLSLFWPWAPGAVSVGQARYRTPTTXAPSASVPWPRAGTCRTP

SEQ ID NO: 4643 - protein, 69 aa, Homo sapiens
  SIGNAL -20..-1: score 7.2 seq LALWLGAVGVGVA/EP
  UNSURE 4: Xaa=Ala or Gly or Pro or Arg
  UNSURE 11: Xaa=Leu or Met
  UNSURE 41: Xaa=Phe or Ile or Leu or Val
MRRLLIPLALWLGAVGVGVAEPPXEAQRRGXQVALEEFHKHPPVQWAFQETSVESAVDTPXPAGIFVRP

SEQ ID NO: 4644 - protein, 78 aa, Homo sapiens
  SIGNAL -27..-1: score 3.6 seq RVLAGXSLRRCEA/AG
  UNSURE -8: Xaa=Leu or Pro
  UNSURE 18: Xaa=Ala or Pro or Ser or Thr
  UNSURE 32: Xaa=Leu or Met or Val
MAGSEELGLREDTLRVLAGXSLRRCEAAGSPVPTPPRSPAQEEPXDFLSRLRRCLPCSXGRGAAPSESPRPCSLPIRP

SEQ ID NO: 4645 - protein, 77 aa, Homo sapiens
  SIGNAL -41..-1: score 9.5 seq LIIFLSFLPFINS/SF
  UNSURE 26: Xaa=Glu or Gly
  UNSURE 27: Xaa=Ser or Thr
MFQNIQKCLNVPFVRGYHVFYINLNAVILIIFLSFLPFINSSFVYKTNPLYDAISNYVFSFRYPNLXXFALDVRLVF

SEQ ID NO: 4646 - protein, 74 aa, Homo sapiens
  SIGNAL -22..-1: score 10.3 seq FLLLLLLLLLTRW/AP
  UNSURE 13: Xaa=His or Gln
  UNSURE 27: Xaa= *  or Trp
MIRAAPPPLFLLLLLLLLLTRWAPHRAMAPSWSSXMVSPWSTTPILGIXLPMCYTWSPQLGWASPTPMTSFMQL

SEQ ID NO: 4647 - protein, 73 aa, Homo sapiens [sequence omitted]

SEQ ID NO: 4648 - protein, 65 aa, Homo sapiens
  SIGNAL -46..-1: score 3.5 seq RWLCLQAYLASFS/LE
MSLTASGPRAAWEERVGGLHTWGANIPTAPDSQRWLCLQAYLASFSLESPHRIYLESPPTLLFPP

SEQ ID NO: 4649 - protein, 52 aa, Homo sapiens
  SIGNAL -41..-1: score 9.9 seq ILPFLLFPFPVNA/RS
  UNSURE 4: Xaa=Leu or Ser
MSSWMYLGYPIVTSNTTCLKLISSSFPQILPFLLFPFPVNARSHXVAQTKSP

SEQ ID NO: 4650 - protein, 64 aa, Homo sapiens
  SIGNAL -41..-1: score 5 seq RLLLILSGCLVYG/TA
MAGGMKVAVSPAVGPGPWGSGVGGGGTVRLLLILSGCLVYGTAETDVNVVMLQESQVCEKRASL

SEQ ID NO: 4651 - protein, 59 aa, Homo sapiens [sequence omitted]

SEQ ID NO: 4652 - protein, 108 aa, Homo sapiens
  SIGNAL -20..-1: score 6.8 seq GLLWMLFVSELRA/AT
  UNSURE 86: Xaa=Glu or Lys or Gln
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVXDS

SEQ ID NO: 4653 - protein, 76 aa, Homo sapiens
  SIGNAL -25..-1: score 3.5 seq IFLGKSLFSLLEA/MI
MSFNLQSSKKLFIFLGKSLFSLLEAMIFALLPKPRKNVAGEIVLITGAGSGLGRLLALQFARLGSVLVLWDINKEG

SEQ ID NO: 4654 - protein, 130 aa, Homo sapiens
  SIGNAL -21..-1: score 5.1 seq PLLLLLPLLNVEP/SG
  UNSURE 27: Xaa=Ile or Arg
MSPPPLLQPLLLLLPLLNVEPSGATLIRIPLHRVQPGRRILNLLRGWXEPAELPKLGAPSPGDKPIFVPLSNYRDVQYFGEIGLGTPPQNFTVAFDTGSSNLWVPSRRCHFFSVPCWLHTDLIPKPLAPS

SEQ ID NO: 4655 - protein, 113 aa, Homo sapiens
  SIGNAL -18..-1: score 10.4 seq LLQWLLLLLPTLC/GP
  UNSURE 8: Xaa=Asn or Thr
  UNSURE 30: Xaa=Lys or Gln
  UNSURE 45: Xaa=Glu or Val
MAESHLLQWLLLLLPTLCGPGTAAWXTSSLACAQGPEFWCQSLEQALXCRALGHCLQEVWGHXGADDLCQECEDIVHILNKMAKEAIFQDTMRKFLEQECNVLPLKLLMPQCT

SEQ ID NO: 4656 - protein, 68 aa, Homo sapiens
  SIGNAL -42..-1: score 7.2 seq ILFSLSFLLVIIT/FP
  UNSURE 14: Xaa=Ala or Glu
  UNSURE 18: Xaa=Ala or Asp
MDSRVSSPEKQDKENFVGVNNKRLGVCGWILFSLSFLLVIITFPISIWMCLKIIKXYERXVVFRLGRH

SEQ ID NO: 4657 - protein, 74 aa, Homo sapiens
  SIGNAL -41..-1: score 3.5 seq QLLGCLQCCWLQS/GR
  UNSURE 23: Xaa=Cys or Gly or Arg or Ser
MFYVAMTKTHKRIRSLCNIHHGLFQFTQQLLGCLQCCWLQSGRAPATYYLVESIEKSAHGSVLXTYDQTQTRIG

SEQ ID NO: 4658 - protein, 73 aa, Homo sapiens
  SIGNAL -30..-1: score 5.8 seq KLLFVLFLRQCLT/LL
  UNSURE -29: Xaa=Lys or Arg
  UNSURE -27: Xaa=Gly or Val
  UNSURE -25: Xaa=Ala or Thr
MXDXVXSSIQALRLNIKKLLFVLFLRQCLTLLPRLECSGTVSAHCNLCLLGSSNSPASASQVAGLLSCATLPG

SEQ ID NO: 4659 - protein, 79 aa, Homo sapiens
  SIGNAL -16..-1: score 14.8 seq SLPLLLLLLGAWA/IP
MRLSLPLLLLLLGAWAIPGGLGDRAPLTATAPQLDDEEMYSAHMPAHLRCDACRAVAYQVSPSPLSPALLTPLLKPAPT

SEQ ID NO: 4660 - protein, 54 aa, Homo sapiens
  SIGNAL -49..-1: score 8.5 seq IVFLLLRVSPCLG/PS
  UNSURE -40: Xaa=Cys or Ser
  UNSURE 3: Xaa=His or Gln
MHIFSICCMXSELHKMKSLSLQLASEKRSLVALVEEIVFLLLRVSPCLGPSXKP

SEQ ID NO: 4661 - protein, 52 aa, Homo sapiens
  SIGNAL -23..-1: score 3.7 seq TNLLCLTFQRCQS/YN
  UNSURE 21: Xaa=Lys or Asn
MLSQSFQKNKTNLLCLTFQRCQSYNWLNIFEATYMTTLFISVIXTNFLKRYL

SEQ ID NO: 4662 - protein, 69 aa, Homo sapiens
  SIGNAL -15..-1: score 3.6 seq VVEASSSVRLASS/EV
MLVVEASSSVRLASSEVTSWSILVTPSASTPIISLSAGPLRTPSHSKTWLLLGALEPASERPCSSVLRS

SEQ ID NO: 4663 - protein, 55 aa, Homo sapiens
  SIGNAL -35..-1: score 5.4 seq LVVVCYLSWRVSS/RS
MPLKNLFSVGLWDPYNLLKKHVLVVVCYLSWRVSSRSWTLLITPVTLHASLSTQA

SEQ ID NO: 4664 - protein, 73 aa, Homo sapiens
  SIGNAL -24..-1: score 5.3 seq LFHLLFLPHYIET/FK
MCSHASMSFHTLFHLLFLPHYIETFKPQSKHCFFWIAAFLTSLLTPQSLQGFHSSLCALRSQHFPSTCNCFCY

SEQ ID NO: 4665 - protein, 56 aa, Homo sapiens
  SIGNAL -17..-1: score 3.8 seq TVLSGCASRGTTG/LP
MESFTVLSGCASRGTTGLPQEVHVLNLRTAGQGPGQLQREVTLHLNPISSVHIHHN

SEQ ID NO: 4666 - protein, 59 aa, Homo sapiens
  SIGNAL -26..-1: score 8.7 seq LLLLDVPTAAVQA/SP
MTLSPLLLFLPPLLLLLDVPTAAVQASPLQALDFFGNGPPVNYKTGNLYLRGPLKKSNA

SEQ ID NO: 4667 - protein, 90 aa, Homo sapiens
  SIGNAL -17..-1: score 5.5 seq LHLPALSSSCLWT/FP
MGGFLHLPALSSSCLWTFPPMCVRIFSYVPLPILTPKTINLIPVLAICSCLPGPGPALPLPAFPTLLVSWYHCPPQKKTGMMDTDDFRAC

SEQ ID NO: 4668 - protein, 71 aa, Homo sapiens
  SIGNAL -41..-1: score 3.9 seq CRCLITLPRSCRP/ST
  UNSURE 7: Xaa=Ala or Thr
  UNSURE 17: Xaa=Ala or Gly or Pro or Arg
MLGPPLQPGSHGKVLAPQGSSGLTPPFPCRCLITLPRSCRPSTSVPRXASTRSSQRPXSSCWRSSCSTTAT

SEQ ID NO: 4669 - protein, 72 aa, Homo sapiens
  SIGNAL -28..-1: score 8 seq IVFCFVFLRQSLA/LS
  UNSURE 13: Xaa=Ala or Gly
  UNSURE 18: Xaa=Pro or Arg
  UNSURE 19: Xaa=Leu or Pro
MIRFSLIWKLMIDFIIVFCFVFLRQSLALSPRLECSGAISXHSNLXXPAFKQFSCLSLLSSWDCRCPTMPDC

SEQ ID NO: 4670 - protein, 64 aa, Homo sapiens
  SIGNAL -15..-1: score 6.7 seq LFVLFLFLFFSFL/FF
  UNSURE 3: Xaa= *  or Trp
  UNSURE 4: Xaa=Glu or Lys
MRLFVLFLFLFFSFLFFXXGSLALLPRLECSGMILAHCKLHLPGSRHSPASASRVAATIGTRHH

SEQ ID NO: 4671 - protein, 57 aa, Homo sapiens
  SIGNAL -20..-1: score 4.4 seq LHLLGSSDSXCXS/LP
  UNSURE -4: Xaa=Pro or Ser
  UNSURE -2: Xaa=Phe or Leu or Pro or Ser
MISAHHNLHLLGSSDSXCXSLPSSWDYSHAPSRPANFVFLVETGFLYVGQAGLELPT

SEQ ID NO: 4672 - protein, 61 aa, Homo sapiens [sequence omitted]

SEQ ID NO: 4673 - protein, 52 aa, Homo sapiens
  SIGNAL -19..-1: score 7 seq STVVLQVLTQATS/QD
MDLNSASTVVLQVLTQATSQDTAVLKPAEEQLKQWETQPGFYSVLLNIFTNH

SEQ ID NO: 4674 - protein, 64 aa, Homo sapiens
  SIGNAL -19..-1: score 7.9 seq LLLALLLPGGDNA/DA
  UNSURE 33: Xaa= *  or Glu
MLFLQFLLLALLLPGGDNADASQEHVSFHVIQIFSFVNQSWARGQGSGWLEXLQTHGWDSESDT

SEQ ID NO: 4675 - protein, 61 aa, Homo sapiens [sequence omitted]

SEQ ID NO: 4676 - protein, 91 aa, Homo sapiens
  SIGNAL -49..-1: score 6.4 seq AVSFAPLIQPCHS/ES
  UNSURE -17: Xaa=Lys or Asn
MKNLLKVGGILVMPLEEKLTKITRTGPSAWETXKILAVSFAPLIQPCHSESGKSRLVQLPPVAVRSLQDLARIAIRGTIKKIIHQETVSKN

SEQ ID NO: 4677 - protein, 56 aa, Homo sapiens
  SIGNAL -36..-1: score 4.6 seq TLLLWCFSALLPT/IV
MDKFNVTKPVEYLNNPIITQFFPTLLLWCFSALLPTIVYYSAFFEAHWTRSGENRT

SEQ ID NO: 4678 - protein, 74 aa, Homo sapiens
  SIGNAL -43..-1: score 3.5 seq QHWLLGGFPRTLG/QA
MAKQYIEKSLLVPDHVITRLMMSELENRRGQHWLLGGFPRTLGQAEALDKICEVDLVISLNIPFETLKDRLSRQ

SEQ ID NO: 4679 - protein, 66 aa, Homo sapiens
  SIGNAL -45..-1: score 3.6 seq ALLELIDSPECLS/KC
  UNSURE -33: Xaa=Met or Val
  UNSURE 21: Xaa=Gly or Val
MALHFQSLAELEXLCTHLYIGTDLTQRIEAEKALLELIDSPECLSKCQLLLEQGTTSYAQLLAATX

SEQ ID NO: 4680 - protein, 60 aa, Homo sapiens
  SIGNAL -29..-1: score 7.6 seq PTLAIALAANAWA/FV
MYTYGNKQHNSPTWDDPTLAIALAANAWAFVLFYVIPEVSQVTKSSPEQSYQGDMYPTRD

SEQ ID NO: 4681 - protein, 56 aa, Homo sapiens
  SIGNAL -43..-1: score 6.1 seq SAATLASLGGTSS/RR
MKELERQQKEVEERPEKDFTEKGSRNMPGLSAATLASLGGTSSRRGSGDTSISIDP

SEQ ID NO: 4682 - protein, 73 aa, Homo sapiens
  SIGNAL -36..-1: score 5.3 seq ALYIMCVPHSVWG/CA
  UNSURE -28: Xaa=Asn or Ser
MFRSDRMWXCHWKWKPSPLLFLFALYIMCVPHSVWGCANCRVVLSNPSGTFTSPCYPNDYPNSQACMWTLRDP

SEQ ID NO: 4683 - protein, 126 aa, Homo sapiens
  SIGNAL -30..-1: score 10.6 seq GLLCCAALSLLWA/GP
MHRYRRPLRHAASAMSIGLLCCAALSLLWAGPVNAGVTQTPKFQVLKTGQSMTLQCAQDMNHEYMSWYRQDPGMGLRLIHYSVGAGITDQGEVPNGYNVSRSTTEDFPLRLLSAAPSQTSVYFCAS

SEQ ID NO: 4684 - protein, 130 aa, Homo sapiens
  SIGNAL -48..-1: score 5.7 seq LLLFFGKLLVVGG/VG
  UNSURE 32: Xaa=Ile or Thr
MIAIYGKNFCVSAKNAFMLLMRNIVRVVVLDKVTDLLLFFGKLLVVGGVGVLSFFFFSGRIPGLGKDFKSPHLNYYWLPXMTSILGAYVIASGFFSVFGMCVDTLFLCFLEDLERTTAPWTALLHVQELL

SEQ ID NO: 4685 - protein, 76 aa, Homo sapiens
  SIGNAL -23..-1: score 6.2 seq PLPLLLLLQPGLP/LF
  UNSURE -18: Xaa=Phe or Ile
  UNSURE 13: Xaa=Ile or Leu
  UNSURE 15: Xaa= *  or Lys or Asn or Tyr
  UNSURE 16: Xaa=Lys or Gln
  UNSURE 17: Xaa=Pro or Thr
MDLVCXPLSVPLPLLLLLQPGLPLFSALHPRLCTEXHXXXRVVYCLFCFLGFQCPSGMQVGSQPVCSLSAPPRPAP

SEQ ID NO: 4686 - protein, 79 aa, Homo sapiens
  SIGNAL -19..-1: score 9.9 seq ILFLVFLLAGLRS/KA
MKSFSRILFLVFLLAGLRSKAAPSAPLPLGCGFPDMAHPSETSPLKGASENSKRDRLNPEFPGTPYPEPSKLPHTVSLE

SEQ ID NO: 4687 - protein, 88 aa, Homo sapiens
  SIGNAL -15..-1: score 7.5 seq AVLLALLMAGLAL/QP
  UNSURE 12: Xaa=Lys or Arg
  UNSURE 16: Xaa=Gly or Ser
  UNSURE 58: Xaa=Asp or His
MKAVLLALLMAGLALQPGTALLCYSWXAQVXNEDCLQVENCTQLGEQCWTARIRAVGLLTVISKGCSLNCVDXSQDYYVGKKNITCCD

SEQ ID NO: 4688 - protein, 128 aa, Homo sapiens
  SIGNAL -28..-1: score 9.5 seq LVXFSLLATAILG/AV
  UNSURE -11: Xaa=Phe or Ser
MASKGMRHFCLISEQLVXFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSG

SEQ ID NO: 4689 - protein, 59 aa, Homo sapiens
  SIGNAL -44..-1: score 3.7 seq LAERLGLFEELWA/AQ
MALYQRWRCLRLQGLQACRLHTAVVSTPPRWLAERLGLFEELWAAQVKRLASMAQKEPQ

SEQ ID NO: 4690 - protein, 66 aa, Homo sapiens
  SIGNAL -29..-1: score 13 seq LLLVLLLVTRXRS/MP
  UNSURE -3: Xaa=Ser or Thr
  UNSURE 18: Xaa=Leu or Val
MWLWEDQGGLLGPFSFLLLVLLLVTRXRSMPASSPAASSFYCASSAXSRCPLAGPCRCSSPGTAFL

SEQ ID NO: 4691 - protein, 88 aa, Homo sapiens
  SIGNAL -48..-1: score 5.4 seq ILLEVFVWNGLQG/LP
  UNSURE -47: Xaa=Phe or Val
MXPNNFWQKLGRKKPRIFTCTQSSTGEAAVKAENLILLEVFVWNGLQGLPSELSDTSGSSKKLGSLVGWWRTLKMAPACLWSMWESPP

SEQ ID NO: 4692 - protein, 70 aa, Homo sapiens
  SIGNAL -38..-1: score 3.6 seq LSWLITWFGHXLS/DF
  UNSURE -3: Xaa=Asp or Glu or Val
MPIIDQVNPELHDFMQSAEVGTIFALSWLITWFGHXLSDFRHVVRLYDFFLACHPLMPIYFAAVIVLYRE

SEQ ID NO: 4693 - protein, 102 aa, Homo sapiens
  SIGNAL -20..-1: score 3.9 seq FLAPSSGVQPTLA/MP
MVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHS

SEQ ID NO: 4694 - protein, 62 aa, Homo sapiens
  SIGNAL -45..-1: score 3.9 seq SLLTESSASRVHA/IX
  UNSURE -18: Xaa=Phe or Leu or Val
  UNSURE -15: Xaa=Leu or Pro
  UNSURE 2: Xaa=Leu or Pro
  UNSURE 9: Xaa= *  or Tyr
  UNSURE 17: Xaa=Ile or Ser
MCFRLRLFIAPPPFFFETESRSDAQAGXQWXRSLLTESSASRVHAIXLPQPPEXLGLQAPTX

SEQ ID NO: 4695 - protein, 52 aa, Homo sapiens
  SIGNAL -18..-1: score 7.2 seq LFFLLRIALASWA/LF
MMTLALFFLLRIALASWALFWIHMNFRRAFFHLRWFDINSTESVNCFGQYGL

SEQ ID NO: 4696 - protein, 85 aa, Homo sapiens
  SIGNAL -45..-1: score 6.7 seq PMLGLAAFRWIWS/RE
  UNSURE 35: Xaa=Asp or Glu
MNNLNDPPNWNIRPNSRADGGDGSRWNYALLVPMLGLAAFRWIWSRESQKEVEKEREAYRRRTAAFQQDLEAKYHAMISXNRRAV

SEQ ID NO: 4697 - protein, 85 aa, Homo sapiens
  SIGNAL -20..-1: score 9.6 seq LLALLLCGRPGRG/QT
  UNSURE 48: Xaa= *  or Cys or Phe or Leu or Ser or Trp or Tyr
  UNSURE 49: Xaa= *  or Glu or Lys or Gln
MKALGAVLLALLLCGRPGRGQTQQEEEEEDEDHGPDDYDEEDEDEVEEEETNRLPGGRSRVLLRCYTXXSLPRDERCNLTQNCSH

SEQ ID NO: 4698 - protein, 80 aa, Homo sapiens
  SIGNAL -19..-1: score 7.2 seq VSIMLLLVTVSDC/AV
MRGATRVSIMLLLVTVSDCAVITGACERDVQCGAGTCCAISLWLRGLRMCTPLGREGEECHPGSHKIPFFRKRKHHTCPC

SEQ ID NO: 4699 - protein, 105 aa, Homo sapiens
  SIGNAL -20..-1: score 10 seq SLLLXLLVASGDA/DM
  UNSURE -9: Xaa=Leu or Met
  UNSURE 10: Xaa= *  or Ala or Glu or Gly or Lys or Arg or Ser or Thr or Trp
  UNSURE 40: Xaa=His or Lys or Asn or Gln or Arg or Ser
  UNSURE 51: Xaa=Ala or Asp or Glu or Gly or Val
  UNSURE 55: Xaa=Pro or Thr
  UNSURE 61: Xaa= *  or Cys or Asp or Glu or Phe or Gly or His or Ile or Lys or Leu or Met or Asn or Gln or Arg or Ser or Val or Trp or Tyr
MGPEALSSLLLXLLVASGDADMKGHFDPAXCRYALGMQDRTIPDSDISASSSWSDSTAAXHSRLESSDGDXAWCXQVRCFXGGGVLAGGSTTTAPGGSGGHPGTA

SEQ ID NO: 4700 - protein, 68 aa, Homo sapiens
  SIGNAL -26..-1: score 10 seq FFLMLLAMGLSSA/IG
MSFLPPSVFWSFIFFLMLLAMGLSSAIGIMQGIITPLQDTFSFFRKHTKLLIVGVFLLMFVCGLFFTR

SEQ ID NO: 4701 - protein, 64 aa, Homo sapiens
  SIGNAL -14..-1: score 3.7 seq VLLARCEGHCSQA/SR
  UNSURE 9: Xaa=Ala or Cys or Gly or Pro or Arg or Ser or Thr
MVLLARCEGHCSQASRSEPLVSXSTVLKQPFRSSCHCCRPQTSKLKALRLRCSGGMRLTATYRY

SEQ ID NO: 4702 - protein, 91 aa, Homo sapiens
  SIGNAL -21..-1: score 9.6 seq CLAFLCFLMHARG/QR
  UNSURE 44: Xaa=Ile or Ser
  UNSURE 65: Xaa=Ser or Thr
MESWWGLPCLAFLCFLMHARGQRDFDLADALDDPEPTKKPNSDIYPKPKPPYYPQPENPDSGGNXYPRPKPRPQPQPGNSGNSGGXSMMWT

SEQ ID NO: 4703 - protein, 123 aa, Homo sapiens
  SIGNAL -42..-1: score 5.2 seq ILSILMGASAITG/IM
  UNSURE 53: Xaa=Asp or Glu
  UNSURE 72: Xaa=Asp or Glu
  UNSURE 76: Xaa=Asp or Glu
MGLAFLYMTVLGFDCITTGYAYTQGLSGSILSILMGASAITGIMGTVAFTWLRRKCGLVRTGLISGLAQLSCLILCVISVFMPGSPLDLSVSPFXDIRSRFIQGESITPTKIPXITTXIYMSN

SEQ ID NO: 4704 - protein, 63 aa, Homo sapiens
  SIGNAL -26..-1: score 5.7 seq AGLALGMLCLGHG/SN
  UNSURE 18: Xaa=Phe or Tyr
MEYCTDRESYSLAAGLALGMLCLGHGSNLIGMSDLNVPEQLYQXMVGGHRRFQTGMHREKHKS

SEQ ID NO: 4705 - protein, 108 aa, Homo sapiens
  SIGNAL -16..-1: score 8.5 seq ALLLLATLAVATG/PA
MRTALLLLATLAVATGPALTLRCHVCTSSSNCKHSVVCPASSRFCKTTNTVEPLRGNLVKKDCAESCTPSYTLQGQVSSGTSSTQCCQEDLCNEKLHNAAPTRTALAQ

SEQ ID NO: 4706 - protein, 52 aa, Homo sapiens
  SIGNAL -47..-1: score 5.9 seq TWLGLLSFQNLHC/FP
MHGFEIISLKEESPLGKVSQGPLFNVTSGSSSPVTWLGLLSFQNLHCFPDLP

SEQ ID NO: 4707 - protein, 65 aa, Homo sapiens
  SIGNAL -32..-1: score 5.4 seq SVFTLTLQAGLSA/IK
MLIQQFRYDNYRLHQLGNNSVFTLTLQAGLSAIKTPQCYKEDGSSKSPDCPVCSRSLNKLAHPCP

SEQ ID NO: 4708 - protein, 63 aa, Homo sapiens
  SIGNAL -35..-1: score 3.6 seq ITSVLLLFPRAGE/FP
MPWCLLPVLRFSVIFLFFGAVIITSVLLLFPRAGEFPAPEVEVKIVDDFFIGRYVLLAFLSAT

SEQ ID NO: 4709 - protein, 96 aa, Homo sapiens
  SIGNAL -21..-1: score 5.8 seq SLLFFLLLEGGKT/EQ
MGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEE

SEQ ID NO: 4710 - protein, 63 aa, Homo sapiens
  SIGNAL -43..-1: score 7 seq PWFLAPWCPGTQS/NR
  UNSURE -39: Xaa=Asn or Thr
MRETXPLPKPLKDTAPSSHGVGSDSPSATRPWFLAPWCPGTQSNRICHPPLSSPPDQATCLRG

SEQ ID NO: 4711 - protein, 94 aa, Homo sapiens
  SIGNAL -46..-1: score 7.8 seq LLYLSFAALGVVA/LR
MVFGYWKQPLITLAKKSVKCARECLRCSLRPLVLLYLSFAALGVVALRSVESPLAETHSCWLSLGMCVLQCEQQWVPTPVSFLCGLSGSSTIIV

SEQ ID NO: 4712 - protein, 68 aa, Homo sapiens
  SIGNAL -22..-1: score 5.9 seq LLILWFHLDCVSS/IL
MEKNPLAAPLLILWFHLDCVSSILNVEQSPQSLHVQEGDSTNFTCSFPSSNFYALHWYRWETAKSPEA

SEQ ID NO: 4713 - protein, 92 aa, Homo sapiens
  SIGNAL -18..-1: score 5 seq SLSVFGSLPASLG/TW
  UNSURE 72: Xaa= *  or Tyr
MDRPGSLSVFGSLPASLGTWLSSPAWLVDRPVRSAHPSANSTGVRMSVLVVLALRSLGRSCSLSQAAPSRWTRSNDAPQPPGSQHIFHTXVP

SEQ ID NO: 4714 - protein, 69 aa, Homo sapiens
  SIGNAL -29..-1: score 4.4 seq IVLHLVLQGMVYT/EY
MHGLLHYLFHTRNHTFIVLHLVLQGMVYTEYTWEVFGYCQELELSLHYLLLPYLLLGVNLFFFTLTCGT

SEQ ID NO: 4715 - protein, 53 aa, Homo sapiens
  SIGNAL -46..-1: score 5.2 seq LLTFLVFTXKLSS/LN
  UNSURE -30: Xaa=Ile or Met
  UNSURE -29: Xaa=Lys or Arg
  UNSURE -5: Xaa=Glu or Gly
  UNSURE 4: Xaa=Gly or Arg
MLMCKMLKSQKNCQENXXIKIILFLKPMCSPQYLLTFLVFTXKLSSLNIXKFH

SEQ ID NO: 4716 - protein, 68 aa, Homo sapiens
  SIGNAL -13..-1: score 4.2 seq MTDLLSASPWALT/IV
MTDLLSASPWALTIVSSELHLAPSMTTVDQLESQVDNVILQTGESASECFCLQCPSLGNIEGGVATGH

SEQ ID NO: 4717 - protein, 108 aa, Homo sapiens
  SIGNAL -42..-1: score 5.5 seq ILGLLFYCFFLCC/FP
  UNSURE 31: Xaa=Ile or Asn or Thr
  UNSURE 42: Xaa=Leu or Met
MRIDNKYFYYNSAHTYILCMQCICIEQFLILGLLFYCFFLCCFPFASNITVLYFVNKNQIMHIRIFIWKKSFXAFPLFPCKGTXFCYGFSLYKIIISYMTYAKISWRV

SEQ ID NO: 4718 - protein, 101 aa, Homo sapiens
  SIGNAL -29..-1: score 5.7 seq FIYYLFFLRWSLS/LS
  UNSURE 49: Xaa= *  or Cys or Gly
  UNSURE 60: Xaa= *  or Lys
MLIIDPQTSTFCLFYLFIYYLFFLRWSLSLSPRLECSGTILAHCKLCLPSSHHSPTSASQVAGTTGARHHAWLIFFFXIFSRDRVSPCXPGWSRCPDLVIP

SEQ ID NO: 4719 - protein, 84 aa, Homo sapiens
  SIGNAL -41..-1: score 5.6 seq LFLFLTSIAEXCS/TP
  UNSURE -39: Xaa=Phe or Ile or Val
  UNSURE -26: Xaa=Cys or Phe or Gly or Val
  UNSURE -16: Xaa=Asp or Glu
  UNSURE -3: Xaa=Cys or Tyr
  UNSURE 8: Xaa=Phe or Leu
MVXWLVLFALQIYSYXSTRDQPASRXRLLFLFLTSIAEXCSTPYSLLGXVFTVSFVALGVLTLCKFYLQGYRAFMNDPAMNRGG

SEQ ID NO: 4720 - protein, 59 aa, Homo sapiens
  SIGNAL -28..-1: score 6.1 seq LYLFSGFWTFXLG/KF
  UNSURE -24: Xaa=Glu or Lys
  UNSURE -21: Xaa=Phe or Leu
  UNSURE -18: Xaa=Lys or Arg
  UNSURE -3: Xaa=Leu or Val
  UNSURE 7: Xaa= *  or Trp
  UNSURE 10: Xaa=Ile or Met
  UNSURE 11: Xaa=Cys or Gly
  UNSURE 23: Xaa=Glu or Val
MNKEXVSXERXAQVRLYLFSGFWTFXLGKFKQGEXSYXXILERLLWQQQYXGWLVGDKR

SEQ ID NO: 4721 - protein, 53 aa, Homo sapiens
  SIGNAL -41..-1: score 7.7 seq LLCLGQLHHPGLG/RV
MELPAVNLESDSPRSLAADNLGLHCILRLLCLGQLHHPGLGRVGCGSAGLHRR

SEQ ID NO: 4722 - protein, 71 aa, Homo sapiens
  SIGNAL -24..-1: score 4.4 seq FVFLFWGVFETRS/LS
  UNSURE 9: Xaa=Cys or Phe or Leu or Trp
  UNSURE 14: Xaa=Phe or Val
  UNSURE 16: Xaa=Pro or Thr
MTVHIELPLLCFVFLFWGVFETRSLSLSPRLEXKLVEXMXHCSIKLLGSSDPPASAFLVAGTTGTCHDTQP

SEQ ID NO: 4723 - protein, 54 aa, Homo sapiens
  SIGNAL -42..-1: score 4.6 seq LLTCLCLHLKCVS/YR
MGNTKMKRYPDSQSAGITGVSHRARPFHLLLTCLCLHLKCVSYRHLVFTFLSVL

SEQ ID NO: 4724 - protein, 78 aa, Homo sapiens
  SIGNAL -26..-1: score 3.7 seq RLLEARSSRPAWA/XT
  UNSURE 1: Xaa=Ile or Lys or Asn
  UNSURE 4: Xaa=Lys or Asn or Arg or Ser
  UNSURE 9: Xaa=Ile or Asn or Ser
  UNSURE 10: Xaa=Asp or Tyr
  UNSURE 11: Xaa= *  or Cys or Phe or Leu or Tyr
  UNSURE 13: Xaa=Lys or Asn
  UNSURE 15: Xaa=Ala or Glu or Ile or Lys or Leu or Pro or Gln or Thr or Val
  UNSURE 23: Xaa=Lys or Asn
  UNSURE 24: Xaa=Lys or Gln
  UNSURE 26: Xaa=Ala or Glu or Gly
  UNSURE 51: Xaa= *  or Cys
MPVILALWEAKVGRLLEARSSRPAWAXTVXPQFSXXXKXIXIKEIYLEXXKXIYSGRARWLMPVIPTLGRQGGRIAXG

SEQ ID NO: 4725 - protein, 94 aa, Homo sapiens
  SIGNAL -21..-1: score 5.3 seq ALTLVLLIKESGA/WS
  UNSURE 46: Xaa=Ile or Ser or Thr
  UNSURE 65: Xaa=Lys or Asn
MIASQFLSALTLVLLIKESGAWSYNTSTEAMTYDEASAYCQQRYTHLVAIQNKEEIEYLNSILKLFXKLLLDWNQKSQQCVGLGRXPETSDRRS

SEQ ID NO: 4726 - protein, 69 aa, Homo sapiens
  SIGNAL -38..-1: score 8.2 seq LLLIFLSFPYTLC/IL
  UNSURE 23: Xaa= *  or Arg
  UNSURE 28: Xaa= *  or Tyr
  UNSURE 29: Xaa=Phe or Ile
MSGLFPVPVRVNVDIAQNITCSSFSLLLIFLSFPYTLCILYRVKSYTPTESITAFNLTIGXFPYLXXST

SEQ ID NO: 4727 - protein, 66 aa, Homo sapiens
  SIGNAL -13..-1: score 5.7 seq MIVLLVMLGDILA/GL
  UNSURE 23: Xaa=His or Gln
  UNSURE 24: Xaa=His or Pro or Gln
  UNSURE 31: Xaa=Cys or Gly
MIVLLVMLGDILAGLFLKGICYFSGIKCPHTAVSHXXHFISRIXSQSQTETIPFKQQRSPFPPPPK

SEQ ID NO: 4728 - protein, 63 aa, Homo sapiens
  SIGNAL -19..-1: score 7.4 seq LGFLXXSLESTLS/IX
  UNSURE -9: Xaa=Ile or Leu or Met
  UNSURE -8: Xaa=Met or Val
  UNSURE 2: Xaa=Pro or Gln
MRALLLLGFLXXSLESTLSIXPWEAPKEHKYKAEEHTVVLTVTGEPCHFPFQYHRQLYHKCTH

SEQ ID NO: 4729 - protein, 70 aa, Homo sapiens
  SIGNAL -28..-1: score 4.5 seq LRWSLTLLPRLEC/GF
  UNSURE 11: Xaa=Pro or Thr
  UNSURE 12: Xaa=His or Leu or Pro
  UNSURE 29: Xaa= *  or Tyr
  UNSURE 37: Xaa= *  or Cys or Gly or Arg or Trp
MACTSCLADLKKIFFLRWSLTLLPRLECGFMILAYLQPXXAGFKQFFCLSLPSSWDXRRGPANFXIFSRD

SEQ ID NO: 4730 - protein, 77 aa, Homo sapiens
MAPVKKLVVKGGKKKKQVLKFTLDCTHPVEDGIMDAANFEQFLQERIKVNGKAGNLGGGVVTIERSKSKITSSTISP

SEQ ID NO: 4731 - protein, 62 aa, Homo sapiens
  UNSURE 5: Xaa=Lys or Asn
  UNSURE 6: Xaa= *  or Ala or Glu or Gly or Lys or Leu or Met or Pro or Gln or Arg or Ser or Thr or Val or Trp
  UNSURE 47: Xaa=Asp or Glu
MMQIXXTGFLNGKNAREFMGELWPLLLSAQENIAGIPSAFLELKKEXIKQRQIEQEKLASMK

SEQ ID NO: 4732 - protein, 135 aa, Homo sapiens
MDSQRELAEELRLYQSTLLQDGLKDLLDEKKFIDCTLKAGDKSLPCHRLILSACSPYFREYFLSEIDEAKKKEVVLDNVDPAILDLIIKYLYSASIDLNDGNVQDIFALASRFQIPSVFTVCVSYLQKRLAPGNC

SEQ ID NO: 4733 - protein, 221 aa, Homo sapiens
  UNSURE 78: Xaa=Gln or Arg
MSVSADERGGLENMRPPNNSSPVQEDAENASCELCGLTITEEDLSSHYLAKHIENICACGKCGQILVKGRQLQEHAQXCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCG

SEQ ID NO: 4734 - protein, 104 aa, Homo sapiens
MEPQEERETQVAAWLKKIFGDHPIPQYEVNPRTTEILHHLSERNRVRDRDVYLVIEDLKQKASEYESEAKYLQDLLMESVNFSPANLSSTGSRYLNALVDSAVA

SEQ ID NO: 4735 - protein, 73 aa, Homo sapiens
MEGLEENGGVVQVGELLPCKICGRTFFPVALKKHGPICQKTATKKRKTFDSSRQRAEGTDIPTVKPLKPRPEP

SEQ ID NO: 4736 - protein, 91 aa, Homo sapiens
MLSHNTMMKQRKQQATAIMKEVHGNDVDGMDLGKKVSIPRDIMLEELSHLSNRGARLFKMRQRRSDKYTFENFQYQSRAQINHSIAMQNGK

SEQ ID NO: 4737 - protein, 67 aa, Homo sapiens
  UNSURE 21: Xaa=Ile or Met
  UNSURE 22: Xaa=Ala or Ser
MSLLFTRCNSIVTVKKNKRHXXEVNASPLKHFVTAKKKINGIFEQLGAYIQESATFLEDTYRNAELD

SEQ ID NO: 4738 - protein, 74 aa, Homo sapiens
  UNSURE 7: Xaa=Ala or Val
  UNSURE 68: Xaa=Asp or Phe or His or Ile or Leu or Asn or Val or Tyr
MGRKDAXTIKLPVDQYRKQIGKQDYKKTKPILRATKLKAEAKKTAIGIKLALYLQLYWHYYWLSMLSXISDSPR

SEQ ID NO: 4739 - protein, 76 aa, Homo sapiens
  UNSURE 13: Xaa=Ile or Val
  UNSURE 69: Xaa= *  or Cys or Phe or Ile or Lys or Leu or Asn or Arg or Ser or Thr or Tyr
MGRKDAATIKLPXDQYRKQIGKQDYKKTKPILRATKLKAEAKKTAIGIKEVGLVLAAILALLLAFYAFXYLRLTTD

SEQ ID NO: 4740 - protein, 115 aa, Homo sapiens
MKETIMNQEKLAKLQAQVRIGGKGTARRKKKVVHRTATADDKKLQFSLKKLGVNNISGIEEVNMFTNQGTVIHFNNPKVQASLAANTFTITGHAETKQLTEMLPSILNQLGADSL

SEQ ID NO: 4741 - protein, 122 aa, Homo sapiens
  UNSURE 86: Xaa=Ala or Pro
  UNSURE 103: Xaa=Gly or Trp
  UNSURE 120: Xaa=Asn or Thr
MADLANEEKPAIAPPVFVFQKDKGQKRSAGGSSPEGGEDSDREDGNYCPPVKRERTSSLTQFPPSQSEERSSGFRLKPPTLIHGQXPSAGLPSQKPKEQQRTXLRPAVLQAPQPKALSQXVP

SEQ ID NO: 4742 - protein, 61 aa, Homo sapiens
  UNSURE 44: Xaa=Glu or Val
  UNSURE 48: Xaa=Ala or Pro or Ser or Thr
MEGISNFKTPSKLSEKKKSVLCSTPTINIPASPFMQKLGFGTGXNVVXNEKISKRFVSFSL

SEQ ID NO: 4743 - protein, 60 aa, Homo sapiens
MMKGEFYVIEYAACDATYNEIVTFERLRPVNQNKTVKKNTFFKCTVDVPEDLREACANEN

SEQ ID NO: 4744 - protein, 92 aa, Homo sapiens
MLRDGRFACAICPHRPVLDTLAMLTAHRAGKKHLSSLQLFYGKKQPGKERKQNPKHQNELRREETKAEAPLLTQTRLITQSALHRAPHYNSC

SEQ ID NO: 4745 - protein, 119 aa, Homo sapiens
MSFKREGDDWSQLNVLKKRRVGDLLASYIPEDEALMLRDGRFACAICPHRPVLDTLAMLTAHRAGKKHLSSLQLFYGKKQPGKERKQNPKHQNELRREETKAEAPLLTQTRLITQSALH

SEQ ID NO: 4746 - protein, 75 aa, Homo sapiens
MGTRKKVHAFVRVKPTDDFAHEMIRYGDDKRSIDIHLKKDIRRGVVNNQQTDWSFKLDGVLHDASQDLVYETVAK

SEQ ID NO: 4747 - protein, 113 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSN

SEQ ID NO: 4748 - protein, 147 aa, Homo sapiens
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQSTTRPSQWDNSLSSSPSSEFYPF

SEQ ID NO: 4749 - protein, 148 aa, Homo sapiens
  UNSURE 120: Xaa=Glu or Val
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAXFIQQFNNQAFSVGQQLVFSFNEKLFGLL

SEQ ID NO: 4750 - protein, 114 aa, Homo sapiens
MGYKLQDLTDVQIMARLQEESLRQDYASTSASVSRHSSSVSLSSGKKGTCSDQEYDQYSLEDEEEFDHLPPPQPRLPRCSPFQRGIPHSQTFSSIRECRRSPSSQYFPSNNYQQ

SEQ ID NO: 4751 - protein, 81 aa, Homo sapiens
  UNSURE 39: Xaa=Gln or Arg
  UNSURE 72: Xaa=Asp or Glu
  UNSURE 75: Xaa=Ile or Lys
  UNSURE 79: Xaa=Ile or Lys
MKRPKLKKASKRMTCHKRYKIQKKVREHHRKLRKEAKKXGHKKPRKDPGVPNSAPFKEALLREAELRKQRLXELXQQQXLD

SEQ ID NO: 4752 - protein, 100 aa, Homo sapiens
MIVNNLLKPISVEGSSKKVKTDTVLILCRKKVENTRWDYLTQVEKECKEKEKPSYDTETDPSEGLMNVLKKIYEDGDDDMKRTINKAWVESREKQAKGDT

SEQ ID NO: 4753 - protein, 103 aa, Homo sapiens
  UNSURE 100: Xaa=Ala or Pro or Ser or Thr
MNSKGQYPTQPTYPVQPPGNPVYPQTLHLPQAPPYTDAPPAYSELYRPSFVHPGAATVPTMSAAFPGASLYLPMAQSVAVGPLGSTIPMAYYPVGPIYPXGST

SEQ ID NO: 4754 - protein, 145 aa, Homo sapiens
  UNSURE 122: Xaa=Gln or Arg
  UNSURE 137: Xaa=Ala or Glu
MASLKCSTVVCVICLEKPKYRCPACRVPYCSVVCFRKHKEQCNPETRPVEKKIRSALPTKTVKPVENKDDDDSIADFLNSDEEEDRVSLQNLKNLDGLSSCHPGWSAAAQSRLTATSPSQIXAILMPQPPEQLGLQXPATTPNQF

SEQ ID NO: 4755 - protein, 98 aa, Homo sapiens
MVVWEPAWGCKGPKSLIGVRNENTFLDLTVQQIEHLNKTYNTDVPLVLMNSFNTDEDTKKILQKYNHCRVKIYTFNQSRYPRINKESLLPVAKDVSYS

SEQ ID NO: 4756 - protein, 53 aa, Homo sapiens
MKTNDTYMKFSWLTVPEKSLDKEHRCIVRHENNKNGVDQEIIFPPIKTDVITM

SEQ ID NO: 4757 - protein, 67 aa, Homo sapiens
  UNSURE 7: Xaa=Cys or Trp
MAVRLLXSLIKKSNQSAYLRSQSRTSSNSFPPVSHLVVALHLSGFYCRIHLSSSFSFGLNSKQSPDA

SEQ ID NO: 4758 - protein, 85 aa, Homo sapiens
MGQQSSVRRLKRSVPCESNEANEANEANKTMPETPTGDSDPQPAPKKMKTSESSTILVVRYRRNVKRTSPEELVNDHARENRINP

SEQ ID NO: 4759 - protein, 111 aa, Homo sapiens
  UNSURE 94: Xaa=Ile or Asn or Ser or Thr
  UNSURE 107: Xaa=Ser or Thr
MLCCMRRTKQVEKNDDDQKIEQDGIKPEDKAHKAATKIQASFRGHITRKKLKGEKKDDVQAAEAEANKKDEAPVADGVEKKGEGTTTAEAAPAXGSKPDEPGKAGKXPSEE

SEQ ID NO: 4760 - protein, 95 aa, Homo sapiens
  UNSURE 22: Xaa=Lys or Asn
MEAEKDSGRRLRPIDRQRYDEXEDLSDVEEIVSVRGFSLEEKLRSQLYQGDFVHAMEGKDFNYEYVQREALRVPLIFREKDGLGIKMPDPDFTVR

SEQ ID NO: 4761 - protein, 71 aa, Homo sapiens
  UNSURE 27: Xaa= *  or Gln
MAPSRNGMVLKPHGSVPHEGARRPRLXPGGAQGGRHSQEGGPDHRHFCGSEEAEQVHGVPAGQRAAAEGVP

SEQ ID NO: 4762 - protein, 120 aa, Homo sapiens
MAPSRNGMVLKPHFHKDWQRRVATWFNQPARKIRRRKARQAKARRIAPRPASGPIRPIVRCPTVRYHTKVRAGRGFSLEELRVAGIHKKVARTIGISVDPRRRNKSTESLQANVQRLKEY

SEQ ID NO: 4763 - protein, 120 aa, Homo sapiens; identical to SEQ ID NO: 4762

SEQ ID NO: 4764 - protein, 81 aa, Homo sapiens
MDEEPERTKRWEGGYERTWEILKEDESGSLKATIEDILFKAKRKRVFEHHGQVRLGMMRHLYVVVDGSRTMEDQDLKPNRL

SEQ ID NO: 4765 - protein, 100 aa, Homo sapiens
MREIVHLQAGQCGNQIGAKFWEVISDEHGIDPTGTYHGDSDLQLERINVYYNEATGGKYVPRAVLVDLEPGTMDSVRSGPFGQIFRPDNFVFGQSGAGNN

SEQ ID NO: 4766 - protein, 64 aa, Homo sapiens
  UNSURE 51: Xaa=Pro or Ser
  UNSURE 53: Xaa=Lys or Leu or Met or Pro or Gln or Arg or Thr
  UNSURE 59: Xaa=His or Gln or Arg
  UNSURE 60: Xaa=Ile or Leu
MSMGLTPLAVTMETVICSWRESMFYYNEATGNKYVPRANPQWIWKPGTMDXVXSGPFGXXFRPR

SEQ ID NO: 4767 - protein, 111 aa, Homo sapiens
MREIVHIQAGQCGNQIGAKFWEVISDEHGIDPTGTYHGDSDLQLDRISVYYNEATGGKYVPRAILVDLEPGTMDSVRSGPFGQIFRPDNFVFGQSGAGNNWAKGTTQRARA

SEQ ID NO: 4768 - protein, 100 aa, Homo sapiens
  UNSURE 82: Xaa=Ala or Asp or Glu or Gly or Val
MNARGLGSELKDSIPVTELSASGPFESHDLLRKGFSCVKNELLPSHPLELSEKNFQLNQDKMNFSTLRNIQGLFAPLKLQMXFKAVQQTGLGPAEHLPWA

SEQ ID NO: 4769 - protein, 132 aa, Homo sapiens
  UNSURE 28: Xaa=Asp or Glu
  UNSURE 129: Xaa=Leu or Met or Val
MAASMHGQPSPSLEDAKLRRPMVIEIIXKNFDYLRKEMTQNIYQMATFGTTAGFSGIFSNFLFRRCFKVKHDALKTYASLATLPFLSTVVTDKLFVIDALYSDNISKENCVFRSSLIGIVCGVFYPSSXAFT

SEQ ID NO: 4770 - protein, 97 aa, Homo sapiens
  UNSURE 8: Xaa=Ala or Glu or Gly or Val
  UNSURE 82: Xaa=Ala or Pro
  UNSURE 94: Xaa=Asn or Thr
MSFILINXPVFLFLFIYFETGSHFVTQAGGKWRGLGSLQPLPPGFRRSSCLSLLSGWDCGLAPPRSANFCIFSGDGVSPCWXDWSSTPGFRWSXLLG

SEQ ID NO: 4771 - protein, 52 aa, Homo sapiens
  UNSURE 51: Xaa=His or Arg
MSNMEKHLFNLKFAAKELSRSAKKCDKEEKAEKAKIKKAIQKGNMEVARIXA

SEQ ID NO: 4772 - protein, 139 aa, Homo sapiens
  UNSURE 24: Xaa=Asp or Gly
  UNSURE 51: Xaa=Ala or Ser
MDGSRKEEEEDSTFTNISLADDIXHSSRILYPRPKSLLPKMMNADMDAVDXENQVELEEKTRLINQVLELQHTLEDLSARVDAVKEENLKLKSENQVLGQYIENLMSASSVFQTTDTKSKRSKGLTPFCFMELLLIIFS

SEQ ID NO: 4773 - protein, 119 aa, Homo sapiens
  UNSURE 36: Xaa=Lys or Gln
  UNSURE 37: Xaa=Phe or Ser
  UNSURE 39: Xaa=Lys or Arg
MSAQFRSLHQYAAQRIISLFSLLSKKHNKVLEQATXXLXGSLSSNDVPLPDYAQDLNVIEEVIRMMLEIINSCLTNSLHHNPNLVYALLYKRDLFEQFRTHPSFQDIMQNIDLVISFFS

SEQ ID NO: 4774 - protein, 112 aa, Homo sapiens
  UNSURE 35: Xaa=Asn or Thr
MQREEKQLEASLDALLSQVADLKNSLGSFICKLEXEYGRLTWPSVLDSFALLSGQLNTLNKVLKHEKTPLFRNQVIIPLVLSPDRDEDLMRQTEGRVPVFSHEVVPDHLRTK

SEQ ID NO: 4775 - protein, 72 aa, Homo sapiens
MGPDYRVLVHRARKLAQQYYLVYQEPIPTAQLVQRVASVMQEYTQSGGVRPFGVSLLICGWNEGRPYLFQSD

SEQ ID NO: 4776 - protein, 70 aa, Homo sapiens
MSSRKQGSQPRGQQSAEEENFKKPTRSNMQRSKMRGASSGKKTAGPQQKNLEPALPGRWGGRSAENPPSG

SEQ ID NO: 4777 - protein, 70 aa, Homo sapiens; identical to SEQ ID NO: 4776

SEQ ID NO: 4778 - protein, 70 aa, Homo sapiens; identical to SEQ ID NO: 4776

SEQ ID NO: 4779 - protein, 70 aa, Homo sapiens; identical to SEQ ID NO: 4776

SEQ ID NO: 4780 - protein, 70 aa, Homo sapiens; identical to SEQ ID NO: 4776

SEQ ID NO: 4781 - protein, 117 aa, Homo sapiens
MALTSTDHNTKPTMIRRPPAVVCYICGREYGTKSISIHEPQCLKKWHNENNLLPKELRRPVPKKPEVRTITAKGFYDLDALNEAAWTSAHSQLVPCNVCGRTFLPDRLIVHQQSCKP

SEQ ID NO: 4782 - protein, 91 aa, Homo sapiens
MGFLKLIEIENFKSYKGRQIIGPFQRFTAIIGPNGSGKSNLMDAISFVLGEKTSNLRVKTLRDLIHGAPVGKPAANRAFVSMVYSEEGAED

SEQ ID NO: 4783 - protein, 58 aa, Homo sapiens
  UNSURE 44: Xaa=Ala or Thr
  UNSURE 50: Xaa=Glu or Val
MAGEKVEKPDTKEKKPEAKKVDAGGKVKKGNLKAKKPKKGKPLXFMDDSXVESTASIL

SEQ ID NO: 4784 - protein, 96 aa, Homo sapiens
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly
MAGEKVEKPDTKEKKPEAKKVDAGGKVKKGNLKAKKPKKGKPHCSRNPVLVRGIGRYSRSAMYSRKAMKEKDREKERERXKXREKEKXRGKNXXRD

SEQ ID NO: 4785 - protein, 96 aa, Homo sapiens
  UNSURE 79: Xaa=Phe or Ile or Asn or Tyr
MAGEKVEKPDTKEKKPEAKKVDAGGKVKKGNLKAKKPKKGKPHCSRNPVLVRGIGRYSRSAMYSRKAMYKRKQLLKPRXRKWKAQNRLRLSISLLE

SEQ ID NO: 4786 - protein, 58 aa, Homo sapiens; identical to SEQ ID NO: 4783
  UNSURE 44: Xaa=Ala or Thr
  UNSURE 50: Xaa=Glu or Val

SEQ ID NO: 4787 - protein, 58 aa, Homo sapiens; identical to SEQ ID NO: 4783
  UNSURE 44: Xaa=Ala or Thr
  UNSURE 50: Xaa=Glu or Val

SEQ ID NO: 4788 - protein, 96 aa, Homo sapiens; identical to SEQ ID NO: 4784
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly

SEQ ID NO: 4789 - protein, 96 aa, Homo sapiens; identical to SEQ ID NO: 4785
  UNSURE 79: Xaa=Phe or Ile or Asn or Tyr

SEQ ID NO: 4790 - protein, 223 aa, Homo sapiens
MAGEKVEKPDTKEKKPEAKKVDAGGKVKKGNLKAKKPKKGKPHCSRNPVLVRGIGRYSRSAMYSRKAMYKRKYSAAKSKVEKKKKEKVLATVTKPVGGDKNGGTRVVKLRKMPRYYPTEDVPRKLLSHGKKPFSQHVRKLRASITPGTILIILTGRHRGKRVVFLKQLASGLLLVTGPLVLNRVPLRRTHQKFVIATSTKIDISNVKIPKHLTDAYFKKKKLR

SEQ ID NO: 4791 - protein, 96 aa, Homo sapiens; identical to SEQ ID NO: 4784
  UNSURE 80: Xaa=Glu or Gly
  UNSURE 82: Xaa=Glu or Gly
  UNSURE 88: Xaa=Ala or Val
  UNSURE 93: Xaa=Lys or Pro or Gln or Thr
  UNSURE 94: Xaa=Asp or Gly

SEQ ID NO: 4792 - protein, 96 aa, Homo sapiens; identical to SEQ ID NO: 4785
  UNSURE 79: Xaa=Phe or Ile or Asn or Tyr

SEQ ID NO: 4793 - protein, 223 aa, Homo sapiens; identical to SEQ ID NO: 4790

SEQ ID NO: 4794 - protein, 68 aa, Homo sapiens
  UNSURE 56: Xaa=Ala or Pro or Ser or Thr
MYPESTTGSPARLSLRQTGSPGMIYSTRYGSPKRQLQFYRNLGKSGLRVSCLGLGXWVTFGGQITDEM

SEQ ID NO: 4795 - protein, 106 aa, Homo sapiens
MAAPSGGVNCEEFAEFQELLKVMRTIDDRIVHELNTTVPTASFAGKIDASQTCKQLYESLMAAHASRDRVIKNCIAQTSAVVKNLREEREKNLDDLTLLKQLRKEQ

SEQ ID NO: 4796 - protein, 113 aa, Homo sapiens
  UNSURE 69: Xaa=Asp or Glu
  UNSURE 70: Xaa=Ala or Pro or Ser or Thr
MPECWDGEHDIETPYGLLHVVIRGSPKGNRPAILTYHDVGLNHKLCFNTFFNFEDMQEITKHFVVCHVXXPGQQVGASQFPQGYQFPSMEQLAAMLPSVVQHFGFKYVIGIGV

SEQ ID NO: 4797 - protein, 87 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQ

SEQ ID NO: 4798 - protein, 103 aa, Homo sapiens
  UNSURE 44: Xaa=Glu or Gly
MSKRGRGGSSGAKFRISLGLPVGAVINCADNTGAKNLYIISVKXIKGRLNRLPAAGVGDMVMATVKKGKPELRKKVHPAVVIRQRKSYRRKDGALASQSVWIT

SEQ ID NO: 4799 - protein, 54 aa, Homo sapiens
MAVGKNKRLTKGGKKGAKKKVVDPFSKKDWYDVKAPAMFNIRNIGHSRCFQPFH

SEQ ID NO: 4800 - protein, 258 aa, Homo sapiens
MAVGKNKRLTKGGKKGAKKKVVDPFSKKDWYDVKAPAMFNIRNIGKTLVTRTQGTKIASDGLKGRVFEVSLADLQNDEVAFRKFKLITEDVQGKNCLTNFHGMDLTRDKMCSMVKKWQTMIEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEP

SEQ ID NO: 4801 - protein, 84 aa, Homo sapiens
MAVGKNKRLTKGGKKGAKKKVVDPFSKKDWYDVKAPAMFNIRNIGKTLVTRTQGTKIASDGLKGRVFETIRCNFASLFLAVERF

SEQ ID NO: 4802 - protein, 139 aa, Homo sapiens
  UNSURE 2: Xaa=Ile or Val
MXEAHVDVKTTDGYLLRLFCVGFTKKRNNQIRKTSYAQHQQVRQIRKKMMEIMTREVQTNDLKEVVNKLIPDSIGKDIEKACQSIYPLHDVFVRKVKMLKKPKFELGKLMELHGEGSSSGKATGDETGAKVERADGYEP

SEQ ID NO: 4803 - protein, 81 aa, Homo sapiens
MNNKFDALKDDDSGDHDQNEENSTQKDGEKEKTERDKNQSSSKRKVEQFWRFYSHMVRPGDLTGHSDFHLFKEGIKPMWED

SEQ ID NO: 4804 - protein, 63 aa, Homo sapiens
  UNSURE 55: Xaa= *  or Glu or Lys or Gln
MKRKKRQFLKLSQNINRWKDVPMSSPPSTLGAWKCCSREQAPGWTCPVLTTSVCXVNNKSFQR

SEQ ID NO: 4805 - protein, 94 aa, Homo sapiens
MQHARKAGLVIPPEKSDRSIHLACTAGIFDAYVPPEGDARISSLSKEGLIERTERMKKTMASQVSIRRIKDYDANFKIKDFPEKAKDIFIEAHL

SEQ ID NO: 4806 - protein, 99 aa, Homo sapiens
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVP

SEQ ID NO: 4807 - protein, 118 aa, Homo sapiens
  UNSURE 13: Xaa=Lys or Arg
  UNSURE 52: Xaa=Phe or Ser
MDIEALKKLNKNXKLVKKLAKKYDAFLASESLIKQIPRILGPGLNKAGKFPXLLTHNENMVAKVDEVKSTIKFQMKKVLCLAVAVGHVKMTDDELVYNIHLAVNFLVSLLKKNWQNVR

SEQ ID NO: 4808 - protein, 100 aa, Homo sapiens
MAGHRLVLVLGDLHIPHRCNSLPAKFKKLLVPGKIQHILCTGNLCTKESYDYLKTLAGDVHIVRGDFDENLNYPEQKVVTVGQFRFSSKAPSHSPFSGQE

SEQ ID NO: 4809 - protein, 147 aa, Homo sapiens
MLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSALGHIMLGNKHYS

SEQ ID NO: 4810 - protein, 111 aa, Homo sapiens
  UNSURE 13: Xaa= *  or Ser
  UNSURE 74: Xaa=Ile or Met
  UNSURE 81: Xaa=His or Arg
METFAPKRVMTIXRTLAGDVHIVRGDFDENLNYPEQKVVTVGQFKIGLIHGHQVIPWGDMASLALLQRQFDVDXLISGHTXKFEAFEHENKFYINPGSALGHIMLGNKHYS

SEQ ID NO: 4811 - protein, 69 aa, Homo sapiens
  UNSURE 49: Xaa=Ala or Ser
  UNSURE 61: Xaa= *  or Ala or Glu or Gly or Leu or Ser or Val
MTCCPGSSLLHTECSGSLNHCFSFESRASCHFHVASAVSPPTPVLPCHXDGSRQGWQTLPXTSLAQKAS

SEQ ID NO: 4812 - protein, 110 aa, Homo sapiens
MWRVKKLSLSLSPSPQTGKRSMRTPLRELTLQPGALTNSGKRSPACSSLTPSLCKLGLQEGSNNSSPVDFVNNKRTDLSSEHFSHSSKWLETCQHESDEQPLDPIPQISS

SEQ ID NO: 4813 - protein, 149 aa, Homo sapiens
MATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARFGISSVPTKGLSSDNKPMVNLDK

SEQ ID NO: 4814 - protein, 113 aa, Homo sapiens
MGRENWPEASEAKEIKLYAQIPPIEKMDASLSMLANCEKLSLSTNCIEKIANLNGLKNLRILSLGRNNIKNLNGLEAVGDTLEELWISYNFIEKLKGIHIMKKLKILYMSNNL

SEQ ID NO: 4815 - protein, 134 aa, Homo sapiens
  UNSURE 102: Xaa=Lys or Arg
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGXKHQRNLGMSMRVERSTLDQVKKRFEVNKKKME

SEQ ID NO: 4816 - protein, 131 aa, Homo sapiens
MASGSGTKNLDFRRKWDKDEYEKLAEKRLTEEREKKDGKPVQPVKRELLRHRDYKVDLESKLGKTIVITKTTPQSEMGGYYCNVCPIVYLTIFLLLSSLSSYLAYLSIHLRVCLQPPPVCPSVQLPVTLCI

SEQ ID NO: 4817 - protein, 58 aa, Homo sapiens
  UNSURE 26: Xaa=Lys or Arg
MGGYYCNVCDCVVKDSINFLDHINGXKHQRNLGMSMRVERSTLDQVKKRFEVNKKKME

SEQ ID NO: 4818 - protein, 112 aa, Homo sapiens
MKHINLSFAACGFLGIYHLGAASALCRHGKKLVKDVKAFAGASAGSLVASVLLTAPEKIEECNQFTYKFAEEIRRQSFGAVTPGYDFMARLRSGMESILPPSAHELAQNRLH

SEQ ID NO: 4819 - protein, 153 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPASSLESRSFLLAKKSGENVAKFIINSYPKYFQKDIAEPHIPCLMPEYFEPQIKDIS

SEQ ID NO: 4820 - protein, 61 aa, Homo sapiens
MAEFLDDQETRLCDNCKKEIPVFNFTIHEIHCQRNIGMCPTCKEPFPKSDMETHMTAEHCQ

SEQ ID NO: 4821 - protein, 55 aa, Homo sapiens
MDILKSEILRKRQLVEDRNLLVENKKYFKRSELAKKEEEAYFERCGYKIQPKEED

SEQ ID NO: 4822 - protein, 96 aa, Homo sapiens
  UNSURE 55: Xaa=Leu or Val
  UNSURE 65: Xaa=Pro or Arg
MPGHLQEGFGCVVTNRFDQLFDDESDPFEVLKAAENKKKEAGGGGVGGPGAKSAXRPRPRPTPTXQANSCARSPRKTARTRCPPALAWLTRKRRRS

SEQ ID NO: 4823 - protein, 115 aa, Homo sapiens
  UNSURE 93: Xaa=Ala or Pro or Ser or Thr
  UNSURE 111: Xaa=Pro or Thr
MHRDSCPLDCKVYVGNLGNNGNKTELERAFGYYGPLRSVWVARNPPGFAFVEFEDPRDAADAVRELDGRTLCGCRVRVELSNGEKRSRNRGPXPSWGRRPRDDYRRRSPPXRRRS

SEQ ID NO: 4824 - protein, 110 aa, Homo sapiens
  UNSURE 91: Xaa=Asp or Gly
MGKGDPKKPRGKMSSYAFFVQTCREEHKKKHPDASVNFSEFSKKCSERWKTMSAKEKGKFEDMAKADKARYEREMKTYIPPKGETKKKFKXPNAPKRPPSAFFLFCSEYR

SEQ ID NO: 4825 - protein, 110 aa, Homo sapiens
  UNSURE 12: Xaa=Glu or Lys
  UNSURE 17: Xaa=Ala or Gly
  UNSURE 29: Xaa=Lys or Arg
  UNSURE 91: Xaa=Asp or Gly
MGKGDPKKPRGXMSSYXFFVQTCREEHKXKHPDASVNFSEFSKKCSERWKTMSAKEKGKFEDMAKADKARYEREMKTYIPPKGETKKKFKXPNAPKRPPSAFFLFCSEYR

SEQ ID NO: 4826 - protein, 59 aa, Homo sapiens
MSAKEKGKFEDMAKADKARYEREMKTYIPPKGETKKKFKGPNAPKRPPSAFFLFCSEYR

SEQ ID NO: 4827 - protein, 64 aa, Homo sapiens
MADAFGDELFSVFEGDSTTAAGTKKDKEKDKGKWKGPPGSADKAGKRFDGKLQSESTNNGKNKR

SEQ ID NO: 4828 - protein, 132 aa, Homo sapiens
MDYQGRSTGEAFVQFASKEIAENALGKHKERIGHRYIEIFRSSRSEIKGFYDPPRRLLGQRPGPYDRPIGGRGGYYGAGRGSMYDRMRRGGDGYDGGYGGFDDYGGYNNYGYGNDGFDERKKTRKRRRRKRR

SEQ ID NO: 4829 - protein, 57 aa, Homo sapiens
MELGVEVCMTECDEEVMDMMVVMEVLMTMVAIIITAMGMMALMKERRQGKGGGGRGE

SEQ ID NO: 4830 - protein, 57 aa, Homo sapiens; identical to SEQ ID NO: 4829

SEQ ID NO: 4831 - protein, 132 aa, Homo sapiens; identical to SEQ ID NO: 4828

SEQ ID NO: 4832 - protein, 308 aa, Homo sapiens
  UNSURE 307: Xaa=Asp or Asn
MMLGTEGGEGFVVKVRGLPWSCSADEVQRFFSDCKIQNGAQGIRFIYTREGRPSGEAFVELESEDEVKLALKKDRETMGHRYVEVFKSNNVEMDWVLKHTGPNSPDTANDGFVRLRGLPFGCSKEEIVQFFSGLEIVPNGITLPVDFQGRSTGEAFVQFASQEIAEKALKKHKERIGHRYIEIFKSSRAEVRTHYDPPRKLMAMQRPGPYDRPGAGRGYNSIGRGAGFERMRRGAYGGGYGGYDDYGGYNDGYGFGSDRFGRDLNYCFSGMSDHRYGDGGSSFQSTTGHCVHMRGLPYRATENDIYXF

SEQ ID NO: 4833 - protein, 76 aa, Homo sapiens
MMLSTEGREGFVVKVRGLPWSCSADEVMRFFSDCKIQNGTSGIRFIYTREGRPSGEAFVELESEEEVKLALKKDRE

SEQ ID NO: 4834 - protein, 94 aa, Homo sapiens
  UNSURE 14: Xaa=Ile or Val
  UNSURE 15: Xaa=Lys or Arg
  UNSURE 17: Xaa=Glu or Lys
  UNSURE 76: Xaa=Ala or Pro or Ser or Thr
  UNSURE 88: Xaa=Phe or Ile or Leu or Val
MCPRILDYLRKKRXXEXKPTSQGKSSSKKEMSKRDGKEKKDRGVTRFQENASEGKAPAEDVFKKPLPPTVKKEESXPPPKVVNPLIGXLGEYGG

SEQ ID NO: 4835 - protein, 119 aa, Homo sapiens
  UNSURE 112: Xaa= *  or Tyr
  UNSURE 113: Xaa=Pro or Ser
MYGFVNHALELLVIRNYGPEVWEDIKKEAQLDEEGQFLVRIIYDDSKTYDLVAAASKVLNLNAGEILQMFGKMFFVFCQESGYDTILRVLGSNVREFLQNLDALHDHLATIXXGMRAPS

SEQ ID NO: 4836 - protein, 218 aa, Homo sapiens
  UNSURE 197: Xaa=Leu or Pro or Gln or Arg
  UNSURE 218: Xaa=Lys or Asn
MVFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGTAAAAAAAAAAAAAAAKVPAKKITAASKKAPAQKVPAQKATGQKAAPAXKAQKGQKAPAQKAPAPKASGX

SEQ ID NO: 4837 - protein, 102 aa, Homo sapiens
  UNSURE 88: Xaa=Ala or Thr
MVFRRFVEVGRVAYVSFGPHAGKLVAIVDVIDQNRALVDGPCTQVRRQAMPFKCMQLTDFILKFPHSAHQKYVRQAWQKADINTKWAXTRWALLHFLLEDLF

SEQ ID NO: 4838 - protein, 142 aa, Homo sapiens
MVFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALEIRLFLF

SEQ ID NO: 4839 - protein, 225 aa, Homo sapiens
  UNSURE 204: Xaa=Leu or Pro or Gln or Arg
  UNSURE 225: Xaa=Lys or Asn
MVFRRFVEVGRVAYVSFGPHAGKLVAIVDVIDQNRALVDGPCTQVRRQAMPFKCMQLTDFILKFPHSAHQKYVRQAWQKADINTKWAATRWAKKIEARERKAKMTDFDRFKVMKAKKMRNRIIKNEVKKLQKAALLKASPKKAPGTKGTAAAAAAAAAAAAAAAAAAAAAAKVPAKKITAASKKAPAQKVPAQKATGQKAAPAXKAQKGQKAPAQKAPAPKASGX

SEQ ID NO: 4840 - protein, 218 aa, Homo sapiens
  UNSURE 69: Xaa=His or Gln
  UNSURE 105: Xaa=His or Ile or Lys or Leu or Met or Asn or Pro or Gln or Arg or Ser or Thr
  UNSURE 197: Xaa=Leu or Pro or Gln or Arg
  UNSURE 218: Xaa=Lys or Asn
MVFRRFVEVGRVAYVSFGPHAGKLVAIVDVIDQNRALVDGPCTQVRRQAMPFKCMQLTDFILKFPHSAXQKYVRQAWQKADINTKWAATRWAKKIEARERKAKMXDFDRFKVMKAKKMRNRIIKNEVKKLQKAALLKASPKKAPGTKGTAAAAAAAAAAAAAAAKVPAKKITAASKKAPAQKVPAQKATGQKAAPAXKAQKGQKAPAQKAPAPKASGX

SEQ ID NO: 4841 - protein, 107 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGHFLNSFWLQ

SEQ ID NO: 4842 - protein, 107 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASR

SEQ ID NO: 4843 - protein, 101 aa, Homo sapiens
MEEEQDLPEQPVKKAKMQESGEQTISQVSNPDVSDQKPETSSLASNLPMSEEIMTCTDYIPRSSNDYTSQMYSAKPYAHILSVPVSETAYPGQTQYQTLQQ

SEQ ID NO: 4844 - protein, 99 aa, Homo sapiens
MEEPEEPADSGQSLVPVYIYSPEYVSMCDSLAKIPKRASMVHSLIEAYALHKQMRIVKPKVASMEEMATFHTDAYLQHLQKVSQEGDDDHPDSIEYGLG

SEQ ID NO: 4845 - protein, 64 aa, Homo sapiens
MAEDADMRNELEEMQRRADQLADESLESTRRMLQLVEESKDAGIRTLVMLDEQGEQLERIEEGM

SEQ ID NO: 4846 - protein, 73 aa, Homo sapiens
MAEVQVLVLDGRGHLLGRLAAIVAKQVLLGRKVVVVRCEGIILRKRMNTNPSRGPYHFRAPSRIFWRTVRGML

SEQ ID NO: 4847 - protein, 129 aa, Homo sapiens
  UNSURE 9: Xaa= *  or Arg
  UNSURE 39: Xaa=Ile or Val
MAEERVATXTQFPVSTESQKPRQKKAPEFPILEKQNWLXHLHYIRKDYEACKAVIKEQLQETQGLCEYAIYVQALIFRLEGNIQESLELFQTCAVLSPQSADNLKQVARSLFLLGKHKAAIEVYNEAAK

SEQ ID NO: 4848 - protein, 63 aa, Homo sapiens
MERSGPSEVTGSDASGPDPQLAVTMGFTGFGKKARTFDLEAMFEQTRRTAVERSRKTLEAREK

SEQ ID NO: 4849 - protein, 74 aa, Homo sapiens
MTKLQGAEHGKKGRGLEYLYLSVHDEDRDDHTRCNVWILDGDLYHKGLLKFAVSAESLPETLVIFVADMSRPWT

SEQ ID NO: 4850 - protein, 66 aa, Homo sapiens
MEDKVTSPEKAEEAKLKARYPHLGQKPGGSDFLRKRLQKGQKYFDSGDYNMAKAKMKNKQLPTAAP

SEQ ID NO: 4851 - protein, 82 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAP

SEQ ID NO: 4852 - protein, 101 aa, Homo sapiens
MSAEVPEAASAEEQKSEHNMLPWSLQPSIPNSLEEMEDKVTSPEKAEEAKLKARYPHLGQKPGGSDFLRKRLQKGQKYFDSGDYNMAKAKMKNKQLPTAAP

SEQ ID NO: 4853 - protein, 82 aa, Homo sapiens; identical to SEQ ID NO: 4851

SEQ ID NO: 4854 - protein, 52 aa, Homo sapiens [sequence omitted]

SEQ ID NO: 4855 - protein, 98 aa, Homo sapiens
METEQPEETFPNTETNGEFGKRPAEDMEEEQAFKRSRNTDEMVELRILLQSKNAGAVIGKGGKNIKALRTDYNASVSVPDSSGPERILSISADIETIG

SEQ ID NO: 4856 - protein, 102 aa, Homo sapiens
METEQPEETFPNTETNGEFGKRPAEDMEEEQAFKRSRNTDEMVELRILLQSKNAGAVIGKGGKNIKALRTDYNASVSVQTAVAPKRILSISADIETIGEILK

SEQ ID NO: 4857 - protein, 144 aa, Homo sapiens
MAEASSANLGSGCEEKRHEGSSSESVPPGTTISRVKLLDTMVDTFLQKLVAAGSYQRFTDCYKCFYQLQPAMTQQIYDKFIAQLQTSIREEISDIKEEGNLEAVLNALDKIVEEGKVRKEPAWRPSGIPEKDLHSVMAPTSCSN

SEQ ID NO: 4858 - protein, 63 aa, Homo sapiens
MEGAKPTLQLVYQAVQALYHDPDPSGKERASFWLGELQRSVHAWEISDQLLQIRQDVESCYFA

SEQ ID NO: 4859 - protein, 82 aa, Homo sapiens
MPSETLWEIAKAEVEKRGINGSEGDGAEIAEKFVFFIGSKNGGKTTIILRCLDRDEPPKPTLALEYTYGRRAKGHNTPKDIA

SEQ ID NO: 4860 - protein, 108 aa, Homo sapiens
MPPKKDVPVKKPAGPSISKPAAKPAAAGAPPAKTKAEPAVPQAPQKTQEPPVDLSKVVIEFNKDQLEELKSRRVDFETFLPMLQAVAKNRGQGTYEDYLEGFRVFDKE

SEQ ID NO: 4861 - protein, 66 aa, Homo sapiens
MAPVVTGKFGERPPPKRLTREAMRNYLKERGDQTVLILHAKVAQKSYGNEKRFFCPPPCVYLMGSA

SEQ ID NO: 4862 - protein, 125 aa, Homo sapiens
  UNSURE 87: Xaa= *  or Cys or Phe or Leu or Trp
MADPWQECMDYAVTLARQAGEVVCEAIKNEMNVMLKSSPVDLVTATDQKVEKMLISSIKEKYPSHSFIGEESVAAGEKSILTDNPTXIIDPIDGTTNFVHRFPFVAVSIGFAVNKKIEFGVVYSC

SEQ ID NO: 4863 - protein, 75 aa, Homo sapiens
MGKSFANFMCKKDFHPASKSNIKKVWMAEQKISYDKKKQEELMQQYLKEQESYDNRLLMGDERVKNGLNFMYEAP

SEQ ID NO: 4864 - protein, 63 aa, Homo sapiens
  UNSURE 7: Xaa=Ala or Asp or Glu or Lys or Asn or Thr
  UNSURE 8: Xaa=Leu or Arg
MLRSRSXXSLQKQPPCQSLSAQKSRSPCGRGGTGRPRGTACGAGIRCEWRLLCGRVEGQRETR

SEQ ID NO: 4865 - protein, 99 aa, Homo sapiens
MAVTLDKDAYYRRVKRLYSNWRKGEDEYANVDAIVVSVGVDEEIVYAKSTALQTWLFGYELTDTIMVFCDDKIIFMASKKKVEFLKQIANTKGNENANG

SEQ ID NO: 4866 - protein, 114 aa, Homo sapiens
  UNSURE 96: Xaa=Ala or Glu
  UNSURE 108: Xaa=Pro or Thr
MGSDKRVSRTERSGRYGSIIDRDDRDERESRSRRRDSDYKRSSDDRRGDRYDDYRDYDSPERERERRNSDRSEDGYHSDGDYGEHDYRHDISDERXTRPSCCAAFPSXSQRAIF

SEQ ID NO: 4867 - protein, 124 aa, Homo sapiens
MFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRR

SEQ ID NO: 4868 - protein, 93 aa, Homo sapiens
MLLTVRHGTVRYRSSALLARTKNNIQRYFGTNSVICSKKDKQSVRTEETSKETSESQDSEKENTKKDLLGIIKGMKVELSTVNVRTTKPPKRR

SEQ ID NO: 4869 - protein, 53 aa, Homo sapiens
  UNSURE 44: Xaa= *  or Cys
MTVLYKSKNTCLPRSEVVALRNMYILLSFQHFVNVDYLKFLFRXAINILLDSE

SEQ ID NO: 4870 - protein, 70 aa, Homo sapiens
MEKFNLDLSTVTQAFLKNSGELEATSAFLASGQRADGYPIWSRQDDIDLQKDDEDTREALVKKFGAQNVA

SEQ ID NO: 4871 - protein, 86 aa, Homo sapiens
  UNSURE 55: Xaa=Ile or Lys or Met or Asn or Arg or Ser or Thr
  UNSURE 56: Xaa=Ala or Ser
MAALGPSSQNVTEYVVRVPKNTTKKYNIMAFNAADKVNFATWNQARLERDLSNKXXTKRRRCPNRARAVSSTASFGRRLGGRSTAS

SEQ ID NO: 4872 - protein, 94 aa, Homo sapiens
MSGSVLFTAGERWRCFLTPSRSSLYWALHNFCCRKKSTTPKKITPNVTFCDENAKEPENALDKLFSSEQQASILHVLNTASTKELEAFRLLRGR

SEQ ID NO: 4873 - protein, 52 aa, Homo sapiens
MRDSAEGPKEDEEKPSASALEQPATLQEVASQEVPPELATPAPAWEPQPEPD

SEQ ID NO: 4874 - protein, 135 aa, Homo sapiens
MKCVFVTVGTTSFDDLIACVSAPDSLQKIESLGYNRLILQIGRGTVVPEPFSTESFTLDVYRYKDSLKEDIQKADLVISHAGAGSCLETLEKGKPLVVVINEKLMNNHQLELAKQLHKEGHLFYCTCSTLPGLLQ

SEQ ID NO: 4875 - protein, 93 aa, Homo sapiens
  UNSURE 21: Xaa=Ile or Leu or Val
  UNSURE 80: Xaa= *  or Lys
  UNSURE 86: Xaa=Lys or Met
  UNSURE 91: Xaa=Ser or Thr
MAPAKKGGEKKKGRSAINEVXTREYTINIHKRIHGVGFKKRAPRALKEIRKFAMKEMGTPDVRIDTRLNKAVWAKGIRCXSYLYSXVNFCXDT

SEQ ID NO: 4876 - protein, 112 aa, Homo sapiens
  UNSURE 106: Xaa=Phe or Val
MAPAKKGGEKKKGRSAINEVVTREYTINIHKRIHGVGFKKRAPRALKEIRKFAMKEMGTPDVRIDTRLNKAVWAKGIRNVPYRIRVRLSRKRNEDEDSPNKLYTLXTYTVNV

SEQ ID NO: 4877 - protein, 108 aa, Homo sapiens
  UNSURE 83: Xaa=Arg or Thr
MWVSSFARVQGKSGEGIVSIIKSVGAVGGTNAPTTEAGRKLSGGARAQRRPELPKQRGFGDGGFVRRNTKSRAWWGIFDILRXELQELMKQIDIMVAHKKSEWEGRYT

SEQ ID NO: 4878 - protein, 101 aa, Homo sapiens
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNV

SEQ ID NO: 4879 - protein, 64 aa, Homo sapiens
MVLWKVVFNRDKQGEYRFSTTQPPQESVDRWGKCCLPWALGCRKKTPKAKYMYLAQELLVDPEW

SEQ ID NO: 4880 - protein, 91 aa, Homo sapiens
  UNSURE 80: Xaa=Gly or Val
MTAAENVCYTLINVPMDSEPPSEISLKNDLEKGDVKSKTEALKKVIIMILNGEKLPGLLMTIIRFVLPLQDHTIKKLLLXFWEIVPKTTPD

SEQ ID NO: 4881 - protein, 91 aa, Homo sapiens; identical to SEQ ID NO: 4880
  UNSURE 80: Xaa=Gly or Val

SEQ ID NO: 4882 - protein, 125 aa, Homo sapiens
MQLTHQLDLFPECRVTLLLFKDVKNAGDLRRKAMEGTIDGSLINPTVIVDPFQILVAANKAVHLYKLGKMKTRTLSTEIIFNLSPNNNISEALKKFGISANDTSILIVYIEEGEKQINQEYLISQ

SEQ ID NO: 4883 - protein, 113 aa, Homo sapiens
  UNSURE 102: Xaa=Ala or Thr
METAPKPGKDVPPKKDKLQTKRKKPRRYWEEETVPTTAGASPGPPRNKKNRELRPQRPKNAYILKKSRISKKPQVPKKPREWKNPESQRGLSGAQDPFPGPXPVPVEVVQKFC

SEQ ID NO: 4884 - protein, 110 aa, Homo sapiens
  UNSURE 74: Xaa=Ala or Thr
MDSVAFEDVDVNFTQEEWALLDPSQKNLYRDVMWETMRNLASIGKKWKDQNIKDHYKHRGRNLRSHMLERLYQXKDGSQRGGIFSQFANQNLSKKIPGVKLCESIVYGEV

SEQ ID NO: 4885 - protein, 110 aa, Homo sapiens
  UNSURE 5: Xaa=Ala or Val
  UNSURE 74: Xaa=Ala or Thr
MDSVXFEDVDVNFTQEEWALLDPSQKNLYRDVMWETMRNLASIGKKWKDQNIKDHYKHRGRNLRSHMLERLYQXKDGSQRGGIFSQFANQNLSKKIPGVKLCESIVYGEV

SEQ ID NO: 4886 - protein, 110 aa, Homo sapiens
  UNSURE 10: Xaa=Ala or Asp
  UNSURE 15: Xaa=His or Gln
  UNSURE 22: Xaa=Asp or Gly
  UNSURE 74: Xaa=Ala or Thr
MDSVAFEDVXVNFTXEEWALLXPSQKNLYRDVMWETMRNLASIGKKWKDQNIKDHYKHRGRNLRSHMLERLYQXKDGSQRGGIFSQFANQNLSKKIPGVKLCESIVYGEV

SEQ ID NO: 4887 - protein, 69 aa, Homo sapiens
MDSVAFEDVAVNFTQEEWALLSPSQKNLYRDVTLETFRNLASVGIQWKDQDIENLYQNLGIKLRSLVER

SEQ ID NO: 4888 - protein, 90 aa, Homo sapiens
  UNSURE 25: Xaa= *  or Gln
MDSVAFEDVSVSFSQEEWALLAPSXKKLYRDVMQETFKNLASIGEKWEDPNVEDQHKNQGRNLRSHTGERLCEGKEGSQCAENFSPNLSV

SEQ ID NO: 4889 - protein, 77 aa, Homo sapiens
  UNSURE 12: Xaa=Ala or Asp
MPCCSHRRCREXPGTSESQEMDPVAFDDVAVNFTQEEWALLDISQRKLYKEVMLETFRNLTSVGKSWKDQNIEYEYQ

SEQ ID NO: 4890 - protein, 109 aa, Homo sapiens
  UNSURE 52: Xaa=Asp or Glu
  UNSURE 76: Xaa=Glu or Lys
  UNSURE 92: Xaa=Glu or Lys
  UNSURE 98: Xaa=Asp or Glu
MARGSVSDEEMMELREAFAKVDTDGNGYISFNELNDLFKAACLPLPGYRVRXITENLMATGDLDQDGRISFDEFIXIFHGLKSTDVAKTFRXAINKKXGICAIGGTSEQ

SEQ ID NO: 4891 - protein, 111 aa, Homo sapiens
MASNKTTLQKMGKKQNGKSKKVEEAEPEEFVVEKVLDRRVVNGKVEYFLKWKGFTDADNTWEPEENLDCPELIEAFLNSQKAGKEKDGTKRKSLSDSESDDSKSKKKRDAA

SEQ ID NO: 4892 - protein, 124 aa, Homo sapiens
  UNSURE 70: Xaa=Asp or Glu
  UNSURE 71: Xaa=Gly or Arg or Trp
  UNSURE 120: Xaa= *  or Leu
MSARKSSDASACSSSEISVKEFLAKAKEDFLKKWENPTQNNAGLEDFERKKTLGTGSFGRVMLVKHKATXXYYAMKILDKQKVVKLKQIEHTLNEKRILQAVNFPFLVRLEYAFKDNSNXYMVM

SEQ ID NO: 4893 - protein, 68 aa, Homo sapiens
MGLSRKSSDASACSSSEISVKEFLAKAKEDFLKKWENPTQNNAGLEDFERKKTLGTGSFGRVMLVKHK

SEQ ID NO: 4894 - protein, 87 aa, Homo sapiens
  UNSURE 12: Xaa=Leu or Trp
  UNSURE 71: Xaa=Cys or Phe
MNTVGTWRLLQXNRAATGKMEMEMEQVFEMKVKEKVQKLKDSEAELQRRHEQMKKNLEAQHKELEEKRRQXEDEKANWEAQQRILEQ

SEQ ID NO: 4895 - protein, 180 aa, Homo sapiens
  UNSURE 41: Xaa= *  or Trp
  UNSURE 76: Xaa=Cys or Tyr
  UNSURE 155: Xaa=Leu or Met
  UNSURE 176: Xaa=Glu or Gly
MAAAVPQRAWTVEQLRSEQLPKKDIIKFLQEHGSDSAGVQXRDLGSLQPPPPGFKRFSCLCLSSSWDYRRVPPRQXLAEHKLLGNIKNVAKTANKDHLVTAYNHLFETKRFKGTESISKVSEQVKNVKLNEDKPKETKSEETLDEGPPKYTKSVXKKGDKPTFPKREMLFTAGIQXHYKM

SEQ ID NO: 4896 - protein, 117 aa, Homo sapiens
  UNSURE 110: Xaa=Arg or Ser
  UNSURE 113: Xaa=Ala or Asp or Gly or Val
MKSEAKDGEEESLQTAFKKLRVDASGSVASLSVGEGTGVRAPVRTATDDTKPKTTCASKDSWHGSTRKSSRGAVRTQRRRRSKSPVLHPPKFIHCSTIASSSSSQLKHKXQTXSPDG

SEQ ID NO: 4897 - protein, 149 aa, Homo sapiens
MAASMFYGRLVAVATLRNHRPRTAQRAAAQVLGSSGLFNNHGLQVQQQQQRNLSLHEYMSMELLQEAGVSVPKGYVAKSPDEAYAIAKKLGSKDVVIKAQVLAGGRGKGTFESGLKGGVKIVFSPEEAKAVSSQMIGKKLFTKQTGERA

SEQ ID NO: 4898 - protein, 114 aa, Homo sapiens
  UNSURE 85: Xaa=Ala or Ser
MATAEVLNIGKKLYEGKTKEVYELLDSPGKVLLQSKDQITAGNAARKNHLEGKAAISNKITSCIFQLLQEAGIKTAFTRKCGETXFIAPQCEMIPIEWVCRRIATGSFLKRNPG

SEQ ID NO: 4899 - protein, 113 aa, Homo sapiens
MRNSYRFLASSLSVVVSLLLIPEDVCEKIIGGNEVTPHSRPYMVLLSLDRKTICAGALIAKDWVLTAAHCNLNKRSQVILGAHSITREEPTKQIMLVKKEFPYPCYDPATREG

SEQ ID NO: 4900 - protein, 93 aa, Homo sapiens
  UNSURE 45: Xaa=Leu or Pro or Gln or Arg
MKVGYERDFLRYLQSLLAEVERRIRRVHARLALSQNQQSSGAAGXTGKNEEKIQVLTDKIDVLLQQIEELGSEGKVEEAQGMMKLVEQLKEER

SEQ ID NO: 4901 - protein, 66 aa, Homo sapiens
  UNSURE 25: Xaa=Arg or Thr
  UNSURE 42: Xaa=Phe or Ile
  UNSURE 46: Xaa=Lys or Asn
MISAAQLLDELMGRDRNLAPDEKRXTCGGTTRAFVNIISVVXVLRXCSQIHVLILMYLEEEINIRD

SEQ ID NO: 4902 - protein, 68 aa, Homo sapiens
  UNSURE 64: Xaa=His or Asn or Pro or Thr
MSAQSVEEDSILIIPTPDEEEKILRVKLEEDPDGEEGSSIPWNHLPDPEIFRQRFRQFGYQDSXGPRE

SEQ ID NO: 4903 - protein, 137 aa, Homo sapiens
  UNSURE 84: Xaa= *  or Glu or Lys or Gln
MAASRRLMKELEEIRKCGMKNFRNIQVDEANLLTWQGLIVPDNPPYDKGAFRIEINFPAEYPFKPPKITFKTKIYHPNIDEKAXVCLPVISAENWKPATKTDQGKTCACVFLGRGLWGCCSGVGASGTRSDRIQRIF

SEQ ID NO: 4904 - protein, 80 aa, Homo sapiens
MSVKMGKKYKNIVLLKGLEVINDYHFRMVKSLLSNDLKLNLKMREEYDKIQIADLMEEKFRGDAGLGKLIKIFEDIPTLE

SEQ ID NO: 4905 - protein, 80 aa, Homo sapiens; identical to SEQ ID NO: 4904

SEQ ID NO: 4906 - protein, 80 aa, Homo sapiens; identical to SEQ ID NO: 4904

SEQ ID NO: 4907 - protein, 91 aa, Homo sapiens
MMEYLKIAQDLEMYGVNYFEIKNKKGTELWLGVDALGLNIYEHDDKLTPKIGFPWSEIRNISFNDKKFVIKPIDKKAPDFVFYAPRLRINK

SEQ ID NO: 4908 - protein, 102 aa, Homo sapiens
  UNSURE 72: Xaa=Asp or Glu
  UNSURE 83: Xaa=Gly or Arg or Trp
MTTATRQEVLGLYRSIFRLARKWQATSGQMEDTIKEKQYILNEARTLFRKNKNLTDTDLIKQCIDECTARIXIGLHYKIPYPXPIHLPPMGLTPLRGRGLRS

SEQ ID NO: 4909 - protein, 103 aa, Homo sapiens
MSATVVDAVNAAPLSGSKEMSLEEPKKMTREDWRKKKELEEQRKLGNAPAEVDEEGKDINPHIPQYISSVPWYIDPSKRPTLKHQRPQPEKQKQFSSSGEWYK

SEQ ID NO: 4910 - protein, 84 aa, Homo sapiens
MFTRWKQQQRKEKLAAKKKLKKEREALGDKAPPKPVPKTIDNQRVYDETTVDPNDEEVAYDEATDEFASYFNKQTSPKILITTS

SEQ ID NO: 4911 - protein, 110 aa, Homo sapiens
MATVEPETTPTPNPPTTEEEKTESNQEVANPEHYIKHPLQNRWALWFFKNDKSKTWQANLRLISKFDTVEDFWALYNHIQLSSNLMPGCDYSLFKDGIEPMWEDEKNKRG

SEQ ID NO: 4912 - protein, 61 aa, Homo sapiens
MSFIFDWIYSGFSSVLQFLGLYKKTGKLVFLGLDNAGKTTLLHMLKDDRLGQHVPTLHPTS

SEQ ID NO: 4913 - protein, 94 aa, Homo sapiens
MSEFNNNFRQQMENYPKNNHTASILDRMQADFKCCGAANYTDWEKIPSMSKNRVPDSCCINVTVGCGINFNEKAIHKEGCVEKIGGWLRKNVLV

SEQ ID NO: 4914 - protein, 119 aa, Homo sapiens
  UNSURE 77: Xaa=His or Leu or Gln
MSIPFSNTHYRIPQGFGNLLEGLTREILREQPDNIPAFAAAYFESLLEKREKTNFDPAEWGSKVEDRFYNNHAFEEXEPPEKSDPKQEESQISGKEEETSVTILDSSEEDKEKEEVAAV

SEQ ID NO: 4915 - protein, 103 aa, Homo sapiens
MTGKVMASKTSELSYLDIFIQCVGCYTCITAIIELSHGSFEKQDRDVLKASGFDFLVRCCGTWHLTTRIVVCKEKTSRKRQQKKKKKKKKKKKKKKKKKKKKK

SEQ ID NO: 4916 - protein, 54 aa, Homo sapiens
MPTTQQSPQDEQEKLLDEAIQAVKVQSFQMKRCLDKNKLMDALKHASNMLGELR

SEQ ID NO: 4917 - protein, 153 aa, Homo sapiens
MSIFTPTNQIRLTNVAVVRMKRAGKRFEIACYKNKVVGWRSGVEKDLDEVLQTHSVFVNVSKGQVAKKEDLISAFGTDDQTEICKQILTKGEVQVSDKERHTQLEQMFRDIATIVADKCVNPETKRPYTVILIERAMKDIHYSVKTNKSTKQQ

SEQ ID NO: 4918 - protein, 106 aa, Homo sapiens
MPKSKRDKKVSLTKTAKKGLELKQNLIEELRKCVDTYKYLFIFSVANMRNSKLKDIRNAWKHSRMFFGKNKVMMVALGRSPSDEYKDNLHQVSKRLRGEVGLLFTN

SEQ ID NO: 4919 - protein, 202 aa, Homo sapiens
MSNLNTQVKDTMNGHISNHPSSFGMYPSQMNGYGSSPTFSQTDREHGSKTSAKALYEQRKNYARDSVSSVSDISQYRVEHLTTFVLDRKDAMITVDDGIRKLKLLDAKGKVWTQDMILQVDDRAVSLIDLESKNELENFPLNTIQHCQAVMHSCSYDSVLALVCKEPTQNKPDLHLFQCDEVKANLISEDIESAISDSKGGK

SEQ ID NO: 4920 - protein, 99 aa, Homo sapiens
  UNSURE 76: Xaa=Asp or Tyr
MKPAMETAAEENTEQSQERKGCFECCIKCLGGVPYASLVATILCFSGVALFCGCGHVALAGTVAILEQHFSTNASXHALLSEVIQLMQYVIYGIASFSS

SEQ ID NO: 4921 - protein, 142 aa, Homo sapiens
MELVQVLKRGLQQITGHGGLRGYLRVFFRTNDAKVGTLVGEDKYGNKYYEDNKQFFGRHRWVVYTTEMNGKNTFWDVDGSMVPPEWHRWLHSMTDDPPTTKPLTARKFIWTNHKFNVTGTPEQYVPYSTTRKKIQEWIHLQH

SEQ ID NO: 4922 - protein, 76 aa, Homo sapiens
MEEDQELERKAIEELLKEAKRGKTRAETMGPMGWMKCPLASTNKRFLINTIKNTLPSHKEQDHEQKEGDKEPAKSQ

SEQ ID NO: 4923 - protein, 63 aa, Homo sapiens
  UNSURE 61: Xaa=Lys or Met
MEEDQELERKISGLKTSMAEGERKTALEMVQAAGTDRHCVTFVLHEEDHTLGNSLRYMIMXNP

SEQ ID NO: 4924 - protein, 63 aa, Homo sapiens
  UNSURE 60: Xaa=Arg or Thr
MFKNTFQSGFLSILYSIGSKPLQIWDKKVRNGHIKRITDNDIQSLVLEIEGTNVSTTYIXCPA

SEQ ID NO: 4925 - protein, 110 aa, Homo sapiens
MTAAIRRQRELSILPKVTLEAMNTTVMQGFNRSERCPRDTRIVQLVFPALYTVVFLTGILLNTLALWVFVHIPSSSTFIIYLKNTLVADLIMTPVGLLHALLMAGGSCPD

SEQ ID NO: 4926 - protein, 116 aa, Homo sapiens
  UNSURE 101: Xaa=Leu or Met or Val
  UNSURE 110: Xaa=Glu or Lys
MSHVVVKNDPELDQQLANLDLNSEKQSGGASTASKGRYIPPHLRNREASKGFHDKDSSGWSCSKDKDAYSSFGSRDSRGKPGYFSERGSGSRGRFDDRGRXTMMVLAIVXDLALAD

SEQ ID NO: 4927 - protein, 116 aa, Homo sapiens
MDIRPNHTIYINNMNDKIKKEELKRSLYALFSQFGHVVDIVALKTMKMRGQAFVIFKELGSSTNALRQLQGFPFYGKPMRIQYAKTDSDIISKMRGTFADKEKKKEKKKAKTVEQT

SEQ ID NO: 4928 - protein, 116 aa, Homo sapiens; identical to SEQ ID NO: 4927

SEQ ID NO: 4929 - protein, 131 aa, Homo sapiens
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALS

SEQ ID NO: 4930 - protein, 108 aa, Homo sapiens
MTTLVLDNGAYNAKIGYSHENVSVIPNCQFRSKTARLKTFTANQIDEIKDPSGLFYILPFQKVDFLDTNIIITEPYFNFTSIQESMNEILFEEYQFQAVLRVNAGALS

SEQ ID NO: 4931 - protein, 82 aa, Homo sapiens
  UNSURE 51: Xaa= *  or Gly or Arg
  UNSURE 63: Xaa=Asp or Glu
MSALNWKPFVYGGLASITAECGTFPIDLTKTRLQIQGQTNDAKFKEIRYRXMLHALVRIGREXGAESTLLGDCPRDVTPGIL

SEQ ID NO: 4932 - protein, 100 aa, Homo sapiens
  UNSURE 59: Xaa= *  or Lys or Arg or Trp
  UNSURE 95: Xaa= *  or Gly or Arg
MGYHFELPGPRMVVTNLLTRNQDKQRQKRQEEQKQQQLKEQKKLIAMLENGLGLPPGMXELLGGPKPDSRMQEFFQPPPPRPPNPQNVPFSQRSXMMKKP

SEQ ID NO: 4933 - protein, 124 aa, Homo sapiens
  UNSURE 109: Xaa=Asp or Glu
  UNSURE 114: Xaa= *  or Leu or Ser or Trp
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDXAIQKXKILSLQSSRL

SEQ ID NO: 4934 - protein, 87 aa, Homo sapiens
MAEVPELASEMMAYYSGNEDDLFFEADGPKQMKCSFQDLDLCPLDGGIQLRISDHHYSKGFRQAASVVVAMDKLRKMLVPCPQTFQE

SEQ ID NO: 4935 - protein, 82 aa, Homo sapiens
MQIVRYSEQTLKIAVISKNPVLVSQYEKVDAGEQRLMNEAFQPASDLFGPCILHQIGSPPTLRPPKTLNSSSVILTERYPLQ

SEQ ID NO: 4936 - protein, 77 aa, Homo sapiens
MQIVRYSEQTLKIAVISKNPVLVSQYEKVDAGEQRLMNEAFQPASDLFGPCILHQIGSPPTLRPPKTLNSSSVILTE

SEQ ID NO: 4937 - protein, 90 aa, Homo sapiens
  UNSURE 69: Xaa=Phe or Ile or Leu or Val
MGNRVCCGGSWSCPSTFQKKKKRGSQTRRTLKPQPQQLQQNLPKGHETTGHTYERVLQQQGSQERSPGXMSEDSNLHYADIQVCSRPHAR

SEQ ID NO: 4938 - protein, 108 aa, Homo sapiens
  UNSURE 61: Xaa=His or Leu or Pro or Gln or Arg
  UNSURE 62: Xaa=Gly or Ser
  UNSURE 83: Xaa=Asn or Thr
  UNSURE 96: Xaa=Asn or Ser
MKLPIFIADAFTARAFRGNPAAVCLLENELDEDMHQKIAREMNLSETAFIRKLHPTDNFAXXSCFGLRWFTPASEVPLCGHAXLASAAVLFHKIKXMNSTLTFVTLSG

SEQ ID NO: 4939 - protein, 67 aa, Homo sapiens
MHTGGLGGYGSGDSEDERSDRGSESSDTDDEELRHRIRQKQEAFWRKEKEQQLLHDKQMEEEKQQTE

SEQ ID NO: 4940 - protein, 89 aa, Homo sapiens
  UNSURE 83: Xaa=Phe or Ile or Leu or Val
MGDVKNFLYAWCGKRKMTPSYEIRAVGNKNRQKFMCEVQVEGYNYTGMGNSTNKKDAQSNAARDFVNYLVRINEIKSEEVPAXGVASPP

SEQ ID NO: 4941 - protein, 139 aa, Homo sapiens
  UNSURE 129: Xaa=Leu or Met or Val
MFSRAGVAGLSAWTLQPQWIQVRNMATLKDITRRLKSIKNIQKITKSMKMVAAAKYARAERELKPARIYGLGSLALYEKADIKGPEDKKKHLLIGVSSDRGLCGAIHSSIAKQMKSEVATLTAAGKEVXLVGIGDLFSG

SEQ ID NO: 4942 - protein, 92 aa, Homo sapiens
  UNSURE 82: Xaa=Leu or Met or Val
MKMVAAAKYARAERELKPARIYGLGSLALYEKADIKGPEDKKKHLLIGVSSDRGLCGAIHSSIAKQMKSEVATLTAAGKEVXLVGIGDLFSG

SEQ ID NO: 4943 - protein, 58 aa, Homo sapiens
MDANDKKIQEKDRELEIKNIYSHPILKNLHDTEDYPKVSSTKSVQADRKILPFTSMRH

SEQ ID NO: 4944 - protein, 115 aa, Homo sapiens
  UNSURE 25: Xaa=Pro or Thr
MGQQISDQTQLVINKLPEKVAKHVXLVRESGSLTYEEFLGRVAELNDVTAKVASGQEKHLLFEVQPGSDSSAFWKVVVRVVCTKINKSSGIVEASRIMNLYQFIQLYKDITSQAA

SEQ ID NO: 4945 - protein, 138 aa, Homo sapiens
MPMAGLLKGLVRQLEQFRVQQQASKMPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTD

SEQ ID NO: 4946 - protein, 115 aa, Homo sapiens
  UNSURE 115: Xaa=His or Gln
MPMAGLLKGLVRQLEQFRVQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHX

SEQ ID NO: 4947 - protein, 58 aa, Homo sapiens
MEAMEKLKSGMRFNEVAAQYSEDKARQGRMQQQGTILEAESSPHQIPILLAPSSWTLQ

SEQ ID NO: 4948 - protein, 65 aa, Homo sapiens
MLFPPSSCLEQPDSCQPYGSSFYALEEKHVGFSLDVGEIEKKGKGKKRRGRRSTKKRRRRGRKEG

SEQ ID NO: 4949 - protein, 125 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHK

SEQ ID NO: 4950 - protein, 177 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISAN

SEQ ID NO: 4951 - protein, 211 aa, Homo sapiens
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEA

SEQ ID NO: 4952 - protein, 78 aa, Homo sapiens
MDSRLDELCNDIATKKKLEEEEAEVKRKATDAAYQARQAVKTPPRRLPTVMVRSPIDSASPGGDYPLGDLTPTTMEEA

SEQ ID NO: 4953 - protein, 123 aa, Homo sapiens
MNLGDGLKLETELLDGKTKLILSPYEHKSKISVKMGNKAKIAKCPLRTKTGHILKSTQDTCIGSEKLLQKKPVGSETSQAKGEKNGMTFSSTKDLCKQCIDKDCLHIQKEISPATPNMQKTRN

SEQ ID NO: 4954 - protein, 126 aa, Homo sapiens
  UNSURE 118: Xaa=Ala or Asp or Gly or His or Leu or Pro or Arg or Val
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGXGNIFQKRR

SEQ ID NO: 4955 - protein, 89 aa, Homo sapiens
MAGNDENYSAELRNASAVMKNQVARFNDLRFVGRSGRGKSFTLTITVFTNPPQVATYHRAIKVTVDGPREPRRHRQKLDDSKPSLFSDR

SEQ ID NO: 4956 - protein, 55 aa, Homo sapiens
MGGFFSSIFSSLFGTREMRILILGLDGAGKTTILYRLQVGEVVTTIPTIGFNVET

SEQ ID NO: 4957 - protein, 115 aa, Homo sapiens
MESGKMAPPKNAPRDALVMAQILKDMGITEYEPRVINQMLEFAFRYVTTILDDAKIYSSHAKKPNVDADDVRLAIQCRADQSFTSPPPRDFLLDIARQKNQTPLPLIKPYAGPRL

SEQ ID NO: 4958 - protein, 83 aa, Homo sapiens
  UNSURE 46: Xaa=Asp or Tyr
  UNSURE 73: Xaa=Leu or Met
  UNSURE 77: Xaa=Phe or Tyr
MESGKTASPKSMPKDAQMMAQILKDMGITEYEPRVINQMLEFAFRXVTTILDDAKIYSSHAKKATVDADDVRXAIQXRADQSF

SEQ ID NO: 4959 - protein, 77 aa, Homo sapiens
MLEFAFRYVTTILDDAKIYSSHAKKPNVDADDVRLAIQCRADQSFTSPPPRDFLLDIARQKNQTPLPLIKPYAGPRL

SEQ ID NO: 4960 - protein, 64 aa, Homo sapiens
MMTSVSSDHCRGAQEKPQISAAQSTQPQKQVVQATAEQMRLAQVIFDKNDSDFEAKVKQLMEVT

SEQ ID NO: 4961 - protein, 67 aa, Homo sapiens
MDRLHLRRTTEQHVPEVEVQVKRRRTASLSNQECQLYPRRSQQQQVPVVDFQAELRQAFLAETPRGG

SEQ ID NO: 4962 - protein, 90 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGV

SEQ ID NO: 4963 - protein, 111 aa, Homo sapiens
MTGYTPDEKLRLQQLRELRRRWLKDQELSPREPVLPPQKMGPMEKFWNKFLENKSPWRKMVHGVYKKSIFVFTHVLVPVWIIHYYMKYHVSEKPYGIVEKKSRIFPGDTIL

SEQ ID NO: 4964 - protein, 105 aa, Homo sapiens
MFSLRFICVKQNSVYWCSVPREGWHSMEVSKNHHYANHQEYDPDTCARCISVRESPRKTQHSQVVEGAIVTQRRDRARSVSVVRMGPLCPGVPRGCPYGVVCLRA

SEQ ID NO: 4965 - protein, 77 aa, Homo sapiens
MLRAKNQLFLLSPHYLRQVKESSGSRLIQQRLLHQQQPLHPEWAALAKKQLKGKNPEDLIWHTPEGISIKPLYSKRD

SEQ ID NO: 4966 - protein, 122 aa, Homo sapiens
MAKGDPKKPKGKMSAYAFFVQTCREEHKKKNPEVPVNFAEFSKKCSERWKTMSGKEKSKFDEMAKADKVRYDREMKDYGPAKGGKKKKDPNAPKRPPSGFFLFCSEFRPKIKSTNPGISIGD

SEQ ID NO: 4967 - protein, 73 aa, Homo sapiens
MDAFEKVRTKLETQPQEEYEIINVEVKHGGFVYYQEGCCLVRSKDEEADSDNYEVLFNLEELKLDQPFIDCIR

SEQ ID NO: 4968 - protein, 78 aa, Homo sapiens
MDAFEKVRTKLETQPQEEYEIINVEVKHGGFVYYQEGCCLVRSKDEEADNDNYEVLFNLEELKLDQPFIDVSELLQMK

SEQ ID NO: 4969 - protein, 92 aa, Homo sapiens
  UNSURE 59: Xaa=Asp or Glu
  UNSURE 69: Xaa=Asp or Glu
  UNSURE 82: Xaa=Ala or Asp
MEKLYKENEGKPENERNLESEGKPEDEGSTEDEGKSDEEEKPDMEGKTECEGKREDEGXPGDEGQLEDXGNQEKQGKSEGEXKPQSEGKPAS

SEQ ID NO: 4970 - protein, 68 aa, Homo sapiens
MATVQQLEGRWRLVDSKGFDEYMKELGEAPGLAAPATWRVVRSSVPRSPSACQILGQEMLGGLPPSPP

SEQ ID NO: 4971 - protein, 130 aa, Homo sapiens
  UNSURE 30: Xaa=Asp or Glu
  UNSURE 31: Xaa=Leu or Val
MSDQQLDCALDLMRRLPPQQIEKNLSDLIXXVPSLCEDLLSSVDQPLKIARDKVVGKDYLLCDYNRDGDSYRSPWSNKYDPPLEDGAMPSARLRKLEVEANNAFDQYRDLYFEGGVSSVYLWDLDHGFAG

SEQ ID NO: 4972 - protein, 98 aa, Homo sapiens
MAGKKNVLSSLAVYAEDSEPESDGEAGIEAVGSAAEEKGGLVSDAYGEDDFSRLGGDEDGYEEEEDENSRQSEDDDSETEKPEADDPKDNTEAEKRDP

SEQ ID NO: 4973 - protein, 61 aa, Homo sapiens
MAGKKNVLSSLAVYAEDSEPESDGEAGIEAVGSAAEEKGGLVSDAYGEDTNPLYPALSLPP

SEQ ID NO: 4974 - protein, 110 aa, Homo sapiens
  UNSURE 101: Xaa=Ile or Ser
MADIDNKEQSELDQDLDDVEEVEEEETGEETKLKARQLTVQMMQNPQILAALQERLDGLVETPTGYIESLPRVVKRRVNALKNLQVKCAQIEAKFYEEVMXLKGSMLSLS

SEQ ID NO: 4975 - protein, 101 aa, Homo sapiens
MAAANPWDPASAPNGAGLVLGHFIASGMVNQEMLNMSKKTVSCFVNFTRLQQITNIQAEIYQKNLEIELLKLEKDTADVVHPFFLEMKSCYVAQAGLELMA

SEQ ID NO: 4976 - protein, 116 aa, Homo sapiens
  UNSURE 61: Xaa=Lys or Asn
  UNSURE 97: Xaa=Cys or Gly or Arg or Ser
  UNSURE 101: Xaa=Ile or Lys or Arg or Thr
  UNSURE 105: Xaa=Asp or Glu
  UNSURE 107: Xaa=Gln or Arg
MSGKANASKKNAQQLKRNPKRKKDNEEVVLSENKVRNTVKKNKNHLKDLSSEGQTKHTNLXHGKTAASKRKTWQPLSKSTRDHLQTMMESVIMTILXNSIXEKEXIXYHLNFLKKR

SEQ ID NO: 4977 - protein, 128 aa, Homo sapiens
  UNSURE 89: Xaa=Ala or Asp or Glu or Gly or Ile or Lys or Met or Asn or Arg or Ser or Thr or Val
  UNSURE 95: Xaa=Ala or Pro or Ser or Thr
  UNSURE 114: Xaa=Ala or Asp or Gly or Ile or Asn or Ser or Thr or Val
MADGKAGDEKPEKSQRAGAAGRPEEEAEKPVKTKTVSSSNGGESSSRSAEKRSAEEEAADLPTKPTKISKFGFAIGSQTTKKASAISIXLGSSKXKETVPTLAPKTLSVAAAFXEDEGSEPEEMPPEA

SEQ ID NO: 4978 - protein, 82 aa, Homo sapiens
  UNSURE 31: Xaa=Ala or Asp or His or Asn or Pro or Ser or Thr or Tyr
  UNSURE 70: Xaa=Lys or Asn
MNRLPDDYDPYAVEEPSDEEPALSRWAPAPXWPPRIWVEAWLWSPPFVAPAEPTQTLAAREPVVPVTCAXQRAFLMGSRSPG

SEQ ID NO: 4979 - protein, 118 aa, Homo sapiens
  UNSURE 107: Xaa=Phe or Ile or Leu or Val
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYXDSDSEDEDRAV

SEQ ID NO: 4980 - protein, 82 aa, Homo sapiens
  UNSURE 60: Xaa=Ala or Glu or Gly or Val
MDDFERRRELRRQKREEMRLEAERIAYQRNDDDEEEAARERRRRARQERLRQKQEEESLXQVTDQVEVNAQNSVPDEEAKTT

SEQ ID NO: 4981 - protein, 86 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYILTQAT

SEQ ID NO: 4982 - protein, 143 aa, Homo sapiens
MAAQGEPQVQFKLVLVGDGGTGKTTFVKRHLTGEFEKKYVATLGVEVHPLVFHTNRGPIKFNVWDTAGQEKFGGLRDGYYIQAQCAIIMFDVTSRVTYKNVPNWHRDLVRVCENIPIVLCGNKVDIKDRKVKAKSIVFHRKKN

SEQ ID NO: 4983 - protein, 53 aa, Homo sapiens
  UNSURE 19: Xaa= *  or Glu or Lys or Gln
MADKPDMGEIASFDKAKLXEKRRRRRRTPCRPKRPLSRRSGVKFPKILVNGLV

SEQ ID NO: 4984 - protein, 58 aa, Homo sapiens
MADKPDMGEIASFDKAKLKKTETQEKNTLPTKESECASVSRAPAQPLTLLFLANPLLH

SEQ ID NO: 4985 - protein, 134 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKALLQPTAM

SEQ ID NO: 4986 - protein, 93 aa, Homo sapiens
  UNSURE 13: Xaa=Ala or Asp or Gly or Val
  UNSURE 27: Xaa=His or Gln
  UNSURE 28: Xaa=Leu or Val
  UNSURE 55: Xaa=Ala or Thr
  UNSURE 65: Xaa=Ala or Gly
MEYLIGIQGPDYXLVASDRVAASNIVXXKDGYELSPTAAANFTRRNLADCLRSRXPYHVNLLLAXYDEHEGPALYYMDYLAALAKALLQPTAM

SEQ ID NO: 4987 - protein, 54 aa, Homo sapiens
MKQPIMADGPRCKRRKQANPRRKNGKKQPEPNFSGPLRGSRPREKEGERERNRG

SEQ ID NO: 4988 - protein, 133 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYG

SEQ ID NO: 4989 - protein, 101 aa, Homo sapiens
MYLKSDSGLGGWITIPAVADVLKYSCIVCWSSREKNNVEQDLKEKEDTIKQRTSEVQDLQDEVQRENTNLQKLQAQKQQVQELLDELDEQKAQLEEQLKEV

SEQ ID NO: 4990 - protein, 65 aa, Homo sapiens
  UNSURE 17: Xaa=Ile or Asn or Ser or Thr
  UNSURE 65: Xaa=Phe or Ile or Leu or Met or Ser or Thr
MADEIDFTTGDAGASSXYPMQCSALRKNGFVVLKGRPCKIVEMSTSKTGKHGHAKVHLVGIDIFX

SEQ ID NO: 4991 - protein, 113 aa, Homo sapiens
MAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVC

SEQ ID NO: 4992 - protein, 101 aa, Homo sapiens
MAASSSSSSAGGVSGSSVTGSGFSVSDLAPPRKALFTYPKGAGEMLEDGSERFLCESVFSYQVASTLKQVKHDQQVARMEKLAGLVEELEADEWRFKPIEQ

SEQ ID NO: 4993 - protein, 101 aa, Homo sapiens; identical to SEQ ID NO: 4992

SEQ ID NO: 4994 - protein, 116 aa, Homo sapiens
MPAYHSSLMDPDTKLIGNMALLPIRSQFKGPAPRETKDTDIVDEAIYYFKANVFFKNYEIKNEADRTLIYITLYISECLKKLQKCNSKSQGEKEMYTLGITNFPIPGEPGFPLNAI

SEQ ID NO: 4995 - protein, 100 aa, Homo sapiens
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIT

SEQ ID NO: 4996 - protein, 68 aa, Homo sapiens
  UNSURE 60: Xaa=Asp or Asn
MAAAATLRLSAQESHSVIQTGVQWRDHSSPQPPPTGDILIQDLTLFPRLECDGTISADCXLHFPGRLF

SEQ ID NO: 4997 - protein, 60 aa, Homo sapiens
  UNSURE 37: Xaa= *  or Glu or Lys or Gln
MAAAATLRLSAQILHWMDQRTTHRPVIWVNQFCHPTXNRKQHEKLTLTPYESISNQTDQH

SEQ ID NO: 4998 - protein, 66 aa, Homo sapiens [sequence omitted]

SEQ ID NO: 4999 - protein, 76 aa, Homo sapiens
  UNSURE 32: Xaa=Lys or Gln
  UNSURE 34: Xaa=Lys or Asn
  UNSURE 35: Xaa=Asp or Glu or His or Gln
  UNSURE 37: Xaa=Lys or Asn
  UNSURE 38: Xaa=His or Asn
  UNSURE 42: Xaa=Arg or Ser
MLGLDELGRSGCGHCTQADLRFGDAAGRDPGXDXXQXXRRAXVPPPPRVMAAAAALRAPAQVVGMEGKMRQHLLSR

SEQ ID NO: 5000 - protein, 129 aa, Homo sapiens
  UNSURE 106: Xaa=Glu or Val
  UNSURE 107: Xaa=Lys or Thr
MAKVEQPVPDHSELVEDSSPDSEPVDLFSDDSIPDVPQKQDETVMLVKESLTETSFESMIEYENKEKLSALPPEGGKPYLESFKLSLDNTKDTLLPDEVSTLSKKXXIPLQMEELSTAVYSNDDLFISK

SEQ ID NO: 5001 - protein, 136 aa, Homo sapiens
  UNSURE 103: Xaa=Glu or Gly
MATLKEKLIAPVAEEEATVPNNKITVVGVGQVGMACAISILGKSLADELALVDVLEDKLKGEMMDLQHGSLFLQTPKIVADKDYSVTANSKIVVVTAGVRQQXGESRLNLVQRNVNVFKFIIPQIVKYSPDCIIIV

SEQ ID NO: 5002 - protein, 79 aa, Homo sapiens
  UNSURE 16: Xaa=Asp or Glu
MATLKEKLIAPVAEEXATVPNNKITVVGVGQVGMACAISILGKVHFKNTIDDREVQHVYTVSLGTLEFYYIFKRFLFFL

SEQ ID NO: 5003 - protein, 139 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIE

SEQ ID NO: 5004 - protein, 123 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQVKSGFYSL

SEQ ID NO: 5005 - protein, 175 aa, Homo sapiens
  UNSURE 155: Xaa=Ile or Leu
MDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYXSPKWIKMFVLDEADEMLSRG

SEQ ID NO: 5006 - protein, 65 aa, Homo sapiens
  UNSURE 45: Xaa=Ile or Leu
MGATCHACIGGTNVRNEMQKLQAEAPHIVVGTPGRVFDMLNRRYXSPKWIKMFVLDEADEMLSRG

SEQ ID NO: 5007 - protein, 62 aa, Homo sapiens
MSASQDSRTEPNPEERPREAPGAHPAPGGRVHFAAQAGLLANCGWAGPPSFGGERPEIQRQW

SEQ ID NO: 5008 - protein, 52 aa, Homo sapiens
  UNSURE 48: Xaa=Asp or Glu
MEKLYSENEGMASNQGKMENEEQPQDERKPEVTCTLEDKKLENEGKTXNKRK

SEQ ID NO: 5009 - protein, 67 aa, Homo sapiens [sequence omitted]

SEQ ID NO: 5010 - protein, 52 aa, Homo sapiens
  UNSURE 14: Xaa=Lys or Asn
  UNSURE 48: Xaa=Asp or Glu
MEKLYSENEGMASXQGKMENEEQPQDERKPEVTCTLEDKKLENEGKTXNKRK

SEQ ID NO: 5011 - protein, 74 aa, Homo sapiens
MMSPLKNSSDGLTSLNQSNSTLVALPEGRQELSDGQVKTGISMSLLTVIEKLRERTDQNASDDDILKELQDNAQ

SEQ ID NO: 5012 - protein, 102 aa, Homo sapiens
MPRIMIKGGVWRNTEDEILKAAVMKYGKNQWSRIASLLHRKSAKQCKARWYEWLDPSIKKTEWSREEEEKLLHLAKLMPTQWRTIAPIIGRTAAQCLEHYEF

SEQ ID NO: 5013 - protein, 110 aa, Homo sapiens
  UNSURE 94: Xaa=His or Leu or Pro or Gln or Arg
MAAAAVQGGRSGGSGGCSGAGGASNCGTGSGRSGLLDKWKIDDKPVKIDKWDGSAVKNSLDDSAKKEKSIFLVAHRKDPTGMDPDDIWQLSSSXKRFDDKYTLKLTFISR

SEQ ID NO: 5014 - protein, 143 aa, Homo sapiens
  UNSURE 8: Xaa=Ala or Asp or Gly or Val
MDKMAAAXVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIF

SEQ ID NO: 5015 - protein, 140 aa, Homo sapiens
MAAAAVQGGRSGGSGGCSGAGGASNCGTGSGRSGLLDKWKIDDKPVKIDKWDGSAVKNSLDDSAKKVLLEKYKYVENFGLIDGRLTICTISCFFAIVALIWDYMHPFPESKPVLALCVISYFVMMGILTIYTSYKEKSIF

SEQ ID NO: 5016 - protein, 114 aa, Homo sapiens
  UNSURE 102: Xaa=Ala or Glu or Gly or Val
  UNSURE 109: Xaa=Ser or Thr
MGRIFLDHIGGTRLFSCANCDTILTNRSELISTRFTGATGRAFLFNKVVNLQYSEVQDRVMLTGRHMVRDVSCKNCNSKLGWIYEFATEDSQRYKEGRVILXRALVREXEGLRS

SEQ ID NO: 5017 - protein, 118 aa, Homo sapiens
MSRSYNDELQFLEKINKNCWRIKKGFVPNMQVEGVFYVNDALEKLMFEELRNACRGGGVGGFLPAMKQIGNVAALPGIVHRSIGLPDVHSGYGFAIGNMAAFDMNDPEAVVSPGGVGF

SEQ ID NO: 5018 - protein, 66 aa, Homo sapiens
  UNSURE 62: Xaa=Lys or Thr
MEADASVDMFSKVLEHQLLQTTKLVEEHLDSEIQKLDQMDEDELERLKEKRLQALRKAQQQXQEWL

SEQ ID NO: 5019 - protein, 123 aa, Homo sapiens
MAAIGRGRSLKNLRVRGRNDSGEENVPLDLTREPSDNLREILQNVARLQGVSNMRKLGHLNNFTKLLCDIGHSEEKLGFHYEDIIICLRLALLNEAKEVRAAGLRALRYLIQDSSILQKVLKL

SEQ ID NO: 5020 - protein, 139 aa, Homo sapiens
  UNSURE 3: Xaa=Ile or Val
MDXLVSECSARLLQQEEEIKSLTAEIDRLKNCGCLGASPNLEQLQEENLKLKYRLNILRKSLQAERNKPTKNMINIISRLQEVFGHAIKAAYPDLENPPLLVTPSQQAKFGDYQCNSAMGISQMLKTKEQKVNPREIAE

SEQ ID NO: 5021 - protein, 99 aa, Homo sapiens
MRQKKIREDHKSYYAINTVYVYGQEKYLLLHDISESEFLTEAEIICDVVCLVYDVSNPKSFEYCARIFKQHFMDSRIPCLIVAAKSDLHEVKQEYSISP

SEQ ID NO: 5022 - protein, 115 aa, Homo sapiens
  UNSURE 20: Xaa=Asp or His
MPGRHVSRVRALYKRVLQLXRVLPPDLKSLGDQYVKDEFRRHKTVGSDEAQRFLQEWEVYATALLQQANENRQNSTGKACFGTFLPEEKLNDFRDEQIGQLQELMQEATKPNRQF

SEQ ID NO: 5023 - protein, 75 aa, Homo sapiens
  UNSURE 58: Xaa=Lys or Thr
  UNSURE 68: Xaa=Ile or Asn or Ser or Thr
MTLSVLSRKDKERVIRRLLLQAPPGEFVNAFDDLCLLIRDEKLMHHQGECAGHQHCQXYSVPLCIDGXPVLLSHH

SEQ ID NO: 5024 - protein, 142 aa, Homo sapiens
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYA

SEQ ID NO: 5025 - protein, 153 aa, Homo sapiens
MLGAQWRRNQPSRAAEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEM

SEQ ID NO: 5026 - protein, 100 aa, Homo sapiens
MAAGVEAAAEVAATEIKMEEESGAPGVPSGNGAPGPKGEGERPAQNEKRKEKNIKRGGNRFEPYANPTKRYRAFITNIPFDVKWQSLKDLVKEKVGEVTY

SEQ ID NO: 5027 - protein, 85 aa, Homo sapiens
  UNSURE 78: Xaa=Glu or Gly
MRMTMEEMKNEAETTSMVSMPLYAVMYPVFNELERVNLSAAQTLRAAFIKAEKENPGLTQDIIMKILEKKSVEVNFTXSLLRMAA

SEQ ID NO: 5028 - protein, 85 aa, Homo sapiens; identical to SEQ ID NO: 5027
  UNSURE 78: Xaa=Glu or Gly

SEQ ID NO: 5029 - protein, 82 aa, Homo sapiens
  UNSURE 68: Xaa=Glu or Val
MGKGRFDEKENVSNCIQLKTSVIKGIKNQLIEQFPGIEPWLNQIMPKKDPVKIVRCHEHIEILTVNGXLLFFRQREGPFYPT

SEQ ID NO: 5030 - protein, 94 aa, Homo sapiens
MFKKFDEKENVSNCIQLKTSVIKGIKNQLIEQFPGIEPWLNQIMPKKDPVKIVRCHEHIEILTVNGELLFFRQREGPFYPTLRLLHKYPFILPH

SEQ ID NO: 5031 - protein, 100 aa, Homo sapiens
  UNSURE 67: Xaa=Asp or Glu
MGAVKPISMKTCCQHGDRGYWSTGYYWRGGPDDNLIEGGGTKFVCKPGARNITVIFHPLLRFIQEIXHALGLGPAKQCPLREFLTVYIKNIFLNQVLAEI

SEQ ID NO: 5032 - protein, 96 aa, Homo sapiens
  UNSURE 88: Xaa=Asp or Gly
MSTIQNLQSFDPFADATKGDDLLPAGTEDYIHIRIQQRNGRKTLTTVQGIADDYDKKKLVKAFKKKFACNGTVIEHPEYGEVIQLQGXQRKTSASF

SEQ ID NO: 5033 - protein, 100 aa, Homo sapiens
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQ

SEQ ID NO: 5034 - protein, 102 aa, Homo sapiens
  UNSURE 99: Xaa=Asp or Glu
MGTPKPRILPWLVSQLDLGQLEGVAWVNKSRTRFRIPWKHGLRQDAQQEDFGIFQAWAEATGAYVPGRDKPDLPTWKRNFRSALNRKEGLRLAEDRSKXPHD

SEQ ID NO: 5035 - protein, 109 aa, Homo sapiens
MKFVYKEEHPFEKRRSEGEKIRKKYPDRVPVIVEKAPKARIGDLDKKKYLVPSDLTVGQFYFLIRKRIHLRAEDALFFFVNNVIPPTSVSLVLPQTLTNHNTHLTESLS

SEQ ID NO: 5036 - protein, 60 aa, Homo sapiens
MMEVESSYSDFISCDRTGRRNAVPDIQGDSEAVSVRKLAGDMGELALEGEPWHWPSSLFS

SEQ ID NO: 5037 - protein, 96 aa, Homo sapiens
  UNSURE 2: Xaa=Ala or Val
  UNSURE 83: Xaa=Met or Val
MXSEIHMTGPMCLIENTNGRLMANPEALKILSAITQPMVVVAIVGLYRTGKSYLMNKLAGKKKGFSLGSTVQSHTKGIWMWCXPHPKKPGHILVLL

SEQ ID NO: 5038 - protein, 124 aa, Homo sapiens
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVE

SEQ ID NO: 5039 - protein, 98 aa, Homo sapiens
MAASIVRRGMLLARQVVLPQLSPAGKRYLLSSAYVDSHKWEAREKEHYCLADLASLMDKTFERKLPVSSLTISRLIDNISSREEIDHAEYYLYKFRHS

SEQ ID NO: 5040 - protein, 108 aa, Homo sapiens
  UNSURE 75: Xaa=Ala or Glu
  UNSURE 77: Xaa=Ile or Asn
  UNSURE 80: Xaa=Lys or Thr
  UNSURE 98: Xaa=His or Gln
  UNSURE 99: Xaa=Ala or Thr
MEAYEQVQKGPLKLKGVAELGVTKRKKKKKDKDKAKLLEAMGTSKKNEEEKRRGLDKRTPAQAAFEKMQEKRQMXRXLKXASKTHKQKSGGLQQTPGXXHGALRHSQS

SEQ ID NO: 5041 - protein, 95 aa, Homo sapiens
MSRPLSDQEKRKQISVRGLAGVENVTELKKNFNRHLHFTLVKDRNVATPRDYYFALAHTVRDHLVGRWIRTQQHYYEKDPKAEDLLPVFRVLYGT

SEQ ID NO: 5042 - protein, 110 aa, Homo sapiens
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQ

SEQ ID NO: 5043 - protein, 73 aa, Homo sapiens
MATSMAAASGRFESAKSIEERKEQTRNARAEVLRQAKANFEKEERRKELKRLRGEDTWMLPDVNERIEQFSQE

SEQ ID NO: 5044 - protein, 176 aa, Homo sapiens
  UNSURE 149: Xaa=Phe or Tyr
MVDDKEKNMKCLTFFLMLPETVKNRSKKSSKKANTSSSSSNSSKLPPVCYEIITLKTKKKKMAADIFPRKKPANSSSTSVQQYHQQNLSNNNLIPAPNWQGLYPTIRERNAMMFNNDLMADVHFVVGPPGGTQRLPGHKYVLAVGSSVXHAMFYGELAEDKDEIRIPDVEPAAFLA

SEQ ID NO: 5045 - protein, 66 aa, Homo sapiens
MACGFRRAIACQLSRVLNLPPENLITSISAVPISQKEEVADFQLSVDSLLEKDNDHSRPDIQVQAK

SEQ ID NO: 5046 - protein, 170 aa, Homo sapiens
  UNSURE 120: Xaa=His or Gln
MSFDPNLLHNNGHNGYPNGTSAALRETGVIEKLLTSYGFIQCSERQARLFFHCSQYNGNLQDLKVGDDVEFEVSSDRRTGKPIAVKLVKIKQEILPEERMNGQEVFYLTYTPEDVEGNVXLETGDKINFVIDNNKHTGAVSARNIMLLKKKQARCQGVVCAMKEAFGFIE

SEQ ID NO: 5047 - protein, 170 aa, Homo sapiens; identical to SEQ ID NO: 5046
  UNSURE 120: Xaa=His or Gln

SEQ ID NO: 5048 - protein, 51 aa, Homo sapiens
MRLGSSKLKSNQLLQEALSRMKWGGPSFQPRKPTVPGAIWDKTLTHDSHIH

SEQ ID NO: 5049 - protein, 162 aa, Homo sapiens
  UNSURE 128: Xaa=Gly or Arg
MFLLPLPAAGRVVVRRLAVRRFGSRSLSTADMTKGLVLGIYSKEKEDDVPQFTSAGENFDKLLAGKLRETLNISGPPLKAGKTRTFYGLHQDFPSVVLVGLGKKAAGIDEQENWHEGKENIRAAVAAXCRQIQDLELSSVEVDPCGDAQAAAEGAVLGLYEY

SEQ ID NO: 5050 - protein, 132 aa, Homo sapiens
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMT

SEQ ID NO: 5051 - protein, 125 aa, Homo sapiens
  UNSURE 48: Xaa=Lys or Met or Arg or Thr
MSNNGLDIQDKPPAPPMRNTSTMIGAGSKDAGTLNHGSKPLPPNPEEXKKKDRFYRSILPGDKTNKKKEKERPEISLPSDFEHTIHVGFDAVTGEFTGMPEQWARLLQTSNITKSEQKKNPQLFW

SEQ ID NO: 5052 - protein, 96 aa, Homo sapiens
  UNSURE 88: Xaa=Ala or Asp or Gly or Val
MESGFTSKDTYLSHFNPRDYLEKYYKFGSRHSAESQILKHLLKNLFKIFCLDGVKGDLLIDIGSGPTIYQLLSACESFKEIVVTDYSXQNLQELEK

SEQ ID NO: 5053 - protein, 110 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAP

SEQ ID NO: 5054 - protein, 85 aa, Homo sapiens
MKSLGLSDEEIVKFSEAEHWLDYFPPLAIQDLKRMGLKVDWRRSFITTDVNPYYDSFVRWQFLTLRERNKIKFGKRYTIYSPKDR

SEQ ID NO: 5055 - protein, 138 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRT

SEQ ID NO: 5056 - protein, 90 aa, Homo sapiens
MEKRLQEAQLYKEEGNQRYREGKYRDAVSRYHRALLQLRGLDPSLPSPLPNLGPQGPALTPEQENILHTTQTDCYNNLAACLLQMEPVNY

SEQ ID NO: 5057 - protein, 89 aa, Homo sapiens
  UNSURE 51: Xaa=Lys or Thr
  UNSURE 80: Xaa=Pro or Thr
MADPRVRQIKIKTGVVKRLVKEKVMYEKEAKQQEEKIEKMRAEDGENYDIXKQAERSLPSAHTSTPASASPMAVSSVKSXSPSTLVLPR

SEQ ID NO: 5058 - protein, 98 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAY

SEQ ID NO: 5059 - protein, 143 aa, Homo sapiens
MTPEFRNALYKWEFEESEEDPVTSIPYQLQRLFVLLQTSKKRAIETTDVTRSFGWDSSEAWQQHDVQELCRVMFDALEQKWKQTEQADLINELYQGKLKDYVRCLECGYEGWRIDTYLDIPLVIRPYGSSQAFASVEEALHAF

SEQ ID NO: 5060 - protein, 77 aa, Homo sapiens
MEPSLLQFYISRQWLNKFKTFAEPGPISNNDFLCIHGGVPPRKAGYIEDLVLMLPQNIWDNLYSRYGGGPAVTICTF

SEQ ID NO: 5061 - protein, 68 aa, Homo sapiens
MIILILPHCRVVKKSVISEPQGLLYMDWGRRATIFSIARELPCLSPRNPATRQSTHRPGPGLKFPPHP

SEQ ID NO: 5062 - protein, 136 aa, Homo sapiens
  UNSURE 64: Xaa=Phe or Leu
  UNSURE 65: Xaa=Asp or Tyr
MPLYEGLGSGGEKTAVVIDLGEAFTKCGFAGETGPRCIIPSVIKRAGMPKPVRVVQYNINTEEXXSYLKEFIHILYFRHLLVNPRDRRVVIIESVLCPSHFRETLTRVLFKYFEVPSVLLAPSHLMALLTLGINSA

SEQ ID NO: 5063 - protein, 59 aa, Homo sapiens
  UNSURE 52: Xaa=Cys or Gly
  UNSURE 53: Xaa=Asn or Tyr
MLKREGKVQPYTKTLDGGWGWMIVIHFFLVPWLLLFVTYLERKLPHSWGFCXXWWISDQ

SEQ ID NO: 5064 - protein, 82 aa, Homo sapiens [sequence omitted]

SEQ ID NO: 5065 - protein, 71 aa, Homo sapiens
MIVSSALMIWKGLIVLTGSESPIVVVLSGSMEPAFHRGDLLFLTNFREDPIRAGEIVVFKLKTRHSNSSQS

SEQ ID NO: 5066 - protein, 74 aa, Homo sapiens [sequence omitted]

SEQ ID NO: 5067 - protein, 98 aa, Homo sapiens
MVIRVYIASSSGSTAIKKKQQDVLGFLEANKIGFEEKDIAANEENRKWMRENVPENSRPATGYPLPPQIFNESQYRGDYDAFFEARENNAVYAFLGLT

SEQ ID NO: 5068 - protein, 56 aa, Homo sapiens
MLIKVKTLTGKEIEIDIEPTDKVERIKERVEEKEGIPPQQQRLIYSGKQMNDEKTA

SEQ ID NO: 5069 - protein, 139 aa, Homo sapiens
  UNSURE 101: Xaa=Ile or Leu
  UNSURE 131: Xaa=Asp or Glu
MEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHXTVKKIFVGGIKEDTEEYNLRDYFEKYGKIXTIEVMEDR

SEQ ID NO: 5070 - protein, 161 aa, Homo sapiens
  UNSURE 106: Xaa=Ala or Glu or Gly or Val
  UNSURE 111: Xaa=Ala or Asp or Gly or Val
  UNSURE 113: Xaa= *  or Gly or Arg
  UNSURE 115: Xaa=Asp or Gly
  UNSURE 120: Xaa=Ala or Asp or Gly or Val
  UNSURE 153: Xaa=Asp or Glu
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVXPKRAXSXEXSVKPXAHLTVKKIFVGGIKEDTEEYNLRDYFEKYGKIXTIEVMEDR

SEQ ID NO: 5071 - protein, 97 aa, Homo sapiens
  UNSURE 85: Xaa=Ala or Val
  UNSURE 88: Xaa=Ala or Glu
  UNSURE 89: Xaa=Ala or Glu or Lys or Thr
MKFNPFVTSDRSKNRKRHFNAPSHIRRKIMSSPLSKELRQKYNVRSMPIRKDDEVQVVRGHYKGQQIGKVVQVYRKKYVIYIERXQRXXGLGSMRPG

SEQ ID NO: 5072 - protein, 100 aa, Homo sapiens
  UNSURE 14: Xaa=Asp or Glu
  UNSURE 26: Xaa=Ile or Met
MYSERRGESRPRAXKAIEKNLKEDGXSAAKDVKLLLLGAGESGKSTIVKQMKIIHEDGFSGEDVKQYKPVVYSNTIQSLAAIVRAMDTLGIEYGDKERKA

SEQ ID NO: 5073 - protein, 89 aa, Homo sapiens
MIDRNLREDGEKAAKEVKLLLLGAGESGKSTIVKQMKIIHEDGYSEDECKQYKVVVYSNTIQSIIAIIRAMGRLKIDFGEAARADDAGN

SEQ ID NO: 5074 - protein, 123 aa, Homo sapiens
  UNSURE 19: Xaa=Lys or Met
  UNSURE 80: Xaa=Asp or His or Asn or Tyr
MDTLGIEYGDKERKADAKXVCDVVSRMEDTEPFSAELLSAMMRLWGDSGIQECFNRSREYQLNDSAKYYLDSLDRIGAAXYQPTEQDILRTRVKTTGIVETHFTFKNLHFRLFDVGGQRSERK

SEQ ID NO: 5075 - protein, 77 aa, Homo sapiens
MAKFVIRPATAADCSDILRLIKELAKYEYMEEQVILTEKDLLEDGFGEHPFYHCLVAEVPKEHWTPEGHSIVGFAMY

SEQ ID NO: 5076 - protein, 143 aa, Homo sapiens
  UNSURE 9: Xaa=Leu or Pro
MAEGEDVPXLPTSSGDGWEKDLEEALEAGGCDLETLRNIIQGRPLPADLRAKVWKIALNVAGKGDSLASWDGILDLPEQNTIHKDCLQFIDQLSVPEEKAAELLLDIESVITFYCKSRNIKYSTSLSWIHLLKPLVHLQLPRS

SEQ ID NO: 5077 - protein, 224 aa, Homo sapiens
  UNSURE 28: Xaa=Ala or Phe or Ser or Val
  UNSURE 32: Xaa= *  or Glu or Lys or Gln
  UNSURE 41: Xaa=Ala or Asp or Glu or Gly or Ile or Lys or Met or Asn or Arg or Ser or Thr or Val
  UNSURE 210: Xaa=Gln or Arg
MASGSNWLSGVNVVLVMAYGSLVFVLLXIFVXRQIMRFAMXSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTXSPEVSPTTIQLTYP

SEQ ID NO: 5078 - protein, 54 aa, Homo sapiens
MESKEELAANNLNGENAQQENEGGEQAPTQNEEESRHLGGGEGQKPGGNIRRGR

SEQ ID NO: 5079 - protein, 94 aa, Homo sapiens
  UNSURE 52: Xaa=Glu or Gly
  UNSURE 75: Xaa=His or Gln
  UNSURE 86: Xaa=Asp or Glu
MEQPMQNGEEDRPLGGGEGHQPAGNRRGQARRLAPNFRWAIPNRQINDGMGXDGDDMEIFMEEMREIRRKLRELXLRNCLRILMGXLSNHHDHH

SEQ ID NO: 5080 - protein, 104 aa, Homo sapiens
  UNSURE 39: Xaa=Lys or Gln
  UNSURE 43: Xaa=Phe or Leu
  UNSURE 62: Xaa=Glu or Gly
  UNSURE 85: Xaa=His or Gln
  UNSURE 96: Xaa=Asp or Glu
MANIHQENEEMEQPMQNGEEDRPLGGGEGHQPAGNRRGXARRXAPNFRWAIPNRQINDGMGXDGDDMEIFMEEMREIRRKLRELXLRNCLRILMGXLSNHHDHH

SEQ ID NO: 5081 - protein, 122 aa, Homo sapiens
MAARRRRSTGGGRARALNESKRVNNGNTAPEDSSPAKKTRRCQRQESKKMPVAGGKANKDRTEDKQDESVKALLLKGKAPVDPECTAKVGKAHVYCEGNDVYDVMLNQTNLQFNNNKYYLIQ

SEQ ID NO: 5082 - protein, 128 aa, Homo sapiens
  UNSURE 127: Xaa=Gly or Ser
MHHLPRRKGSDHGLLTESGIETGTGSLPHLKIESGIVQGIDVEEAAVLALVPVPNLQKENDGTKNENEIRSGIGIRRTEIETRMGTDGTRTVNDPAYLLVEEKTLNLGRTETLRRMKRMNMVIRSLXP

SEQ ID NO: 5083 - protein, 111 aa, Homo sapiens
  UNSURE 42: Xaa=Lys or Asn
MARPTLLPSVGPEYIKYFNDKTIDEELERDKRVTWIVEFFAXWSNDCQSFAPIYADLSLKYNCTGLNFGKVDVGRYTDVSTRYKVSTSPLTKQLPTLILFQGGKEAMRRPQ

SEQ ID NO: 5084 - protein, 104 aa, Homo sapiens
MHRSGRYGTQQQRAGSKTAGPPCQWSRMASEGTNIPSPVVRQIDKQFLICSICLERYKNPKVLPCLHTFCERCLQNYIPAHSLTLSCPVCRQTSILPEKGVAAL

SEQ ID NO: 5085 - protein, 99 aa, Homo sapiens
  UNSURE 52: Xaa= *  or Ser
MALKQISSNKCFGGLQKVFEHDSVELNCKMKFAVYLPPKAETGKCPALYWLXGLTCTEQNFISKSGYHQSASEHGLVVIAPDTSPRGCNIKGEDESWDF

SEQ ID NO: 5086 - protein, 55 aa, Homo sapiens
MALKQISSNKCFGGLQKVFEHDSHQQEKLLRIMWKKKITNMQRMERSIQKTSHDG

SEQ ID NO: 5087 - protein, 113 aa, Homo sapiens
  UNSURE 100: Xaa=Ala or Pro or Ser or Thr
MQLKPMEINPEMLNKVLSRLGVAGQWRFVDVLGLEEESLGSVPAPACALLLLFPLTAQHENFRKKQIEELKGQEVSPKVYFMKQTIGNSCGTIGLIHAVXNNQDKLGFEDGSV

SEQ ID NO: 5088 - protein, 53 aa, Homo sapiens
  UNSURE 32: Xaa= *  or Gln
MGARHRARAHSIQIMKVEEIAASKCRRPAVKXFHDSKIKFPLPHRVLRRQHKP

SEQ ID NO: 5089 - protein, 95 aa, Homo sapiens
MKASGTLREYKVVGRCLPTPKCHTPPLYRMRIFAPNHVVAKSRFWYFVSQLKKMKKSSGEIVYCGQVFEKSPLRVKNFGIWLRYDSRSGTAPEPT

SEQ ID NO: 5090 - protein, 177 aa, Homo sapiens
  UNSURE 79: Xaa= *  or Gly
MQLKPMEINPEMLNKVLSRLGVAGQWRFVDVLGLEEESLGSVPAPACALLLLFPLTAQHENFRKKQIEELKFSCWAVRXNSSAVRRSRGSVSCFNSVWTEQIRGLSSSLRPPSDFLSACNLRDHLLGHLLLLGPASTVFVVSSFLPTNHELPDSSELFHRRGGSRQQPGQFVPAGGR

SEQ ID NO: 5091 - protein, 140 aa, Homo sapiens
  UNSURE 79: Xaa= *  or Gly
  UNSURE 83: Xaa=Cys or Gly or Arg or Ser
MQLKPMEINPEMLNKVLSRLGVAGQWRFVDVLGLEEESLGSVPAPACALLLLFPLTAQHENFRKKQIEELKFSCWAVRXNSSXSSAVPRVCLLLQQCLDGTDPGTLFQPPTALRFPLRLQPPGPSSRPSPASGTCQHRCQ

SEQ ID NO: 5092 - protein, 136 aa, Homo sapiens
  UNSURE 79: Xaa= *  or Gly
  UNSURE 83: Xaa=Cys or Gly or Arg or Ser
MQLKPMEINPEMLNKVLSRLGVAGQWRFVDVLGLEEESLGSVPAPACALLLLFPLTAQHENFRKKQIEELKFSCWAVRXNSSXSSAVPRVCLLLQQCLDGTDPGTLFQPPTALRFPLPEAGDGREDGPGGCKRRGN

SEQ ID NO: 5093 - protein, 90 aa, Homo sapiens
  UNSURE 54: Xaa=Met or Val
  UNSURE 55: Xaa=Glu or Lys
MKASGTLREYKVVGRCLPTPKCHTPPLYRMRIFAPNHVVAKSRFWYFVSQLKKXXEIAASKCRRPAVKQFHDSKIKFPLPHRVLRRQHKP

SEQ ID NO: 5094 - protein, 53 aa, Homo sapiens; identical to SEQ ID NO: 5088
  UNSURE 32: Xaa= *  or Gln

SEQ ID NO: 5095 - protein, 61 aa, Homo sapiens
  UNSURE 25: Xaa=Met or Val
  UNSURE 26: Xaa=Glu or Lys
MRIFAPNHVVAKSRFWYFVSQLKKXXEIAASKCRRPAVKQFHDSKIKFPLPHRVLRRQHKP

SEQ ID NO: 5096 - protein, 66 aa, Homo sapiens
MRIFAPNHVVAKSRFWYFVSQLKKMKKSSGEIVYCGQVFEKSPLRVKNFGIWLRYDSRSGTAPEPT

SEQ ID NO: 5097 - protein, 83 aa, Homo sapiens
  UNSURE 70: Xaa=Ile or Ser
MLRFIQKFSQASSKILKYSFPVGLRTSRTDILSLKMSLQQNFSPCPRPWLSSSFPAYMSKTQCYHTSPCXFKKQQSEALLARP

SEQ ID NO: 5098 - protein, 85 aa, Homo sapiens
MGMLELRWASGGEMVTLDVGPEDELPDWAAAKEFYQKYDPKDVIGRGVSSVVRRCVHRATGHEFAVKIMEVTAERLSPEQLEEVR

SEQ ID NO: 5099 - protein, 86 aa, Homo sapiens
  UNSURE 64: Xaa=Ala or Asp or Glu or Gly or Ile or Lys or Met or Asn or Arg or Ser or Thr or Val
MAANVGDQRSTDWSSQYSMVAGAGRENGMETPMHENPEWEKARQALASISKSGAAGGSAKSSSXGPVASAQYVSQAEASSFAAAAV

SEQ ID NO: 5100 - protein, 100 aa, Homo sapiens
MTTAARPTFEPARGGRGKGEGDLSQLSKQYSSRDLPSHTKIKYRQTTQDAPEEVRNRDFRRELEERERAAAREKNRDRPTREHTTSSSVSKKPRLDQIPA

SEQ ID NO: 5101 - protein, 75 aa, Homo sapiens
MAPKKPEPKKEAAKPAPAPAPAPAPAPAPAPEAPKEPAFDPKSVKIDFTADQIEEFKEAFSLFDRTPTGEMKITY

SEQ ID NO: 5102 - protein, 150 aa, Homo sapiens
  UNSURE 144: Xaa= *  or Ala or Glu or Gly or Ile or Lys or Leu or Pro or Gln or Arg or Ser or Thr or Val
  UNSURE 150: Xaa=any one of the twenty amino acids
MAVAVRTLQEQLEKAKESLKNVDENIRKLTGRDPNDVRPIQARLLALSGPGGGRGRGSLLLRRGFSDSGGGPPAKQRDLEGAVSRLGGERRTRRESRQESDPEDDDVKKPALQSSVVATSKERTRRDLIQDQNMDEKGKQRNRXIFGLLX

SEQ ID NO: 5103 - protein, 69 aa, Homo sapiens
MNVQPCSRCGYGVYPAEKISCIDQIWHKACFHCEVCKMMLSVNNFVSHQKKPYCHAHNPKNNTFTSVYH

SEQ ID NO: 5104 - protein, 79 aa, Homo sapiens
MDSLYSSIYEIEKYNMKSYKVFISRKMDVLKATAEQISSQTGNKVHAIQCDVRDPDMVQNTVSELIKVAGHPNIVINNA

SEQ ID NO: 5105 - protein, 145 aa, Homo sapiens
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNA

SEQ ID NO: 5106 - protein, 53 aa, Homo sapiens
MDVLKATAEQISSQTGNKVHAIQCDVRDPDMVQNTVSELIKVAGHPNIVINNA

SEQ ID NO: 5107 - protein, 132 aa, Homo sapiens
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIG

SEQ ID NO: 5108 - protein, 130 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFG

SEQ ID NO: 5109 - protein, 114 aa, Homo sapiens
  UNSURE 85: Xaa=Asp or Gly
  UNSURE 97: Xaa=Ala or Asp or Glu or Gly or Val
  UNSURE 99: Xaa=Gly or Val
MLRPAGLWRLCRRPWAARVPAENLGRREVTSGVSPRGSTSPRTLNIFDRDLKRKQKNWAARQPEPTKFDYLKEEVGSRIADRVYXIPRNFPLALDLXVXRGYIAQYLNKETIGK

SEQ ID NO: 5110 - protein, 63 aa, Homo sapiens
MAQRTGLEDPERYLFVDRAVIYNPATQADWTAKKLVWIPSERHGFEAASIKEERGDEVMVELA

SEQ ID NO: 5111 - protein, 128 aa, Homo sapiens
  UNSURE 6: Xaa=Ala or Pro
MEGALXAPFRPSQGFLSRRLKSSIKRTKSQPKLDRTSSFRQILPRFRSADHDRARLMQSFKESHSHESLLSPSSAAEALELNLDEDSIIKPVHSSILGQEFCFEVTTSSGTKCFACRSAAERDKWIEN

SEQ ID NO: 5112 - protein, 69 aa, Homo sapiens
MSPESKKLFNIIILGVAFMFMFTAFQTCGNVAQTVIRSLNRTDFHGSGYTSMAIIYGVFSASNLITPSV

SEQ ID NO: 5113 - protein, 69 aa, Homo sapiens; identical to SEQ ID NO: 5112

SEQ ID NO: 5114 - protein, 140 aa, Homo sapiens
MDKRKLGRRPSSSEIITEGKRKKSSSDLSEIRKMLNAKPEDVHVQSPLSKFRSSERWTLPLQWERSLRNKVISLDHKNKKHIRGCPVTSKSSPERQLKVMLTNVLWTDLGRKFRKTLPRNDANLCDANKVQSDSLPSTSV

SEQ ID NO: 5115 - protein, 98 aa, Homo sapiens
MVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKG

SEQ ID NO: 5116 - protein, 132 aa, Homo sapiens
MSTVHEILCKLSLEGDHSTPPSAYGSVKAYTNFDAERDALNIETAIKTKGVDEVTIVNILTNRSNAQRQDIAFAYQRRTKKELASALKSALSGHLETVILGLLKTPAQYDASELKASMKGLGTDEDSLIEII

SEQ ID NO: 5117 - protein, 74 aa, Homo sapiens
MGIMNSFVNDIFERIAGEASRLAHYNKALDHHLQGDPDGRAPAASRGAGQARCVRGHQGRYQVHQLQVNLSLQL

SEQ ID NO: 5118 - protein, 74 aa, Homo sapiens
  UNSURE 30: Xaa=Asp or His
  UNSURE 33: Xaa=Ile or Leu
  UNSURE 34: Xaa=Pro or Gln
  UNSURE 35: Xaa=Gly or Arg
  UNSURE 45: Xaa=Ala or Ser
  UNSURE 47: Xaa=Gly or Arg
  UNSURE 53: Xaa=Cys or Arg
  UNSURE 61: Xaa=His or Tyr
MGIMNSFVNDIFERIAGEASRLAHYNKALXHHXXXDPDGRAPAAXRXAGQARXVRGHQGRXQVHQLQVNLSLQL

SEQ ID NO: 5119 - protein, 74 aa, Homo sapiens; identical to SEQ ID NO: 5117

SEQ ID NO: 5120 - protein, 74 aa, Homo sapiens
  UNSURE 29: Xaa=Phe or Leu
  UNSURE 39: Xaa=Gly or Ser
  UNSURE 45: Xaa=Ala or Ser
  UNSURE 46: Xaa=Arg or Trp
  UNSURE 48: Xaa=Ala or Thr
  UNSURE 53: Xaa=Cys or Arg
  UNSURE 58: Xaa= *  or Gln
MGIMNSFVNDIFERIAGEASRLAHYNKAXDHHLQGDPDXRAPAAXXGXGQARXVRGHXGRYQVHQLQVNLSLQL

SEQ ID NO: 5121 - protein, 74 aa, Homo sapiens
  UNSURE 8: Xaa=Leu or Val
MGIMNSFXNDIFERIAGEASRLAHYNKALDHHLQGDPDGRAPAASRGAGQARCVRGHQGRYQVHQLQVNLSLQL

SEQ ID NO: 5122 - protein, 92 aa, Homo sapiens
  UNSURE 84: Xaa=His or Gln
  UNSURE 85: Xaa=Asp or Tyr
MAFQYVWLSLEQLPYLTSSRLYPALPCFASPSPPDSISAAHGTSGRCQTTRQDSLQGEGLSLEFPDMTKKASYQKKHNCLRLPXXLLQKRRR

SEQ ID NO: 5123 - protein, 93 aa, Homo sapiens
MDIAIHHPWIRRPFFPFHSPSRLFDQFFGEHLLESDLFPTSTSLSPFYLRPPSFLRAPSWFDTGLSEVSLPTARTGESLLEPPGNFSIHFPFL

SEQ ID NO: 5124 - protein, 93 aa, Homo sapiens; identical to SEQ ID NO: 5123

SEQ ID NO: 5125 - protein, 168 aa, Homo sapiens
  UNSURE 16: Xaa=Asp or Glu
  UNSURE 38: Xaa=His or Gln
  UNSURE 39: Xaa=Ala or Ser
  UNSURE 53: Xaa=Glu or Gln
  UNSURE 60: Xaa=Glu or Gly
MTSAFKLDFLPDMMVXGRLLVPDRINGTANKMNGALDXXDQPDPDAIKMFVGXIPRSWSXKELTSQLTPHTHLATMDIAIHHPWIRRPFFPFHSPSRLFDQFFGEHLLESDLFPTSTSLSPFYLRPPSFLRAPSWFDTGLSEVSLPTARTGESLLEPPGNFSIHFPFL

SEQ ID NO: 5126 - protein, 93 aa, Homo sapiens; identical to SEQ ID NO: 5123

SEQ ID NO: 5127 - protein, 75 aa, Homo sapiens
  UNSURE 9: Xaa=Asp or Tyr
MNGALDHSXQPDPDAIKMFVGQIPRSWSEKELKELFEPYGAVYQINVLRDRSQNPPQSKGCCFVTFYTRKAALEA

SEQ ID NO: 5128 - protein, 93 aa, Homo sapiens; identical to SEQ ID NO: 5123

SEQ ID NO: 5129 - protein, 88 aa, Homo sapiens
  UNSURE 10: Xaa=Phe or Leu
  UNSURE 32: Xaa=Leu or Val
MDIAIHHPFXPFHSPSRLFDQFFGEHLLESDXFPTSTSLSPFYLRPPSFLRAPSWFDTGLSEVSLPTARTGESLLEPPGNFSIHFPFL

SEQ ID NO: 5130 - protein, 121 aa, Homo sapiens
  UNSURE 113: Xaa=Asp or His or Asn or Tyr
MAATTGSGVKVPRNFRLLEELEEGQKGVGDGTVSWGLEDDEDMTLTRWTGMIIGPPRTIYENRIYSLKIECGPKYPEAPPFVRFVTKINMNGVNSSNGVVDPRAISVLAKWQXSYSIKVVL

SEQ ID NO: 5131 - protein, 125 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRL

SEQ ID NO: 5132 - protein, 132 aa, Homo sapiens
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQEAINCLNAAIDIYTDMGRFTIAAKHHITMQRSMR

SEQ ID NO: 5133 - protein, 78 aa, Homo sapiens
MYTRAANMFKMAKNWSAAGNAFCQAAKLHMQLQSKHDSATSFVDAGNAYKKADPQEAINCLNAAIDIYTDMGRFTIAA

SEQ ID NO: 5134 - protein, 84 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQG

SEQ ID NO: 5135 - protein, 66 aa, Homo sapiens
MSVPSALMKQPPIQSTAGAVPVRNEKGEISMEKVKVKRYVSGKRPDYAPMESSDEEDEEFQFIKKA

SEQ ID NO: 5136 - protein, 157 aa, Homo sapiens
MASPSLERPEKGAGKSEFRNQKPKPENQDESELLTVPDGWKEPAFSKEDNPRGLLEESSFATLFPKYREAYLKECWPLVQKALNEHHVNATLDLIEGSMTVCTTKKTFDPYIIIRARDLIKLLARSVSFEQAVQILQDDVACDIIKIGSLVGIKRDL

SEQ ID NO: 5137 - protein, 102 aa, Homo sapiens
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRER

SEQ ID NO: 5138 - protein, 111 aa, Homo sapiens
  UNSURE 95: Xaa=Cys or Gly or Arg or Ser
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGXLGPLNIPLLADVTRRL

SEQ ID NO: 5139 - protein, 54 aa, Homo sapiens
  UNSURE 41: Xaa=Asp or His or Asn or Tyr
  UNSURE 45: Xaa= *  or Trp
  UNSURE 46: Xaa=Ala or Pro or Ser or Thr
MDLNRIIQALRHHRPEVADCSRERAQPVLQDYQFCPQFTSXYSLXXCGFQYDRQ

SEQ ID NO: 5140 - protein, 132 aa, Homo sapiens
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDI

SEQ ID NO: 5141 - protein, 62 aa, Homo sapiens
  UNSURE 19: Xaa=Ala or Asp
  UNSURE 57: Xaa=Ala or Glu
MTATLRPYLSAVRATLQAXLCLENFSSQVVERHNKPEVEVRSSKELLLQPVTISRNXKEKVL

SEQ ID NO: 5142 - protein, 83 aa, Homo sapiens
  UNSURE 43: Xaa=Ile or Met
  UNSURE 76: Xaa= *  or Cys or Trp
  UNSURE 80: Xaa=Ile or Lys or Met or Asn or Arg or Ser or Thr
  UNSURE 81: Xaa=Phe or Ile
  UNSURE 83: Xaa=Ile or Lys or Met or Asn or Arg or Ser or Thr
MAKSKNHTTHNQSRKWHRNGIKKPRSQRYESLKGVDPKFLRNXRFAKKHNKKGLKKMQANNAKSKNHTTHNQSRKXHRNXXKX

SEQ ID NO: 5143 - protein, 130 aa, Homo sapiens
MAKSKNHTTHNQSRKWHRNGIKKPRSQRYESLKGVDPKFLRNMRFAKKHNKKGLKKMQANNAKAMSARAEAIKALVKPKEVKPKIPKGVSRKLDRLAYIAHPKLGKRARARIAKGLRLCRPKAKAKAKAK

SEQ ID NO: 5144 - protein, 75 aa, Homo sapiens
  UNSURE 68: Xaa= *  or Gly
MQAARPREAAAASSERKPGCPTLLGVLQGWGWRLQSPQPCSPGQSPLQNPQRSVHKSGKRGQPPKCWXTSYAACV

SEQ ID NO: 5145 - protein, 126 aa, Homo sapiens
MFRRPVLQVLRQFVRHESETTTSLVLERSLNRVHLLGRVGQDPVLRQVEGKNPVTIFSLATNEMWRSGDSEVYQLGDVSQKTTWHRISVFRPGLRDVAYQYVKKGSRIYLEGKIDYGEYMDKNNVR

SEQ ID NO: 5146 - protein, 70 aa, Homo sapiens
MRPLDIDEVEAPEEVEVLEPEEDFEQFLLPVINEMREDIASLIREHGRAYLRTRSKLWEMDNMLIQIKTQ

SEQ ID NO: 5147 - protein, 72 aa, Homo sapiens
  UNSURE 69: Xaa=Gly or Leu or Arg or Val
MRPLDIVELAEPEEVEVLEPEEDFEQFLLPVINEMREDIASLTREHGRAYLRNRSKQWEEMRPLDIVEXAET

SEQ ID NO: 5148 - protein, 76 aa, Homo sapiens
MRPLDIVELAEPEEVEVLEPEEDFEQFLLPVINEMREDIASLTREHGRAYLRNRSKLWEMDNMLIQIKTQVEASKE

SEQ ID NO: 5149 - protein, 71 aa, Homo sapiens
  UNSURE 45: Xaa=Asp or Glu
MRPLDIVELAEPEEVEVLEPEEDFEQFLLPVINEMREDIASLTRXHGRAYLRNRSKLWEMDNMLIQIKTQV

SEQ ID NO: 5150 - protein, 132 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGGSFGDLRGLCSRSYQSWRGLVGHLAPLQTRNSPLCLINQH

SEQ ID NO: 5151 - protein, 128 aa, Homo sapiens
  UNSURE 13: Xaa=Asn or Ser
MEVKGKKQFTGKXTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSD

SEQ ID NO: 5152 - protein, 96 aa, Homo sapiens
  UNSURE 93: Xaa=Met or Val
MADSSGQQGKGRRVQPQWSPPAGTQPCRLHLYNSLTRNKEVFIPQDGKKVTWYCCGPTVYDASHMGHARSYISFDILRRVLKDYFKFDVFYCXNIT

SEQ ID NO: 5153 - protein, 61 aa, Homo sapiens
  UNSURE 17: Xaa= *  or Glu or Lys or Leu or Met or Gln or Val
  UNSURE 28: Xaa= *  or Ala or Glu or Gly or Ile or Lys or Leu or Pro or Gln or Arg or Ser or Thr or Val
  UNSURE 29: Xaa=Ile or Asn or Ser or Thr
  UNSURE 30: Xaa= *  or Leu or Ser
MKDSAPELNVSSSETEXDKEEAKPDGEXXXDFNQSNGGTKRQKISHQNYIAYQSKLFAEVC

SEQ ID NO: 5154 - protein, 106 aa, Homo sapiens
MCRLWFECSKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITG

SEQ ID NO: 5155 - protein, 216 aa, Homo sapiens
MPSKESWSGRKTNRAAVHKSKQEGRQQDLLIAALGMKLGSPKSSVTIWQPLKLFAYSQLTSLVRRATLKENEQIPKYEKIHNFKVHTFRGPHWCEYCANFMWGLIAQGVKCADCGLNVHKQCSKMVPNDCKPDLKHVKKVYSCDLTTLVKAHTTKRPMVVDMCIREIESRGLNSEGLYRVSGFSDLIEDVKMAFDRDGEKADISVNMYEDINIITG

SEQ ID NO: 5156 - protein, 122 aa, Homo sapiens
MCVPRSGLILSCICLYCGVLLPVLLPNLPFLTCLSMSTLESVTYLPEKGLYCQRLPSSRTHGGTESLKGKNTENMGFYGTLKMIFYKMKRKLDHGSEVRSFSLGKKPCKVSEYTSTTGLVPC

SEQ ID NO: 5157 - protein, 74 aa, Homo sapiens
MAPSTPLLTVRGSEGLYMVNGPPHFTESTVFPRESGKNCKVCIFSKDGTLFAWGNGEKVNIISVTNKGLLHSFD

SEQ ID NO: 5158 - protein, 56 aa, Homo sapiens
MGKCRGLRTARKLRSHRRDQKWHDKQYKKAHLGTALKANPFGGASHAKGLAIASHP

SEQ ID NO: 5159 - protein, 99 aa, Homo sapiens
MVQLQGGRFLMGTNSPDSRDGEGPVREATVKPFAIDIFPVTNKDFRDFVREKKYRTEAEMFGWSFVFEDFVSDELRNKATQPMKVKFTHGGTGSSQTAP

SEQ ID NO: 5160 - protein, 140 aa, Homo sapiens
MPGVTVKDVNQQEFVRALAAFLKKSGKLKVPEWVDTVKLAKHKELAPYDENWFYTRAASTARHLYLRGGAGVGSMTKIYGGRQRNGVMPSHFSRGSKSVARRVLQALEGLKMVEKDQDGGRKLTPQGQRDLDRIAGQWQL

SEQ ID NO: 5161 - protein, 109 aa, Homo sapiens
MAGALVRKAADYVRSKDFRDYLMSTHFWGPVANWGLPIAAINDMKKSPEIISGRMTFALCCYSLTFMRFAYKVQPRNWLLFACHATNEVAQLIQGGRLIKHEMTKTASA

SEQ ID NO: 5162 - protein, 110 aa, Homo sapiens
  UNSURE 96: Xaa=Phe or Leu
  UNSURE 97: Xaa=Cys or Arg
  UNSURE 101: Xaa=His or Gln
  UNSURE 102: Xaa=Asp or His or Asn or Tyr
  UNSURE 105: Xaa=Ala or Asp or Gly or Ile or Asn or Ser or Thr or Val
  UNSURE 110: Xaa=Ala or Cys or Asp or Phe or Gly or Ser or Val or Tyr
MVEYSLSKGKGNKVSAEKVNKTHSVNGITEEADPTIYSGKVIRPLRSVDPTQTEYQGMIEIVEEGDMKGEVYPFGIVGMANKGDCLQKGESVKFQXXVLGXXRWXYGLHX

SEQ ID NO: 5163 - protein, 107 aa, Homo sapiens
MAAQYGSMSFNPSTPGASYGPGRQEPRNSQLRIVLVGKTGAGKSATGNSILGRKVFHSGTAAKSITKKCEKRSSSWKETELVVVDTPGIFDTEVPNAETSKEIIRCI

SEQ ID NO: 5164 - protein, 108 aa, Homo sapiens
MSGLAATTFHWKKCRLDLPGHVALQACKRLPDEHNDVQKKTFTKWINARFSKSGKPPINDMFTDLKDGRKLLDLLEGLTGTSLPKERGSTRVHALNNVNRVLQVLHQN

SEQ ID NO: 5165 - protein, 66 aa, Homo sapiens
  UNSURE 27: Xaa=Ala or Pro or Ser or Thr
  UNSURE 58: Xaa=Arg or Thr
MSDEFSLADALPEHSPAKTSAVSNTKXGQPPQGWPGSNPWNNPSAPSSVPSGLPPSAXPSTVPFGP

SEQ ID NO: 5166 - protein, 121 aa, Homo sapiens
  UNSURE 92: Xaa= *  or Lys
  UNSURE 104: Xaa=Phe or Ile
  UNSURE 108: Xaa=Asp or Val
  UNSURE 113: Xaa=Phe or Leu
MQSNKTFNLEKQNHTPRKHHQHHHQQQHHQQQQQQPPPPPIPANGQQASSQNEGLTIDLKNFRKPGEKTFTQRSRLFVGNLPPDITEEEMRXLFEKYGKAGEVXIHKXKGFGXIRLETRTL

SEQ ID NO: 5167 - protein, 121 aa, Homo sapiens
  UNSURE 38: Xaa=Ala or Pro
  UNSURE 39: Xaa=Pro or Thr
  UNSURE 92: Xaa= *  or Lys
  UNSURE 104: Xaa=Phe or Ile
  UNSURE 108: Xaa=Asp or Val
  UNSURE 113: Xaa=Phe or Leu
MQSNKTFNLEKQNHTPRKHHQHHHQQQHHQQQQQQPPXXPIPANGQQASSQNEGLTIDLKNFRKPGEKTFTQRSRLFVGNLPPDITEEEMRXLFEKYGKAGEVXIHKXKGFGXIRLETRTL

SEQ ID NO: 5168 - protein, 121 aa, Homo sapiens; identical to SEQ ID NO: 5166
  UNSURE 92: Xaa= *  or Lys
  UNSURE 104: Xaa=Phe or Ile
  UNSURE 108: Xaa=Asp or Val
  UNSURE 113: Xaa=Phe or Leu

SEQ ID NO: 5169 - protein, 121 aa, Homo sapiens; identical to SEQ ID NO: 5166
  UNSURE 92: Xaa= *  or Lys
  UNSURE 104: Xaa=Phe or Ile
  UNSURE 108: Xaa=Asp or Val
  UNSURE 113: Xaa=Phe or Leu

SEQ ID NO: 5170 - protein, 121 aa, Homo sapiens; identical to SEQ ID NO: 5166
  UNSURE 92: Xaa= *  or Lys
  UNSURE 104: Xaa=Phe or Ile
  UNSURE 108: Xaa=Asp or Val
  UNSURE 113: Xaa=Phe or Leu

SEQ ID NO: 5171 - protein, 231 aa, Homo sapiens
  UNSURE 22: Xaa=Leu or Met or Val
MAGNIIPAIATTNAVIAGLIVXEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERS

SEQ ID NO: 5172 - protein, 59 aa, Homo sapiens
  UNSURE 41: Xaa=Asp or Glu
  UNSURE 45: Xaa=His or Asn
  UNSURE 57: Xaa=Cys or Ser
MKIFCSRANPTTGSVEWLEEDEHYDYHQEIARSSYADMLHXKDRXVKYYQGIRAAVXRE

SEQ ID NO: 5173 - protein, 99 aa, Homo sapiens
MDMGNQHPSISRLQEIQKEVKSVEQQVIGFSGLSDDKNYKKLERILTKQLFEIDSVDTEGKGDIQQARKRAAQETERLLKELEQNANHPHRIEIQNIFE

SEQ ID NO: 5174 - protein, 67 aa, Homo sapiens
  UNSURE 57: Xaa=Asp or Asn
MMTKHKKCFIIVGVLITTNIITLIVKLTRDSQSLCPYDWIGFQNKCYYFSKEEGDWXSSKYNCSTQH

SEQ ID NO: 5175 - protein, 118 aa, Homo sapiens
  UNSURE 110: Xaa=Ile or Met
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQXDKLIKTAV

SEQ ID NO: 5176 - protein, 74 aa, Homo sapiens
  UNSURE 23: Xaa=Arg or Ser
MSEETRQSKLAAAKKKLREYQQXNSPGVPTGAKKKKKIKNGSNPETTTSGGCHSPEDVSLGWPGSWGQGAQGAV

SEQ ID NO: 5177 - protein, 117 aa, Homo sapiens
  UNSURE 58: Xaa=Ile or Asn or Ser or Thr
MATGQKLMRAVRVFEFGGPEVLKLRSDIAVPIPKDHQVLIKVHACGVNPVETYIRSGXYSRKPLLPYTPGSDVAGVIEAVGDNASAFKKGDRVFTSSTISGGYAEYALAADHTVYKL

SEQ ID NO: 5178 - protein, 78 aa, Homo sapiens
MVQKKLEELQSMKQHLLFQQEEERQAQFMMRQETLAQQQLQLEQIQQLQQQLHQQLEEQKIRQIYQYNYDPSGTASPQ

SEQ ID NO: 5179 - protein, 51 aa, Homo sapiens
METVQLRNPPRRQLKKLDEDSLTKQPEEVFDVLEKLGEGSYGSVYKAIHKE

SEQ ID NO: 5180 - protein, 83 aa, Homo sapiens
MWSEGRYEYERIPRERAPPRSHPSDGYNRLVNIVPKKPPLLDRPGEGSYNRYYSHVITETMTRAAVFLMIEEVVHLTEEMNLV

SEQ ID NO: 5181 - protein, 147 aa, Homo sapiens
MPSKGPLQSVQVFGRKKTATAVAHCKRGNGLIKVNGRPLEMIEPRTLQYKLLEPVLLLGKERFAGVDIRVRVKGGGHVAQIYAIRQSISKALVAYYQKYVDEASKKEIKDILIQYDRTLLVADPRRCESKKFGGLVPALATRNPTDK

SEQ ID NO: 5182 - protein, 113 aa, Homo sapiens
MACAAARSPADQDRFICIYPAYLNNKKTIAEGRRIPISKAVENPTATEIQDVCSAVGLNVFLEKNKMYSREWNRDVQYRGRVRVQLKQEDGSLCLVQFPSRKSVMLYAAEMIP

SEQ ID NO: 5183 - protein, 108 aa, Homo sapiens
  UNSURE 100: Xaa=Glu or Val
MRGDRGRGRGGRFGSRGGPGGGFRPFVPHIPFDFYLCEMAFPRVKPAPDETSFSEALLKRNQDLAPNSAEQASILSLVTKINNVIDNLIVAPGTFEVQIXEVRQVGPI

SEQ ID NO: 5184 - protein, 96 aa, Homo sapiens
MANLDKYTETFKMGSNSTSTAEIYCNVTNVKFQYSLYATTYILIFIPGLLANSAALWVLCRFISKKNKAIIFMINLSVADLAHVLSLPLRIYYYIS

SEQ ID NO: 5185 - protein, 69 aa, Homo sapiens
MGNFRGHALPGTFFFIIGLWWCTKSILKYICKKQKRTCYLGSKTLFYRLEILEGITIVGMALTGMAGEQ

SEQ ID NO: 5186 - protein, 140 aa, Homo sapiens
  UNSURE 22: Xaa=Ala or Asp or Gly or Val
  UNSURE 134: Xaa=Glu or Gly or Gln or Arg
  UNSURE 136: Xaa= *  or Lys
MSGESARSLGKGSAPPGPVPEXSIRIYSMRFCPFAERTRLVLKAKGIRHEVININLKNKPEWFFKKNPFGLVPVLENSQGQLIYESAITCEYLDEAYPGKKLLPDDPYEKACQKMILELFSKVPSLVGSFIRSXNXEDYD

SEQ ID NO: 5187 - protein, 73 aa, Homo sapiens
MTLKISSTTITLEGRRRTFHVWRACECTRWKERLEHPGIITPIVLLMEISKDGSILLVGVQVCGTVPRGLTHT

SEQ ID NO: 5188 - protein, 68 aa, Homo sapiens
  UNSURE 62: Xaa=Ala or Asp or Glu or Gly or Ile or Lys or Met or Asn or Arg or Ser or Thr or Val
MKKISLKTLRKSFNLNKSKEETDFMVVQQPSLASDFGKDDSLFGSCYGKDMASCDINGEDEXGGKNRS

SEQ ID NO: 5189 - protein, 104 aa, Homo sapiens
MNEEEQFVNIDLNDDNICSVCKLGTDKETLSFCHICFELNIEGVPKSDLLHTKSLRGHKDCFEKYHLIANQGCPRSKLSKSTYEEVKTILSKKINWIVQYAQNK

SEQ ID NO: 5190 - protein, 74 aa, Homo sapiens
MSSLSEYAFRMSRLSARLFGEVTRPTNSKSMKVVKLFSELPLAKKKETYDWYPNHHTYAELMQTLRFLGLYRDE

SEQ ID NO: 5191 - protein, 83 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQK

SEQ ID NO: 5192 - protein, 73 aa, Homo sapiens
MAGILRLVVQWPPGRLQTVTKGVESLICTDWIRHKFTRSRIPEKVFQASPEDHEKYGGDPQNPHKLHIVTRIK

SEQ ID NO: 5193 - protein, 65 aa, Homo sapiens
MPESLLGWFEPVVCTLRMKNTRHLSLHPIKSYLGLLIELRASHRSPDSFFSRCHFNRFCNPSDTS

SEQ ID NO: 5194 - protein, 110 aa, Homo sapiens
MLSACNLLKNTINDPKALTSKDMRFCLNTLQHEWFRVSSQKSAIPAMVGDYIAAFEAISPDVLRYVINLADGNGNTALHYSVSHSNFEIVKLLLDADVCNVDHQNKAGYT

SEQ ID NO: 5195 - protein, 121 aa, Homo sapiens
  UNSURE 117: Xaa= *  or Ala or Glu or Gly or Lys or Leu or Met or Pro or Gln or Arg or Ser or Thr or Val or Trp
MATRNPPPQDYESDDDSYEVLDLTEYARRHQWWNRVFGHSSGPMVEKYSVATQIVMGGVTGWCAGFLFQKVGKLAATAVGGGFLLLQIASHSGYVQIDWKRVEKDVNKAKRQIKKRXNKAA

SEQ ID NO: 5196 - protein, 68 aa, Homo sapiens
  UNSURE 51: Xaa= *  or Cys or Phe or Leu or Ser or Trp or Tyr
  UNSURE 53: Xaa=Leu or Met or Val
MAANSSGQGFQNKNRVAILAELTKRKENYLCRTSLQQIILELGIDTIMWVXCXFCFVLFCFETESRPV

SEQ ID NO: 5197 - protein, 69 aa, Homo sapiens
MHDFYRCHTCNTTDRNAICVNCIKKCHQGHDVEFIRHDRFFCDCGAGTLSNPCTLAGEPTHDTDTLYDS

SEQ ID NO: 5198 - protein, 138 aa, Homo sapiens
MWSLGCITAELYTGYPLFPGENEVEQLACIMEVLGLPPAGFIQTASRRQTFFDSKGFPKNITNNRGKKRYPDSKDLTMVLKTYDTSFLDFLRRCLVWEPSLRMTPDQALKHAWIHQSRNLKPQPRPQTLRKSNSFFPS

SEQ ID NO: 5199 - protein, 67 aa, Homo sapiens
MLISVTNLGCTVLLYVSFVEIFKNISITFPLKSGESLLDDWPGTFSLNRTFGCLLSSKKWWFTLKYH

SEQ ID NO: 5200 - protein, 62 aa, Homo sapiens
  UNSURE 50: Xaa=His or Arg
MVLGKVKSLTISFDCLNDSNVPVYSSGDTVSGRVNLEVTGEIRVKSLKIXARGHAKVRWTES

SEQ ID NO: 5201 - protein, 70 aa, Homo sapiens
MQVTCWLQRWSRWMGIIAGSKALEYSNGIFDCQSPTSPFMGSLRALHLVEDLRGLLEMMETDEKEGLRCQ

SEQ ID NO: 5202 - protein, 60 aa, Homo sapiens
MGLGHEQGFGAPCLKCKEKCEGFELHFWRKICRNCKCGQEEHDVLLSNEEDRKVGKLFED

SEQ ID NO: 5203 - protein, 82 aa, Homo sapiens
  UNSURE 33: Xaa=Asn or Thr
  UNSURE 60: Xaa=Cys or Trp
MREIAEILPAQEKVEARIDLKMGKKRVTDHKLXVDKVIKNINTISSELKKIKELSQLLLXDLILHFNHPIKTENLAEAERNN

SEQ ID NO: 5204 - protein, 142 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEH

SEQ ID NO: 5205 - protein, 102 aa, Homo sapiens
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAK

SEQ ID NO: 5206 - protein, 93 aa, Homo sapiens
MGEKSENCGVPEDLLNGLKVTDTQEAECAGPPVPDPKNQHSQSKLLRDDEAHLQEDQGEEECFHDCSASFEEEPGADKVENKSNEDVNSSELD

SEQ ID NO: 5207 - protein, 102 aa, Homo sapiens
  UNSURE 87: Xaa=Asn or Ser
MNKKKKPFLGMPAPLGYVPGLGRGATGFTTRSDIGPARDANDPVDDRHAPPGKRTVGDQMKKNQAADDDDEDLNDTNYDEFNGYAGXLFSSGPYEKDDEEAD

SEQ ID NO: 5208 - protein, 81 aa, Homo sapiens
  UNSURE 62: Xaa=Ala or Asp or Gly or Val
MQVGGNANATAFFRQHGCTANDANTKYNSRAAQMYREKIRQLGSAALARHGTDLWIDNMSSXVPNHSPEKKDSDFFTEHTQ

SEQ ID NO: 5209 - protein, 52 aa, Homo sapiens [sequence omitted]

SEQ ID NO: 5210 - protein, 65 aa, Homo sapiens
  UNSURE 47: Xaa=Ile or Asn or Ser or Thr
MDASEIWCRDSDRGSSLRRSIPCPPALCFVRKIHLRPLVLRPTSPRXISPILNPFLSFPGRDEGD

SEQ ID NO: 5211 - protein, 80 aa, Homo sapiens
MSGIGNKRAAGEPGTSMPPEKKAAVEDSGTTVETIKLGGVSSTEELDIRTLQTKNRKLAEMLDQRQAIEDELREHIEKLE

SEQ ID NO: 5212 - protein, 150 aa, Homo sapiens
MLLELSEEHKEHLAFLPQVDSAVVAEFGRIAVEFLRRGANPKIYEGAARKLNVSSDTVQHGVEGLTYLLTESSKLMISELDFQDSVFVLGFSEELNKLLLQLYLDNRKEIRTILSELAPSLPSYHNLEWRLDVQNNKKVMELDALPVLHF

SEQ ID NO: 5213 - protein, 58 aa, Homo sapiens
  UNSURE 42: Xaa=Leu or Met or Pro or Thr
MAGQAFRKFLPLFDRVLVERSAAETVTKGGIMLPENGDTPWXREIQISPSPKPHASLP

SEQ ID NO: 5214 - protein, 133 aa, Homo sapiens
  UNSURE 133: Xaa=Cys or Phe or Ser or Tyr
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTX

SEQ ID NO: 5215 - protein, 120 aa, Homo sapiens
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDI

SEQ ID NO: 5216 - protein, 211 aa, Homo sapiens
  UNSURE 102: Xaa=Ile or Val
  UNSURE 147: Xaa=Ser or Thr
MTTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYXIFGTVIQEVKTSNVAREAALGAGFSDKTPAHTVTMACISANQAMXTGVGLIASGQCDVIVAGGVELMSDVPIRHSRKMRKLMLDLNKAKSMGQRLSLISKFRFKCLAPE

SEQ ID NO: 5217 - protein, 55 aa, Homo sapiens
MGQGHIPFPRAPIGCPPCPGVWGPGSGAERAHSGLGDAVCPHRSAPGAGLADSTA

SEQ ID NO: 5218 - protein, 101 aa, Homo sapiens
  UNSURE 77: Xaa=Ala or Pro or Ser or Thr
  UNSURE 100: Xaa=Lys or Gln
MSLKMDNRDVAGKANRWFGVAPPKSGKMNMNILHQEELIAQKKREIEAKMEQKAKQNQVASPQPPHPGEITNAHNSXCISNKFANDGSFLQQFLKLQKAXT

SEQ ID NO: 5219 - protein, 92 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEE

SEQ ID NO: 5220 - protein, 92 aa, Homo sapiens
MVHQDNCSYQAQKNERESIRQKLALGSFFDDGPGIYTSCSKSGKPSLSSRLQSGMNLQICFVNDSGSDKDSDADDSKTETSLDTPLSPMSKQ

SEQ ID NO: 5221 - protein, 100 aa, Homo sapiens
MSDTAVADTRRLNSKPQDLTDAYGPPSNFLEIDIFNPQTVGVGRARFTTYEVRMRTNLPIFKLKESCVRRRYSDFEWLKNELERDSKIVVPPLPGKALKR

SEQ ID NO: 5222 - protein, 105 aa, Homo sapiens
  UNSURE 89: Xaa= *  or Lys
  UNSURE 93: Xaa=Asp or Glu
  UNSURE 96: Xaa=Leu or Arg
MTDQQAEARSYLSEEMIAEFKAAFDMFDADGGGDISVKELGTVMRMLGQTPTKEELDAIIEEVDEDGSGTIDFEEFLVMMVRQMKEDAXGKSXEEXGVQEKNREG

SEQ ID NO: 5223 - protein, 90 aa, Homo sapiens
MSAEASARPLRVGSRVEVIGKGHRGTVAYVGATLFATGKWVGVILDEAKGKNDGTVQGRKYFTCDEGHGIFVRQSQIQVFEDGADTTPQR

SEQ ID NO: 5224 - protein, 116 aa, Homo sapiens
  UNSURE 74: Xaa=Ile or Lys or Met or Asn
MKIELSMQPWNPGYSSEGATAQETYTCPKMIEMEQAEAQLAELDLLASMFPGENELIVNDQLAVAELKDCIEKXTMEGRSSKVYFTINMNLDVSDEKMTQKIKLEENFNSPSRRHS

SEQ ID NO: 5225 - protein, 93 aa, Homo sapiens
  UNSURE 72: Xaa=Asp or Glu
MAHFSSEDQAMLQAMLRRLFQSVKEKITGAPSLECAEEILLHLEETDENFHNYEFVKYLRQHIGNTLGSMIXEEMEKCTSDRNQGEECGYDTV

SEQ ID NO: 5226 - protein, 133 aa, Homo sapiens
  UNSURE 44: Xaa=Ile or Ser
MDQQAIYAELNLPTDSGPESSSPSSLPRDVCQGSPWHQFALKLXCAGIILLVLVVTGLSVSVTSLIQKSSIEKCSVDIQQSRNKTTERPGLLNCPIYWQQLREKCLLFSHTVNPWNNSLADCSTKESSLLLIR

SEQ ID NO: 5227 - protein, 120 aa, Homo sapiens
MAAQKINEGLEHLAKAEKYLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALER

SEQ ID NO: 5228 - protein, 139 aa, Homo sapiens
MIKASMMKNQWMEIGHHQLHQPSRFLHLKHPEILPTVQGSLVQQVALRLERASKEGGAGAVDEDDFIKAFTDVPSIQIYSSRELEETLNKIREILSDDKHDWDQRANALKKIRSLLVAGAAQYDCFFQHLRLLDGALKL

SEQ ID NO: 5229 - protein, 94 aa, Homo sapiens
MKTLETQPLAPDCCPSDQDPAPAHPSPHASPMNKNADSELMPPPPERGDPPRLSPDPVAGSAVSQELREGDPVSLSTPLETEFGSPSELSPRIK

SEQ ID NO: 5230 - protein, 152 aa, Homo sapiens
  UNSURE 80: Xaa=Lys or Gln or Arg
MRPLTEEETRVMFEKIAKYIGENLQLLVDRPDGTYCFRLHNDRVYYVSEKIMKLAANISGDKLVSLGTCFGKFTKTHKFXLHVTALDYLAPYAKYKVWIKPGAEQSFLYGNHVLKSGLGRITENTSQYQGVVVYSMADIPLGFGVAAKSTQD

SEQ ID NO: 5231 - protein, 70 aa, Homo sapiens
  UNSURE 13: Xaa=Phe or Ile or Leu or Val
MITLNNQDQPVPXNSSHPDEYKIAALVFYSCIFIIGLFVNITALWVFSCTTKKRTTVTIYMMNVALVDLI

SEQ ID NO: 5232 - protein, 94 aa, Homo sapiens
MLSFFRRTLGRRSMRKHAEKERLREAQRAATHIPAAGDSKSIITCRVSLLDGTDVSVDLPKKAKGQELFDQIMYHLDLIESDYFGLRFMDSAQV

SEQ ID NO: 5233 - protein, 143 aa, Homo sapiens
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKLTNTPLISIETNTTGSSLH

SEQ ID NO: 5234 - protein, 143 aa, Homo sapiens; identical to SEQ ID NO: 5233

SEQ ID NO: 5235 - protein, 134 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQL

SEQ ID NO: 5236 - protein, 55 aa, Homo sapiens
MEFQAVVMAVGGGSRMTDLTSSIPKPLLPVGNKPLIWYPLNLLERVDLKKSLWLQ

SEQ ID NO: 5237 - protein, 122 aa, Homo sapiens
  UNSURE 120: Xaa=Leu or Met or Val
MDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAAXAG

SEQ ID NO: 5238 - protein, 115 aa, Homo sapiens
  UNSURE 75: Xaa=Ile or Met
MATNESVSIFSSASLAVEYVDSLLPENPLQEPFKNAWNYMLNNYTKFQIATWGSLIVHEALYFLFCLPGFLFQFXPYMKKYKIQKDKPETWENQWKCFKVLLFNHFCIQLPLICG

SEQ ID NO: 5239 - protein, 95 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTN

SEQ ID NO: 5240 - protein, 86 aa, Homo sapiens
MAAAAPDSRVSEEENLKKTPKKKMKMVTGAVASVLEDEATDTSDSEGSCGSEKDHFYSDDDAIEADSEGDAEPCDKENENDGESSV

SEQ ID NO: 5241 - protein, 82 aa, Homo sapiens
  UNSURE 60: Xaa=Ala or Asp or Glu or Gly or Val
  UNSURE 76: Xaa=Gly or Ser
MAESENRKELSESSQEEAGNQIMVEGLGEHLERGEDAAAGLGDDGKCGEEAAAGLGEEGXNGEDTAAGSGEDGKKXGDTDED

SEQ ID NO: 5242 - protein, 98 aa, Homo sapiens
  UNSURE 52: Xaa=Asn or Ser
MAASGLDHLKNGYRRRFCRPSRARDINTEQGQNVLEILQDCFEEKSLANDFXTNSTKSVPNSTRKIKDTCIQSPSKECRNHIQSQFQFLQRRKKLSTV

SEQ ID NO: 5243 - protein, 96 aa, Homo sapiens
MESDFYLRYYVGHKGKFGHEFLEFEFRPDGKLRYANNSNYKNDVMIRKEELEIVIGDEHISFTTSKIGSLIDVNQSKDPEGLRVFYYLVQDLKCLV

SEQ ID NO: 5244 - protein, 133 aa, Homo sapiens
MESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLV

SEQ ID NO: 5245 - protein, 109 aa, Homo sapiens
MMRFMLLFSRQGKLRLQKWYLATSDKERKKMVRELMQVVLARKPKMCSFLEWRDLKVVYKRYASLYFCCAIEGQDNELITLELIHRYVELLDKYFGSVCELDIIFNFEK

SEQ ID NO: 5246 - protein, 104 aa, Homo sapiens
  UNSURE 49: Xaa=Asp or Asn
MAARTAFGAVCRRLWQGLGNFSVNTSKGNTAKNGGLLLSTNMKWVQFSXLHVDVPKDLTKPVVTISDEPDILYKRLSVLVKGHDKAVLDSYEYFAVLAAKELGI

SEQ ID NO: 5247 - protein, 63 aa, Homo sapiens
MKWVQFSNLHVDVPKDLTKPVVTISDEPDILYKRLSVLVKGHDKAVLDSYEYFAVLAAKELGI

SEQ ID NO: 5248 - protein, 120 aa, Homo sapiens
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQSS

SEQ ID NO: 5249 - protein, 101 aa, Homo sapiens
MAKHHPDLIFCRKQAGVAIGRLCEKCDGKCVICDSYVRPCTLVRICDECNYGSYQGRCVICGGPGVSDAYYCKECTIQEKDRDGCPKIVNLGSSKTDLFYE

SEQ ID NO: 5250 - protein, 109 aa, Homo sapiens
MARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAK

SEQ ID NO: 5251 - protein, 51 aa, Homo sapiens
MGLDKMKKTACGFCFVEYYSRADAENAMRYINGTRLDDRIIRTDWDAGFKE

SEQ ID NO: 5252 - protein, 145 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSVND

SEQ ID NO: 5253 - protein, 123 aa, Homo sapiens
MPMTLGYWNIRGLAHSIRLLLEYTDSSYEEKKYTMGDAPDYDRSQWLNEKFKLGLDFPNLPYLIDGTHKITQSNAILRYIARKHNLCGESEKEQIREDILENQFMDSRMQLAKLCYDPDFVSP

SEQ ID NO: 5254 - protein, 123 aa, Homo sapiens
MSCESSMVLGYWDIRGLAHAIRLLLEFTDTSYEEKRYTCGEAPDYDRSQWLDVKFKLDLDFPNLPYLLDGKNKITQSNAILRYIARKHNMCGETEEEKIRVDIIENQVMDFRTQLIRLCYSSD

SEQ ID NO: 5255 - protein, 79 aa, Homo sapiens
MDEDVLTTLKILIIGESGVGKSSLLLRFTDDTFDPELAATIGVDFKVKTISVDGNKAKLAIWDTAGQERFRTLTPSYYR

SEQ ID NO: 5256 - protein, 64 aa, Homo sapiens
MDEDVLHPEEPHHRLLLRFTDDTFDPELAATIGEPVFKNSIEMSNIFLPLGFFYLNPSTFLLPR

SEQ ID NO: 5257 - protein, 166 aa, Homo sapiens
MAIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELP

SEQ ID NO: 5258 - protein, 52 aa, Homo sapiens
MAQSVLVPSGPDSFRFFTRESLAAIEQRIAEEKAKRPKQERKDEDDENGPKP

SEQ ID NO: 5259 - protein, 127 aa, Homo sapiens
MADLEEQLSDEEKVRIAAKFIIHAPPGEFNEVFNDVRLLLNNDNLLREGAAHAFAQYNLDQFTPVKIEGYEDQVLITEHGDLGNGKFLDPKNRICFKFDHLRKEATDPRPCEVENAVESWRTSVETA

SEQ ID NO: 5260 - protein, 77 aa, Homo sapiens
MRKIDLCLSSEGSEVILATSSDEKHPPENIIDGNPETFWTTTGMFPQEFIICFHKHVRIERLVIQSYFVQTLKIEKS

SEQ ID NO: 5261 - protein, 70 aa, Homo sapiens
  UNSURE 3: Xaa=Lys or Asn
MEXTENSVDSKSIKNLEPKIIHGSESMDSGISLDNSYKMDYPEMGLCIIINNKNFHKSTGMTSRSGTDVD

SEQ ID NO: 5262 - protein, 66 aa, Homo sapiens
MATAAYEQLKLHITPEKFYVEACDDGADDVLTIDRVSTEVTLAVKKDVPPSAVTRPIFGILGTIHL

SEQ ID NO: 5263 - protein, 88 aa, Homo sapiens
  UNSURE 36: Xaa=Arg or Ser
  UNSURE 37: Xaa=Ser or Tyr
MSSHKTFRIKRFLAKKQKQNRPIPQWIRMKTGNKIXXTEKFSKSPLDPGSPAVFTCHQLLGRLRQENRLNPGGGGCWEPSQDHATTLQ

SEQ ID NO: 5264 - protein, 70 aa, Homo sapiens
  UNSURE 44: Xaa=Pro or Ser
  UNSURE 49: Xaa= *  or Lys
  UNSURE 60: Xaa=Phe or Leu
MYTGHENKDWFSRHWFTLQPVFSVSPFPTSFPPPNPFFFLFCFXFLFFXFLFTLPSMPFXSCFSSQKTFQ

SEQ ID NO: 5265 - protein, 120 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYRGGKICLTDH

SEQ ID NO: 5266 - protein, 120 aa, Homo sapiens; identical to SEQ ID NO: 5265

SEQ ID NO: 5267 - protein, 94 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWT

SEQ ID NO: 5268 - protein, 221 aa, Homo sapiens
  UNSURE 128: Xaa=Phe or Leu
  UNSURE 130: Xaa=Ala or Thr
MADFDDRVSDEEKVRIAAKFITHAPPGEFNEVFNDVRLLLNNDNLLREGAAHAFAQYNMDQFTPVKIEGYEDQVLITEHGDLGNSRFLDPRNKISFKFDHLRKEASDPQPEEADGGLKSWRESCDSGXRXYVKDHYSNGFCTVYAKTIDGQQTIIACIESHQFQPKNFWNGRWRSEWKFTIIPPTAQVVGVLKIQVHYYEDGNVQLVSHKDVQDSLTVSNE

SEQ ID NO: 5269 - protein, 115 aa, Homo sapiens
  UNSURE 73: Xaa=Cys or Asp or Gly or His or Asn or Arg or Ser or Tyr
  UNSURE 74: Xaa=Ala or Pro or Ser or Thr
  UNSURE 92: Xaa= *  or Glu or Gly
  UNSURE 95: Xaa=Cys or Phe or Ile or Asn or Ser or Thr or Tyr
  UNSURE 96: Xaa=His or Gln
MTYAYLFKYIIIGDTGVGKSCLLLQFTDKRFQPVHDLTIGVEFGARMVNIDGKQIKLQIWDTAGQESFRSITXXYYRGAAGALLVYDITRRXTFXXLTSWLEDARQHSSSNMVIM

SEQ ID NO: 5270 - protein, 59 aa, Homo sapiens
  UNSURE 53: Xaa=Phe or Ile or Leu or Val
MFTIENNFVLKNKDSFSRVGPVPTYVLPANWTGTYTVVYLAPEINIAPNNQSXIILLTA

SEQ ID NO: 5271 - protein, 98 aa, Homo sapiens
MAAGESMAQRMVWVDLEMTGLDIEKDQIIEMACLITDSDLNILAEGPNLIIKQPDELLDSMSDWCKEHHGKSGLTKAVKESTITLQQAEYEFLSFVRQ

SEQ ID NO: 5272 - protein, 126 aa, Homo sapiens
  UNSURE 78: Xaa=Ile or Met
  UNSURE 79: Xaa=Asp or His or Asn or Tyr
MASSLNEDPEGSRITYVKGDLFACPKTDSLAHCISEDCRMGAGIAVLFKKKFGGVQELLNQQKKSGEVAVLKRDGRYXXYLITKKRASHKPTYENLQKSLEAMKSHCLKNGVTDLSMPRIGCGLDR

SEQ ID NO: 5273 - protein, 77 aa, Homo sapiens
  UNSURE 65: Xaa=Lys or Asn
  UNSURE 74: Xaa=Phe or Leu
MEPPKMNPVVEPLSWMLGTWLSDPPGAGTYPTLQPFQYLEEVHISHVGQPMLNFSFNSFHPDTRXRCTESVASXASS

SEQ ID NO: 5274 - protein, 90 aa, Homo sapiens
MSDVEENNFEGRESRSQSKSPTGTPARVKSESRSGSRSPSRVSKHSESHSRSRSNPGRGQGDILIDVTLDPDPTLTLIGDDLEVDHIHQN

SEQ ID NO: 5275 - protein, 148 aa, Homo sapiens
  UNSURE 25: Xaa=Ala or Gly
  UNSURE 142: Xaa=Asp or Asn
MRPPCPWREAEAADLRPEAPGRRDXKMSASLVRATVRAVSKRKLQPTRAALTLTPSAVNKIKQLLKDKPEHVGVKVGVRTRGCNGLSYTLEYTKTKGDSDEEVIQDGVRVFIEKKAQLTLLGTEMDYVEDKLSSEFVFNNPXIKGTCG

SEQ ID NO: 5276 - protein, 124 aa, Homo sapiens
MAPVEHVVADAGAFLRHAALQDIGKNIYTIREVVTEIRDKATRRRLAVLPYELRFKEPLPEYVRLVTEFSKKTGDYPSLSATDIQVLALTYQLEAEFVGVSHLKQEPQKVKVSSSIQHPETPLH

SEQ ID NO: 5277 - protein, 112 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYH

SEQ ID NO: 5278 - protein, 125 aa, Homo sapiens
MGKSNSKLKPEVVEELTRKTYFTEKEVQQWYKGFIKDCPSGQLDAAGFQKIYKQFFPFGDPTKFATFVFNVFDENKDGRIEFSEFIQALSVTSRGTWMRSYGGPSSSTTWTMMATSPGMRCWTLW

SEQ ID NO: 5279 - protein, 124 aa, Homo sapiens
  UNSURE 109: Xaa=Arg or Ser
  UNSURE 113: Xaa= *  or Cys or Phe or Leu or Ser or Trp or Tyr
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHEKQEXQDLXSYCKSSFSTRR

SEQ ID NO: 5280 - protein, 59 aa, Homo sapiens
  UNSURE 7: Xaa=Lys or Asn
  UNSURE 38: Xaa=Met or Val
MSSTSPXLQKAIDLASKAAQEDKAGNYEEALQLYQHAXQYFLHVVKYEAQGDKAKQSIR

SEQ ID NO: 5281 - protein, 123 aa, Homo sapiens
MKFRAKIVDGACLNHFTRISNMIAKLAKTCTLRISPDKLNFILCDKLANGGVSMWCELEQENFFNEFQMEGVSAENNEIYLELTSENLSRALKTAQNARALKIKLTNKHFPCLTVSVELLSMS

SEQ ID NO: 5282 - protein, 117 aa, Homo sapiens
MSKLWRRGSTSGAMEAPEPGEALELSLAGAHGHGVHKKKHKKHKKKHKKKHHQEEDAGPTQPSPAKPQLKLKIKLGGQVLGTKSVPTFTVIPEGPRSPSPLMVVDNEEEPMEGVPLE

SEQ ID NO: 5283 - protein, 70 aa, Homo sapiens
  UNSURE 63: Xaa= *  or Arg
MHWFRTWKLMEITVQQLMAHLDAIRKDMVILEKSEFANLRAENEKMKIELDQVKQQLMHETSXIRADNKL

SEQ ID NO: 5284 - protein, 67 aa, Homo sapiens
  UNSURE 8: Xaa=Glu or Gly
  UNSURE 60: Xaa= *  or Arg
MVTQAQQXITVQQLMAHLDAIRKDMVILEKSEFANLRAENEKMKIELDQVKQQLMHETSXIRADNKL

SEQ ID NO: 5285 - protein, 111 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDP

SEQ ID NO: 5286 - protein, 64 aa, Homo sapiens
  UNSURE 56: Xaa=Leu or Ser
MEIKDQGAQMEPLLPTRNDEEAVVDRGGTRSILKTHFEKEDLEGHRTLFIGVHVPXGGRKSHRR

SEQ ID NO: 5287 - protein, 51 aa, Homo sapiens
  UNSURE 40: Xaa=Ile or Met
MSDAKWARSNTGMLKHSWNLRREEGFSDHFHTSNNLGRIXNIYLSSDNTNR

SEQ ID NO: 5288 - protein, 65 aa, Homo sapiens
MGVKLEIFRMIIYLTFPVAMFWVSNQAEWFEDDVIQRKRELWPPEKVSDLFFLPEGWRRLDSCIR

SEQ ID NO: 5289 - protein, 127 aa, Homo sapiens
MATKAVCVLKGDGPVQGIINFEQKESNGPVKVWGSIKGLTEGLHGFHVHEFGDNTAGCTSAGPHFNPLSRKHGGPKDEERHVGDLGNVTADKDGVADVSIEDSVISLSGDHCIIGRTLVVHEKADDL

SEQ ID NO: 5290 - protein, 97 aa, Homo sapiens
MATKAVCVLKGDGPVQGIINFEQKESNGPVKVWGSIGGSRSLLVPELIGQPVQSFIEPVAAGGAGGLNVLHFFHITIDIRNVCVFLAPLFSSFTTIV

SEQ ID NO: 5291 - protein, 69 aa, Homo sapiens
MRECISIHVGRAGVRIGNACWELYCLAIRCPSGFKISAIITVFPPFDLPFGRVVLVAGALAAADDDIRR

SEQ ID NO: 5292 - protein, 80 aa, Homo sapiens
MRECISVHVGQAGVQMGNACWELYCLEHGIQPDGQMPSDKTIGGGDDSFTTFFCETGAGKHVPRAVFVDLEPTVIDEIRN

SEQ ID NO: 5293 - protein, 81 aa, Homo sapiens
  UNSURE 29: Xaa=Ala or Glu or Gly or Val
  UNSURE 74: Xaa=Leu or Val
MRECISIHVGQAGVQIGNACWELYCLEHXIQPDGQMPSDKTIGGGDDSFNTFFSETGAGKHVPRAVFVDLEPTXVDEVRTG

SEQ ID NO: 5294 - protein, 96 aa, Homo sapiens
  UNSURE 73: Xaa=Asp or Glu
MSLHQFLLEPITCHAWNRDRTQIALSPNNHEVHIYKKNGSQWVKAHELKEHNGHITGIDWAPKSDRIVTCGAXRNAYVWSQKDGVWKPTLVILRIN

SEQ ID NO: 5295 - protein, 53 aa, Homo sapiens
  UNSURE 50: Xaa=Asn or Ser
MTPVQSATIPLFMRNKDVAAEAVTGSGKTLAFVIPILEILLRREEKLKKXQVG

SEQ ID NO: 5296 - protein, 140 aa, Homo sapiens
  UNSURE 105: Xaa=Met or Val
MAHRFPALTQEQKKELSEIAQSIVANGKGILAADESVGTMGNRLQRIKVENTEENRRQFREILFSVDSSINQSIGGVILFHETLYQKDSQGKLFRNILKEKGIVXGIKLDQGGAPLAGTNKETTIQGLDGLSERCAQYKK

SEQ ID NO: 5297 - protein, 112 aa, Homo sapiens
  UNSURE 55: Xaa=Lys or Asn
MAKWGEGDPRWIVEERADATNVNNWHWTERDASNWSTDKLKTLFLAVQVQNEEGXCEVTEVSKLDGEASINNRKGKLIFFYEWSVKLNWTGTSKSGVQYKGHVEIPICLMKQ

SEQ ID NO: 5298 - protein, 82 aa, Homo sapiens
MAKWGEGDPRWIVEERADATNVNNWHWTERDASNWSTDKLKTLFLAVQVQNEEGIPKCWDYRQEPRPLALIIVLSVVVAFKN

SEQ ID NO: 5299 - protein, 129 aa, Homo sapiens
MASNVTNKTDPRSMNSRVFIGNLNTLVVKKSDVEAIFSKYGKIVGCSVHKGFAFVQYVNERNARAAVAGEDGRMIAGQVLDINLAAEPKVNRGKAGVKRSAAEMYGSVTEHPSPSPLLSSSFDLDYDFQ

SEQ ID NO: 5300 - protein, 129 aa, Homo sapiens; identical to SEQ ID NO: 5299

SEQ ID NO: 5301 - protein, 94 aa, Homo sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYT

SEQ ID NO: 5302 - protein, 71 aa, Homo sapiens
  UNSURE 25: Xaa=Phe or Ser
MDLYEDYQSPFDFDAGVNKSYLYLXPSGNSSPPGSPTLQKFGLLRTDPVPEEGEDVAATISATETLSEEEQ

SEQ ID NO: 5303 - protein, 55 aa, Homo sapiens
MTASHATGGSHLRRQGWVPGETHLQAKNSLKAERLDRWCRMKPRRRVRTSVPVCP

SEQ ID NO: 5304 - protein, 85 aa, Homo sapiens
  UNSURE 68: Xaa=Ala or Pro or Ser or Thr
MLQTSNYSLVLSLQFLLLSYDLFVNSFSELLQKTPVIQLVLFIIQDIAVLFNIIIIFLMFFNTFVFQXGLVNLLFHKFKGTIILT

SEQ ID NO: 5305 - protein, 140 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVP

SEQ ID NO: 5306 - protein, 76 aa, Homo sapiens
MGGEQEEERFDGMLLAMAQQHEGGVQELVNTFFSFLRRKTDFFIGGEEGMAEKLITQTFSHHNQLAQKTRREKRAR

SEQ ID NO: 5307 - protein, 67 aa, Homo sapiens
  UNSURE 61: Xaa=Cys or Phe or Ser or Tyr
MGGEQEEERFDGMLLAMAQQHEGGVQELVNTFFSFLRRKTDFFIGGEEGMAEKIGRRENEXQQKKCQ

SEQ ID NO: 5308 - protein, 79 aa, Homo sapiens
  UNSURE 42: Xaa=Ile or Lys or Met or Asn
MSKLGLRQVTGVTRVTIRKSKNILFVITKPDVYKSPASDTYXVFGEAKIEDLSQQAQLAAAEKFKVQGEAVSNIQENTQ

SEQ ID NO: 5309 - protein, 73 aa, Homo sapiens
MASQSQGIQQLLQAEKRAAEKVADARKRKARRLKQAKEEAQMEVEQYRREREHEFQSKQQAAMGSQGNLSAEV

SEQ ID NO: 5310 - protein, 132 aa, Homo sapiens
  UNSURE 122: Xaa=Gly or Arg or Trp
MPSVPDFETLFSQVQLFISTCNGEHIRYATDTFAGLCHQLTNALVERKQPLRGIGILKQAIDKMQMNTNQLTSIHADLCQLCLLAKCFKPALPYLDVDMMDICKENGAYDAKHFLCYYYYGXMIYTGLKNFE

SEQ ID NO: 5311 - protein, 86 aa, Homo sapiens
  UNSURE 74: Xaa=Ala or Thr
MTELPAPLSYFQNAQMSEDNHLSNTVRSQNDNRERQEHNDRRSLGHPEPLSNGRPQGNSRQVVEQDEEEDEELXLKYGAKHVIMLF

SEQ ID NO: 5312 - protein, 102 aa, Homo sapiens
MAGEEINEDYPVEIHEYLSAFENSIGAVDEMLKTMMSVSRNELLQKLDPLEQAKVDLVSAYTLNSMFWVYLATQGVNPKEHPVKQELERIRVYMNRVKEITD

SEQ ID NO: 5313 - protein, 77 aa, Homo sapiens
  UNSURE 14: Xaa=Leu or Arg
MVLKTEEEDVPSDXTAEERQELENIRRRKQELLADIQRLKDEIAEVANEIENLGSTEERKNMQRNKQVAMGRKKFNM

SEQ ID NO: 5314 - protein, 69 aa, Homo sapiens
  UNSURE 7: Xaa=Asp or Gly
  UNSURE 8: Xaa=Arg or Thr
  UNSURE 23: Xaa=Gly or Arg
  UNSURE 27: Xaa=Asp or Gly
  UNSURE 28: Xaa=Gly or Arg
  UNSURE 52: Xaa= *  or Tyr
  UNSURE 55: Xaa=Leu or Trp
  UNSURE 57: Xaa=Ala or Gly
  UNSURE 58: Xaa=Phe or Leu
  UNSURE 61: Xaa=Ile or Asn
  UNSURE 63: Xaa= *  or Cys
MKDDRRXXYSAGKRGGFNTFRDXENYXXGYSSLLKRDFGAKTQNGVYSAANXTKXEXXGVXLXLLVYRP

SEQ ID NO: 5315 - protein, 77 aa, Homo sapiens
  UNSURE 5: Xaa=Cys or Tyr
  UNSURE 49: Xaa=Arg or Thr
  UNSURE 66: Xaa=Asp or Gly
MMDPXSVGVQLRTTNECHKTYYTRHTGFKTLQELSSNDMLLLQLRTGMXLSGNNTICFHHVKIYIXRFEDLQKSCCD

SEQ ID NO: 5316 - protein, 80 aa, Homo sapiens
  UNSURE 79: Xaa= *  or Glu or Gly or Lys or Gln or Arg or Trp
MAFLASGPYLTHQQKVLRLYKRALRHLESWCVQRDKYRYFACLMRGPIKNLKEQLSMKRSQWEMEKHNLESTMKTYVSXL

SEQ ID NO: 5317 - protein, 108 aa, Homo sapiens
  UNSURE 46: Xaa=Glu or Gly
  UNSURE 48: Xaa=Lys or Asn
  UNSURE 55: Xaa=Asp or Glu
  UNSURE 88: Xaa=Ile or Met
  UNSURE 91: Xaa=Ala or Pro
MPERELWPAGTGSEPVTRVGSCDSMMSSTSTRSGSSDSSYDFLSTXEXECLLFLXETIRSLDTEADSGLSTDESEPATTPRGFRALPXTQXTPRGGPEETITQQGRTP

SEQ ID NO: 5318 - protein, 136 aa, Homo sapiens
MLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYN

SEQ ID NO: 5319 - protein, 89 aa, Homo sapiens
MAEYLASIFGTEKDKVNCSFYFKIGACRHGDRCSRLHNKPTFSQTILIQNIYRNPQNSAQTADGSHCAVSDVEMQEHYDEFFEEVFTEM

SEQ ID NO: 5320 - protein, 63 aa, Homo sapiens
MFRIQQLKQLLEDSTSGEDRSSSSSSEGKEKHKKKKKKEKHKKRKKEKKKKKKRKHKSSKSNE

SEQ ID NO: 5321 - protein, 75 aa, Homo sapiens
  UNSURE 70: Xaa=Ala or Asp or Gly or Val
MVGEEKMSLRNRLSKSRENPEEDEDQRNPAKESLETPSNGRIDIKQLIAKKIKLTAEAEELKPFFMKEVXSHFDD

SEQ ID NO: 5322 - protein, 92 aa, Homo sapiens
MRGQRLPLDIQIFYCARPDEEPFVKIITVEEAKRRKSTCSYYEDEDEEVLPVLRPHSALLENMHIEQLARRLPARVQGYPWRLAYSTLEHGT

SEQ ID NO: 5323 - protein, 117 aa, Homo sapiens
MANLERTFIAIKPDGVQRGLVGEIIKRFEQKGFRLVAMKFLRASEEHLKQHYIDLKDRPFFPGLVKYMNSGPVVAMVREGLNVVKTGRVMLGETNPADSKPGTIRGDFCIQVGRNII

SEQ ID NO: 5324 - protein, 83 aa, Homo sapiens
MADFGISAGQFVAVVWDKSSPVEALKGLVDKLQALTGNEGRVSVENIKQLLQCLVPGSTTLHSAEILAEIARILRPGGCLFLK

SEQ ID NO: 5325 - protein, 51 aa, Homo sapiens
MATEIGSPPRFFHMPRFQHQAPRQLFYKRPDFAQQQAMQQLTFDGKRMRKA

SEQ ID NO: 5326 - protein, 103 aa, Homo sapiens
  UNSURE 91: Xaa=Ile or Asn or Ser or Thr
MAAIRKKLVIVGDGACGKTCLLIVFSKDQFPEVYVPTVFENYVADIEVDGKQVELALWDTAGQEDYDRLRPLSYPDTDVILMCFSIDSPDXLENIPEKWTQKS

SEQ ID NO: 5327 - protein, 103 aa, Homo sapiens
  UNSURE 78: Xaa=His or Gln
  UNSURE 88: Xaa=Lys or Asn or Arg or Ser
MTECCSVTQAGVQWHDLGSLQPPPPGFKRFSCLSLPSSWDYRLECDGMILAHGKLRLPGSSDSPASASRVAGITGMCXHAPLARLVSXTLPQVISHLWDYRPA

SEQ ID NO: 5328 - protein, 131 aa, Homo sapiens
MKLLTRAGSFSRFYSLKVAPKVKATAAPAGAPPQPQDLEFTKLPNGLVIASLENYSPVSRIGLFIKAGSRYEDFSNLGTTHLLRLTSSLTTKGASSFKITRGIEAVGGKLSVTATRENMAYTVECLRGDVD

SEQ ID NO: 5329 - protein, 56 aa, Homo sapiens
MGPRKKSVKTCIMNNEIPEEMTADETKDYMNQLSHEVLCHIFRYLPLQDIMCMFFP

SEQ ID NO: 5330 - protein, 52 aa, Homo sapiens
  UNSURE 28: Xaa=Cys or Phe or Gly or Val
MTEVMKVRKRWLGIVAHAYNFSTLGGRXRRISWGQEFETSLGNTDTFSTKKK

SEQ ID NO: 5331 - protein, 203 aa, Homo sapiens
  UNSURE 115: Xaa=Cys or Trp
  UNSURE 116: Xaa=Glu or Lys
  UNSURE 182: Xaa= *  or Glu or Lys or Gln
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLXXRIADISQVYTQNAEMRPLGCCMILIGIDEEQGPQVYKCDPAGYYCGFKATAAGVKQTESTSFLEKXVKKKFDWTFEQTVETAITCLS

SEQ ID NO: 5332 - protein, 184 aa, Homo sapiens
  UNSURE 121: Xaa=Phe or Leu
  UNSURE 163: Xaa= *  or Glu or Lys or Gln
MAGLRREYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMIXIGIDEEQGPQVYKCDPAGYYCGFKATAAGVKQTESTSFLEKXVKKKFDWTFEQTVETAITCLS

SEQ ID NO: 5333 - protein, 79 aa, Homo sapiens
  UNSURE 55: Xaa=Gly or Arg or Trp
MNRNVCPYVRIGNNGEDQLIKDVLDKFLNCHEQTYDEEFLNTFTHLSQEDHVSKXGVFGTDSSENIFTSAKVTHKNEAD

SEQ ID NO: 5334 - protein, 81 aa, Homo sapiens
MMTSVGTNRARGNWEQPQNQNQTQHKQRPQATAEQIRLAQMISDHNDADFEEKVKQLIDITGKNQDECVIALHDCNGDVNR

SEQ ID NO: 5335 - protein, 124 aa, Homo sapiens
  UNSURE 107: Xaa=Leu or Met or Val
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLXLADQMISRIEYIHSKNF

SEQ ID NO: 5336 - protein, 75 aa, Homo sapiens
MSSFGAGKTKEVIFSVEDGSVKMFLRGRPVPMMIPDELAPTYSLDTRSELPSCRLKLEWVYGYRGRDCRANLYLL

SEQ ID NO: 5337 - protein, 73 aa, Homo sapiens
  UNSURE 58: Xaa=Ile or Val
  UNSURE 60: Xaa=Ala or Asp
  UNSURE 64: Xaa=Asp or Asn
  UNSURE 65: Xaa=Lys or Arg
  UNSURE 67: Xaa=Glu or Lys
MAPPSPSNSTPNSSSGSNGNDQLSKTNLYIRGLQPGTTDQDLVKLCQPYGKIVSTKAXLXKTTXXCXGYGFVD

SEQ ID NO: 5338 - protein, 105 aa, Homo sapiens
  UNSURE 14: Xaa=Ala or Val
MCNTPTYCDLGKAXKDVFNKGYGFGMVKIDLKTKSCSGVMEFSTSGHAYTDTGKASGNLETKYKVCNYGLTFTQKWNTDNTLGTEISWENKLAEGLKLTLDTIFV

SEQ ID NO: 5339 - protein, 85 aa, Homo sapiens
  UNSURE 3: Xaa=Phe or Ile or Leu or Val
  UNSURE 64: Xaa=Cys or Phe or Gly or Ile or Leu or Arg or Ser or Val
MGXWRFYGAALTDSGQATRRINWNSSKCQVWYPQPLNSLQVKWKIKQNHQIQGLMLLLNTVLIXLPGPPGNSCPSTYWLPELAMG

SEQ ID NO: 5340 - protein, 76 aa, Homo sapiens
  UNSURE 61: Xaa=Ala or Gly
  UNSURE 62: Xaa=Lys or Gln
  UNSURE 63: Xaa=Ala or Val
MDGFYDQQVPYMVTNSQRGRNCNEKPTNVRKRKFINRDLAHDSEELFQDLSQLQETWLAEXXXPDNDEQFVPDYQA

SEQ ID NO: 5341 - protein, 73 aa, Homo sapiens
MERSPSRRRRLEEAPIPKDDLDFRLAALYNHHTGTFKNKSEILLNQKTTQDTYRTKIQFPGEFLTPPTPPITF

SEQ ID NO: 5342 - protein, 60 aa, Homo sapiens
  UNSURE 20: Xaa=Ile or Asn or Ser or Thr
MGLSHSKTHLRVIKVAPLQXKEVETPSAGRVDFAFNQNLEEKTSYSLARLQDQNKALEGQ

SEQ ID NO: 5343 - protein, 76 aa, Homo sapiens
  UNSURE 67: Xaa=Asp or Glu
MSCLTKEDTGWYWCGIQRDFARDDMDFTELIVTDDKGTLANDFWSGKDLSGNKTRSCKAPKVVRKAXRSRTSILII

SEQ ID NO: 5344 - protein, 90 aa, Homo sapiens
MIEDSGKRGNTMAERRQLFAEMRAQDLDRIRLSTYRTACKLRFVQKKCNLHLVDIWNVIEALRENALNNLDPNTELNVSRLEAVLSTIFY

SEQ ID NO: 5345 - protein, 68 aa, Homo sapiens
MANCQIAILYQRFQRVVFGISQLLCFSALISELTNQKEVAAWTYHYSTKAYSWNISRKYCQNRYTDLV

SEQ ID NO: 5346 - protein, 58 aa, Homo sapiens
MEYERSPLERKGQTLCFHESEDLAEPVPQGYCIHSLSLKGCATSRMSLLDFEISNCLP

SEQ ID NO: 5347 - protein, 58 aa, Homo sapiens; identical to SEQ ID NO: 5346

SEQ ID NO: 5348 - protein, 138 aa, Homo sapiens
MEEYAREPCPWRIVDDCGGAFTMGTIGGGIFQAIKGFRNSPVGVNHRLRGSLTAIKTRAPQLGGSFAVWGGLFSMIDCSMVQVRGKEDPWNSITSGALTGAILAARNGPVAMVGSAAMGGILLALIEGAGILLTRFAS

SEQ ID NO: 5349 - protein, 87 aa, Homo sapiens
MAASSSGEKEKERLGGGLGVAGGNSTRERLLSALEDLEVLSRELIEMLAISRNQKLLQAGEENQVLELLIHRDGEFQELMKLALNQG

SEQ ID NO: 5350 - protein, 105 aa, Homo sapiens
MAKEWGYASHNGPDHWHELFPNAKGENQSPVELHTKDIRHDPSLQPWSVSYDGGSAKTILNNGKTCRVVFDDTYDRSMLRGGPLPGPYRLRQFHLHWGSSDDHGS

SEQ ID NO: 5351 - protein, 100 aa, Homo sapiens
  UNSURE 97: Xaa=Ala or Thr
MTEQMTLRGTLKGHNGWVTQIATTPQFPDMILSASRDKTIIMWKLTRDETNYGIPQRALRGHSHFVSDVVISSDGQFALSGSWDGTLRLWDLTTQVXAHL

SEQ ID NO: 5352 - protein, 135 aa, Homo sapiens
MSCRQDGGRGGRGMVADWLQQSYQAVKEKSSEALEFMKRDLTEFTQVVQHDTACTIAATASVVKEKLATEGSSGATEKMKKGLSDFLGVISDTFAPSPDKTIDCDVITLMGTPSGTAEPMMAPRLASIACSRTQQ

SEQ ID NO: 5353 - protein, 55 aa, Homo sapiens [sequence omitted]

SEQ ID NO: 5354 - protein, 106 aa, Homo sapiens
MSSLAVRDPAMDRSLRSVFVGNIPYEATEEQLKDIFSEVGSVVSFRLVYDRETGKPKGYGFCEYQDQETALSAMRNLNGREFSGRALRVDNAASEKNKEELKSLGP

SEQ ID NO: 5355 - protein, 111 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFRE

SEQ ID NO: 5356 - protein, 118 aa, Homo sapiens
  UNSURE 113: Xaa=Ala or Pro or Ser or Thr
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDADCLLKMTCQSQMSXKSTIH

SEQ ID NO: 5357 - protein, 82 aa, Homo sapiens
  UNSURE 30: Xaa=Ala or Pro or Ser or Thr
  UNSURE 48: Xaa=Lys or Asn
  UNSURE 78: Xaa= *  or Trp
MSKRPSYAPPPTPAPATQMPSTPGFVGYNXYSHLAYNNYRLGGNPGTXSRVTVGESTITASGKQLELTRNAFRIRSFXIIST

SEQ ID NO: 5358 - protein, 84 aa, Homo sapiens
  UNSURE 20: Xaa=Ser or Thr
  UNSURE 23: Xaa=Arg or Thr
MSKRPSYAPPPTPAPATASXGIXIPKPPKPPDKPLMPYMRYSRKVWDQVKASNPDLKLWEIGKIIGGMWRDLTDEEKQEYLNEY

SEQ ID NO: 5359 - protein, 119 aa, Homo sapiens
  UNSURE 85: Xaa=Lys or Asn
MSKRPSYAPPPTPAPATQMPSTPGFVGYNPYSHLAYNNYRLGGNPGTNSRVTASSGITIPKPPKPPDKPLMPYMRYSRKVWDQVXASNPDLKLWEIGKIIGGMWRDLTDEEKQEYLNEY

SEQ ID NO: 5360 - protein, 110 aa, Homo sapiens
  UNSURE 11: Xaa=Gly or Ser
  UNSURE 12: Xaa=Lys or Asn
MCMGDIKSNMXXLIYESRGDRDLHCTESQSEASTEEGHDSLSVGSFEEDSKSEFILDPPKPKPPAWFNGILTWEDFELVNPHRARFLKEIKDLAIKRRQILSNKGLSEDE

SEQ ID NO: 5361 - protein, 113 aa, Homo sapiens
MSGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGRVTIAQGGVLPTSR

SEQ ID NO: 5362 - protein, 122 aa, Homo sapiens
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYM

SEQ ID NO: 5363 - protein, 77 aa, Homo sapiens
MLRHLMYKIKSTGPITVAEYMKEVLTNPAKGYYVYRDMLGEKGDFITSPEISQIFGELQVYGSLVNGWPLEKAQLSS

SEQ ID NO: 5364 - protein, 65 aa, Homo sapiens
MMFKHFDKDKSGRLNHQEFKSCLRSLGYDLPMVEEGEPDPEFEAILDTVDPNRDGHVSLQEYMAF

SEQ ID NO: 5365 - protein, 64 aa, Homo sapiens
  UNSURE 19: Xaa=Asp or Glu
MELSAEYLREKLQRDLEAXMWRWRTRPSTVAPVASESWWCRPSSRGNRCFRDTGSVQSNEMCDG

SEQ ID NO: 5366 - protein, 169 aa, Homo sapiens [sequence omitted]

SEQ ID NO: 5367 - protein, 86 aa, Homo sapiens
  UNSURE 6: Xaa= *  or Ala or Glu or Lys or Pro or Gln or Ser or Thr
  UNSURE 39: Xaa=His or Leu or Pro or Arg
MRAVLXFAAATGATPIAGRFTPGTFTNQIQAAFREPRLXVVTDPRADHQPLTEASYVNLPTIALCNTDSPLRYVDIAIPCNNKGAH

SEQ ID NO: 5368 - protein, 86 aa, Homo sapiens; identical to SEQ ID NO: 5367
  UNSURE 6: Xaa= *  or Ala or Glu or Lys or Pro or Gln or Ser or Thr
  UNSURE 39: Xaa=His or Leu or Pro or Arg

SEQ ID NO: 5369 - protein, 81 aa, Homo sapiens
  UNSURE 70: Xaa= *  or Cys or Trp
MPASLKTPATEEGNQHENTASSSRCPMTSPCTLQPINDLHTWDHSKTLKNLRLKVLLETNLRFPPICVWXPMIKPLSLLQP

SEQ ID NO: 5370 - protein, 108 aa, Homo sapiens
  UNSURE 89: Xaa=Ala or Pro
  UNSURE 99: Xaa=Ala or Leu or Ser or Val
MARTKQTARKSTGGKAPRKQLATKAARKSAPSTGGVKKPHRYRPGTVALREIRRYQKSTELLIRKLPFQRLVREIAQDFKTDLRFQSAXSVRCRRLAKXPGGSVRRYQ

SEQ ID NO: 5371 - protein, 57 aa, Homo sapiens
MYKEELVPFRLKLFQKIEEEELLPNLFYEASITLDIKIQQRYTKKTKKEKENFKPIS

SEQ ID NO: 5372 - protein, 76 aa, Homo sapiens
  UNSURE 73: Xaa=Leu or Val
MVAMAEAEAGVAVEVRGLPPAVPDELLTLYFENRRRSGGGPVLSWQRLGCGGVLTFREPADAERVLAQADHEXHGA

SEQ ID NO: 5373 - protein, 64 aa, Homo sapiens
  UNSURE 46: Xaa=Leu or Arg
  UNSURE 51: Xaa=Arg or Thr
  UNSURE 54: Xaa=Leu or Met or Val
MDMIRAQEQKRDLHDQFQHQLKCSNDSFSVIADYFGRGVFNKLTLXTDPPXARXTSSLEAGLQR

SEQ ID NO: 5374 - protein, 99 aa, Homo sapiens
MSAAMRERFDRFLHEKNCMTDLLAKLEAKTGVNRSFIALGVIGLVALYLVFGYGASLLCNLIGFGYPAYISIKAIESPNKEDDTQWLTYWVVYGVFSIA

SEQ ID NO: 5375 - protein, 115 aa, Homo sapiens
  UNSURE 56: Xaa=Arg or Ser
  UNSURE 92: Xaa=Ala or Cys or Asp or Phe or Gly or His or Ile or Leu or Asn or Pro or Arg or Ser or Thr or Val or Tyr
  UNSURE 96: Xaa=Asp or His or Asn or Tyr
MELDFGHFDERDKTSRNMRGSRMNGLPSPTHSAHCSFYRTRTLQALSNEKKAKKVXFYRNGDRYFKGIVYAVSSDRFRSFDALLADLTRSLXDNIXLPQGVRYIYTIDGSKEDRK

SEQ ID NO: 5376 - protein, 73 aa, Homo sapiens
MATITCTRFTEEYQLFEELGKGAFSVVRRCVKVLAGQEYAAKIINTKKLSARDHQKLEREARICRLLKHPNIV

SEQ ID NO: 5377 - protein, 80 aa, Homo sapiens
MVPPPPGEESQTVILPPGWQSYLSPQGRRYYVNTTTNETTWERPSSSPGIPASPGSHRSSLPPTVNGYHASGTPAHPPET

SEQ ID NO: 5378 - protein, 70 aa, Homo sapiens
MGVQGLWKLLECSGRQVSPEALEGKILAVDISIWLNQALKGVRDRHGNSIENPHLLTLFHRLCKLLFFRI

SEQ ID NO: 5379 - protein, 103 aa, Homo sapiens
  UNSURE 91: Xaa=Asp or Gly
MAERKPNGGSGGASTSSSGTNLLFSSSATEFSFNVPFIPVTQASASPASLLLPGEDSTDVGEEDSFLGQTSIHTSAPQTFSYFSQVSSSSXPFGNIGQSPLTT

SEQ ID NO: 5380 - protein, 88 aa, Homo sapiens
MIIGTNNVFEVGCYSQAMKMGDNNVIESKAYVGRNVILTSGCIIGACCNLNTFEVIPENTVIYGADCLRRVQTERPQPQTLQLDFLMK

SEQ ID NO: 5381 - protein, 86 aa, Homo sapiens
  UNSURE 34: Xaa=Asp or Glu or Val
MRRGRGVPLPGKPAPLTIQLPKQFSRIEEVFKEXQNLKEIVNSLKKSCQDCKLQADDNGDPGRNGLLLPSTGAPGEVGDNRVRELE

SEQ ID NO: 5382 - protein, 144 aa, Homo sapiens
MAWRHLQKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVIN

SEQ ID NO: 5383 - protein, 90 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDN

SEQ ID NO: 5384 - protein, 81 aa, Homo sapiens
  UNSURE 7: Xaa=Pro or Gln
  UNSURE 25: Xaa=Arg or Thr
MLWGVPXPSLPPPLPLVEEDGGRRXADLDTQRSDIATLLKTSLRKGDTWYLVIVAGSNSGKNMLALTVGTNTRWEIKMCIP

SEQ ID NO: 5385 - protein, 87 aa, Homo sapiens
MAAQIPESDQIKQFKEFLGTYNKLTETCFLDCVKDFTTREVKPEETTCSEHCLQKYLKMTQRISMRFQEYHIQQNEALAAKAGLLGQ

SEQ ID NO: 5386 - protein, 70 aa, Homo sapiens
MVGRSRRRGAAKWAAVRAKAGPTLTDENGDDLGLPPSPGDTSYYQDQVDDFHEARSRAALAKGWNEVQSG

SEQ ID NO: 5387 - protein, 94 aa, Homo sapiens
  UNSURE 28: Xaa=Ile or Thr
  UNSURE 66: Xaa=Asp or Gly
  UNSURE 76: Xaa=Lys or Met or Arg or Thr
  UNSURE 83: Xaa=Ile or Asn or Ser or Thr
MSKCRDDRVWIKDWKVACLCPRWKGPQXVVLSTPTAVKVEGIPAWIQHSHIKPAAPETWEARPSPXNPCRVTLKKXTSPAPVXRKLTSQARPKP

SEQ ID NO: 5388 - protein, 110 aa, Homo sapiens
  UNSURE 40: Xaa=Asp or His
MVEEVQKHSVHTLVFRSLKRTHDMFVADNGKPVPLDEESXKRKMAIKLRNEYGPVLHMPTSKENLKEKGPQNATDSYVHKQYPANQGQEVEYFVAGTHPYPPGPGVALTA

SEQ ID NO: 5389 - protein, 129 aa, Homo sapiens
  UNSURE 25: Xaa=Ala or Gly
  UNSURE 26: Xaa=Asp or Glu
  UNSURE 28: Xaa=Glu or Gln
  UNSURE 29: Xaa=Pro or Ser
  UNSURE 32: Xaa=Ile or Arg
  UNSURE 110: Xaa=Ser or Thr
  UNSURE 113: Xaa=Asp or Gly
  UNSURE 116: Xaa=Ile or Asn or Ser or Thr
  UNSURE 121: Xaa=Asp or Gly
MDPLFQQTHKQVHEIQSCMGRLETXXKXXVHXVENEIQASIDQIFSRLERLEILSSKEPPNKRQNAKLRVDQLKYDVQHLQTALRNFQHRRHAREQQERQREELLSRTFXTNXSGXTIPMXDHCSLTPP

SEQ ID NO: 5390 - protein, 81 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDA

SEQ ID NO: 5391 - protein, 103 aa, Homo sapiens
MAEPWGNELASAAARGDLEQLTSLLQNNVNVNAQNGFGRTALQVMKLGNPEIARRLLLRGANPDLKDRTGFAVIHDAARAGFLDTLQTLLEFQADVNIEDNEG

SEQ ID NO: 5392 - protein, 53 aa, Homo sapiens
MAGLTAAAPRARSPPAPAVHPPPLSAWRGPWGHSWWSSWRSLLSRGWSRSPWR

SEQ ID NO: 5393 - protein, 92 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEE

SEQ ID NO: 5394 - protein, 64 aa, Homo sapiens
MPKPINVRVTTMDAELEFAIQPNTTGKQLFDQVVKTIGLREVWYFGLHYVDNKGFPTWLKLDKK

SEQ ID NO: 5395 - protein, 98 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSR

SEQ ID NO: 5396 - protein, 133 aa, Homo sapiens
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEY

SEQ ID NO: 5397 - protein, 133 aa, Homo sapiens
  UNSURE 54: Xaa=Pro or Arg
MAENDVDNELLDYEDDEVETAAGGDGAEAPAKKDVKGSYVSIHSSGFRDFLLKXELLRAIVDCGFEHPSEVQHECIPQAILGMDVLCQAKSGMGKTAVFVLATLQQLEPVTGQVSVLVMCHTRELAFQISKEY

SEQ ID NO: 5398 - protein, 100 aa, Homo sapiens
  UNSURE 10: Xaa=Arg or Ser
  UNSURE 11: Xaa= *  or Cys or Gly or Arg or Ser or Trp
MPDSNFAERXXEQVSGAKVIAQALKTQDVEYIFGIVGIPVTEIAIAAQQLGIKYIGMRNEQAACYAASAIGYLTSRPGVCLVVSGPGLIHALGGMANANM

SEQ ID NO: 5399 - protein, 73 aa, Homo sapiens
MKATTPLQTVDRPKDWYKTMFKQIHMVHKPGLYNPPYSAQSHPAAKTQTYRPLSKSHSDNSPNAFKDASSPVP

SEQ ID NO: 5400 - protein, 104 aa, Homo sapiens
  UNSURE 85: Xaa=Ile or Lys or Arg or Thr
  UNSURE 98: Xaa=Cys or Asp or Gly or His or Asn or Arg or Ser or Tyr
MAGTGLVAGEVVVDALPYFDQGYEAPGVREAAAALVEEETRRYRPTKNYLSYLTAPDYSAFETDIMRNEFERLAARQPIELLSMXRYELPAPSSGQKXDITAWQ

SEQ ID NO: 5401 - protein, 54 aa, Homo sapiens
  UNSURE 29: Xaa=Ala or Glu or Gly or Val
MAPGEVTITVRLIRSFEHRNFKPVVYHGXNLDQTVKEFIVFLKQDIPLRTNLPP

SEQ ID NO: 5402 - protein, 62 aa, Homo sapiens
  UNSURE 49: Xaa=His or Leu or Pro or Gln or Arg
  UNSURE 50: Xaa=Ser or Thr
MPLKSVLWGGSKGPWSWPRPRHRERLDFLSLCAEWLRWRPLSLTQQLKXXISGSNWLPHPLP

SEQ ID NO: 5403 - protein, 84 aa, Homo sapiens
  UNSURE 62: Xaa= *  or Ala or Glu or Gly or Lys or Leu or Met or Pro or Gln or Arg or Ser or Thr or Val or Trp
MTVFFKTLRNHWKKTTAGLCLLTWGGHWLYGKHCDNLLRRAACQEAQVFGNQLIPPNAQVKXATVFLNPAACKGKARTLFEKNA

SEQ ID NO: 5404 - protein, 69 aa, Homo sapiens
  UNSURE 41: Xaa=Cys or Tyr
MLCWGYWSLGQPGISTNLQGIVAEPQVCGFISDRSVKEVAXGGNHSVFLLEDGEVYTCGLNTKGQLGHE

SEQ ID NO: 5405 - protein, 71 aa, Homo sapiens
MFLAQRSLCSLSGRAKFLKTISSSKILGFSTSAKMSLKFTNAKRIEGLDSNVWIEFTKLAADPSVVNLGQG

SEQ ID NO: 5406 - protein, 124 aa, Homo sapiens
MSLKFTNAKRIEGLDSNVWIEFTKLAADPSVVNLGQGFPDISPPTYVKEELSKIAAIDSLNQYTRGFGHPSLVKALSYLYEKLYQKQIDSNKEILVTVGAYGSLFNTIQALIDEGDEVILIVPF

SEQ ID NO: 5407 - protein, 51 aa, Homo sapiens
MSGLDGGNKLPLAQTGGLAAPDHASGDPDLDQCQGLREETEATQVMANTGG

SEQ ID NO: 5408 - protein, 120 aa, Homo sapiens
  UNSURE 87: Xaa=Cys or Phe or Ser or Tyr
MDLLFGRRKTPEELLRQNQRALNRAMRELDRERQKLETQEKKIIADIKKMAKQGQMDAVRIMAKDLVRTRRYVRKFVLMRANIQAVXLKIQTLKSNNSMAQAMKGVTKAMGTMNRQLKLP

SEQ ID NO: 5409 - protein, 120 aa, Homo sapiens
  UNSURE 30: Xaa=Asp or His or Asn or Tyr
  UNSURE 34: Xaa=His or Gln
  UNSURE 87: Xaa=Cys or Phe or Ser or Tyr
MDLLFGRRKTPEELLRQNQRALNRAMRELXRERXKLETQEKKIIADIKKMAKQGQMDAVRIMAKDLVRTRRYVRKFVLMRANIQAVXLKIQTLKSNNSMAQAMKGVTKAMGTMNRQLKLP

SEQ ID NO: 5410 - protein, 120 aa, Homo sapiens
  UNSURE 28: Xaa=Asp or Glu
  UNSURE 29: Xaa=Leu or Val
  UNSURE 87: Xaa=Cys or Phe or Ser or Tyr
MDLLFGRRKTPEELLRQNQRALNRAMRXXDRERQKLETQEKKIIADIKKMAKQGQMDAVRIMAKDLVRTRRYVRKFVLMRANIQAVXLKIQTLKSNNSMAQAMKGVTKAMGTMNRQLKLP

SEQ ID NO: 5411 - protein, 109 aa, Homo sapiens
MPGIVELPTLEELKVDEVKISSAVLKAAAHHYGAQCDKPNKEFMLCRWEEKDPRRCLEEGKLVNKCALDFFRQIKRHCAEPFTEYWTCIDYTGQQLFRHCRKQQAKFDE

SEQ ID NO: 5412 - protein, 106 aa, Homo sapiens
MADKVLKEKRKLFIHSMGEGTINGLLDELLQTRVLNQEEMEKVKRENATVMDKTRALIDSVIPKGAQACQICITYICEEDSYLAETLGLSAALQAVQDNPAMPTCS

SEQ ID NO: 5413 - protein, 108 aa, Homo sapiens
  UNSURE 19: Xaa=Lys or Asn
  UNSURE 20: Xaa=Phe or Ile or Leu or Val
MERSLRQSLLEPVPPSLPXXCAWLVSELRVLCKLEENVQATNSPSEAEEFQLEVSGLLGEMNCPYLSLTSGDVTKRLLIQKNCLLLLTYLISELEAARMALCECSSKK

SEQ ID NO: 5414 - protein, 75 aa, Homo sapiens
MENQVLTPHVYWAQRHRELYLRVELSDVQNPAISITENVLHFKAQGHGAKGDNVYEFHLEFLDLVKPEPVYKLTQ

SEQ ID NO: 5415 - protein, 124 aa, Homo sapiens
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDN

SEQ ID NO: 5416 - protein, 93 aa, Homo sapiens
MEGHICQSLESAKAGTRFPGPQWGCANPRELGWSAMARSRLTATSVSQVQENGFVKKLEPKSGWMTFLEVTGKICEMLFCPEAILLTRKDTPY

SEQ ID NO: 5417 - protein, 134 aa, Homo sapiens
  UNSURE 107: Xaa=Ile or Met
  UNSURE 108: Xaa=Asp or Tyr
MASTIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSXXGREAHATPKHDHERAQSYRASRSYAM

SEQ ID NO: 5418 - protein, 149 aa, Homo sapiens
  UNSURE 147: Xaa=Asp or Glu
MAAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGAAGCLLXDE

SEQ ID NO: 5419 - protein, 57 aa, Homo sapiens
MQVVDLVRKSGNSVTLLVLDGDSYEKAVKTRVDLKELGQSQKEQGLSDNILSPVMNG

SEQ ID NO: 5420 - protein, 113 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGATPFWG

SEQ ID NO: 5421 - protein, 58 aa, Homo sapiens
  UNSURE 40: Xaa=Glu or Val
  UNSURE 41: Xaa=Glu or Gly
MLLTRKQTCQLGILLSIHRQHSKQETSLRVPDLIQMFATXXYELDKLRLSSGGSWQPC

SEQ ID NO: 5422 - protein, 115 aa, Homo sapiens
MPERDSEPFSNPLAPDGHDVDDPHSFHQSKLTNEDFRKLLMTPRAAPTSAPPSKSRHHEMPREYNEDEDPAARRRKKKSYYAKLRQQEIERERELAEKYRDRAKERRDGVNKDYE

SEQ ID NO: 5423 - protein, 91 aa, Homo sapiens
  UNSURE 72: Xaa=Pro or Thr
  UNSURE 77: Xaa=Cys or Gly
  UNSURE 89: Xaa=Arg or Thr
MIQLRPCSGFPGNMQAWAIFKGKYKEGDTGGPAVWKTRLRCALNKSSEFKEVPERGRMDVAEPYKVYQLLPXGIVSXQPGTQKVHQSDXQF

SEQ ID NO: 5424 - protein, 136 aa, Homo sapiens
  UNSURE 117: Xaa=Pro or Thr
  UNSURE 122: Xaa=Cys or Gly
  UNSURE 134: Xaa=Arg or Thr
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPXGIVSXQPGTQKVHQSDXQF

SEQ ID NO: 5425 - protein, 125 aa, Homo sapiens [sequence omitted]

SEQ ID NO: 5426 - protein, 131 aa, Homo sapiens
  UNSURE 112: Xaa= *  or Leu
MTNQYGILFKQEQAHDDAIWSVAWGTNKKENSETVVTGSLDDLVKVWKWRDERLDLQWSLEGHQLGVVSVDISHTLPIAASSSLDAHIRLWDLENGKQIKSIDAGPVDAWTXAFSPDSQYLATGTHVGKVN

SEQ ID NO: 5427 - protein, 173 aa, Homo sapiens
MAGGGGDLSTRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTT

SEQ ID NO: 5428 - protein, 198 aa, Homo sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTT

SEQ ID NO: 5429 - protein, 77 aa, Homo sapiens
  UNSURE 73: Xaa=Glu or Gly or Lys or Arg
MTLYFRTWEEQKTEHALLSLITWFQAQPPAFLTNQGLRTEGNYFFWWTWNLRLSTLSSSQWSLFISDLQIVLXFVVT

SEQ ID NO: 5430 - protein, 128 aa, Homo sapiens
  UNSURE 116: Xaa= *  or Trp
MAVSTVFSTSSLMLALSRHSLLSPLLSVTSFRRFYRGDSPTDSQKDMIEIPLPPWQERTDESIETKRARLLYESRKRGMLENCILLSLFAKEHLQHMTEKQLNLYDRLINEPSNDXDIYYWATEAKPA

SEQ ID NO: 5431 - protein, 120 aa, Homo sapiens
MAPQKDRKPKRSTWRFNLDLTHPVEDGIFDSGNFEQFLREKVKVNGKTGNLGNVVHIERFKNKITVVSEKQFSKRYLKYLTKKYLKKNNLRDWLRVVASDKETYELRYFQISQDEDESES

SEQ ID NO: 5432 - protein, 92 aa, Homo sapiens
MAENGDNEKMAALEAKICHQIEYYFGDFNLPRDKFLKEQIKLDEGWVPLEIMIKFNRLNRLTTDFNVIVEALSKSKAELMEISEDKTKIRRS

SEQ ID NO: 5433 - protein, 83 aa, Homo sapiens
MAAFSEMGVMPEIAQAVEEMDWLLPTDIQAESIPLILGGGDVLMAAETGSGKTGAFSIPVIQIVYETLKDQQEGKKGKTTIKT

SEQ ID NO: 5434 - protein, 86 aa, Homo sapiens
  UNSURE 23: Xaa= *  or Tyr
  UNSURE 39: Xaa=His or Gln
MAELQMLLEEEIPGGRRALFDSXTNLERVADYCENNYIXSADKQRALEETKAYTTQSLASVAYLINTLANNVLQMLDIQASQLRRM

SEQ ID NO: 5435 - protein, 84 aa, Homo sapiens
MKTRRTTRLQQQHSEQPPLQPSPVTTRRGLRDSHSSEEDEASSQTDLSQTISKKTVRSIQEAPVSEDLVIRLRRPPLRYPRYEA

SEQ ID NO: 5436 - protein, 123 aa, Homo sapiens
MGKFMKPGKVVLVLAGRYSGRKAVIVKNIDDGTSDRPYSHALVAGIDRYPRKVTAAMGKKKIAKRSKIKSFVKVYNYNHLMPTRYSVDIPLDKTVVNKDVFRDPALKRKARREAKVSLKRDTD

SEQ ID NO: 5437 - protein, 123 aa, Homo sapiens; identical to SEQ ID NO: 5436

SEQ ID NO: 5438 - protein, 52 aa, Homo sapiens
  UNSURE 33: Xaa=His or Asn
MNFPPQSPARGSLDAVGPGRGSPRLDCSSEWPXLPCQAAAETTRRSTCENTC

SEQ ID NO: 5439 - protein, 113 aa, Homo sapiens
  UNSURE 90: Xaa=Asp or Asn
MTDNSNNQLVVRAKFNFQQTNEDELSFSKGDVIHVTRVEEGGWWEGTLNGRTGWFPSNYVREVKASEKPVSPKSGTLKSPPKGFDTTAIXKSYYNVVARSSAESRRLLFKPDA

SEQ ID NO: 5440 - protein, 87 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFE

SEQ ID NO: 5441 - protein, 74 aa, Homo sapiens
MSDSGSQLGSMGSLTMKSQLQITVISAKLKENKKNWFGPSPYVEVTVDGQSKKTEKCNNTNSPKWKQPLTVIVT

SEQ ID NO: 5442 - protein, 75 aa, Homo sapiens
MEYMAESTDRSPGHILCCECGVPISPNPANICVACLRSKVDISQGIPKQVSISFCKQCQRYFQPPGTWIQCALES

SEQ ID NO: 5443 - protein, 175 aa, Homo sapiens
  UNSURE 144: Xaa=Ile or Met
  UNSURE 154: Xaa=Arg or Ser
MPVARSWVCRKTYVTPRRPFEKSRLDQELKLIGEYGLRNKREVWRVKFTLAKIRKAARELLTLDEKDPRRLFEGNALLRRLVRIGVLDEGKMKLDYILGLKIEDFLERRLQTQVFKLGLAKSIHHARVLIRQRHIRVRKQVVNXPSFIVRLDSXKHIDFSLRSPYGGGRPGRVKR

SEQ ID NO: 5444 - protein, 175 aa, Homo sapiens; identical to SEQ ID NO: 5443
  UNSURE 144: Xaa=Ile or Met
  UNSURE 154: Xaa=Arg or Ser

SEQ ID NO: 5445 - protein, 103 aa, Homo sapiens
  UNSURE 57: Xaa=Lys or Leu or Met or Gln
  UNSURE 80: Xaa=Arg or Trp
MSDCYTELEKAVIVLVENFYKYVSKYSLVKNKISKSSFREMLQKELNHMLSDTGNRXAADKLIQNLDANHDGRISFDEYXTLIGGITGPIAKLIHEQEQQSSS

SEQ ID NO: 5446 - protein, 66 aa, Homo sapiens
MSDCYTELEKAVIVLVENFYKYVSKYSLVKNKISKSSFREMLQKELNHMLSVRPLTQGPCLPLPFP

SEQ ID NO: 5447 - protein, 103 aa, Homo sapiens
  UNSURE 97: Xaa=Gln or Arg
MSDCYTELEKAVIVLVENFYKYVSKYSLVKNKISKSSFREMLQKELNHMLSDTGNRKAADKLIQNLDANHDGRISFDEYWTLIGGITGPIAKLIHEXEQQSSS

SEQ ID NO: 5448 - protein, 106 aa, Homo sapiens
  UNSURE 48: Xaa=Asp or Tyr
MAPSVPAAEPEYPKGIRAVLLGPPGAGKGTQAPRLAENFCVCHLATGXMLRAMVASGSELGKKLKATMDAGKLVSDEMVVELIEKNLETPLCKNGFLLDGFPRTVR

SEQ ID NO: 5449 - protein, 125 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPP

SEQ ID NO: 5450 - protein, 129 aa, Homo sapiens
  UNSURE 45: Xaa=Lys or Arg
MEFVKCLGHPEEFYNLVRFRIGGKRKVMPKMDQDSLSSSLKTCYXYLNQTSRSFAAVIQALDGEMRNAVCIFYLVLRALDTLEDDMTISVEKKVPLLHNFHSFLYQPDWRFMESKEKDRQVLEDFPTIS

SEQ ID NO: 5451 - protein, 86 aa, Homo sapiens
MEEASEGGGNDRVRNLQSEVEGVKNIMTQNVERILVRGENLEHLRNKTEDLEATSEHFKTTSQKVARKFWWKNVKMIVLICVIVFI

SEQ ID NO: 5452 - protein, 145 aa, Homo sapiens
  UNSURE 80: Xaa=Lys or Gln
  UNSURE 135: Xaa=Ile or Arg
MAIFSVYVVNKAGGLIYQLDSYAPRAEAEKTFSYPLDLLLKLHDERVLVAFGQRDGIRVGHAVLAINGMDVNGRYTADGXEVLSIWVTLLITRCPFDLAGPASLLMRSLCWPPCSTRSLPSAPSCLLNREAQALXCWRQTHSNCT

SEQ ID NO: 5453 - protein, 104 aa, Homo sapiens
MEYYLVKWKGWPDSTNTWEPLQNLKCPLLLQQFSNDKHNYLSQVKKGKAITPKDNNKTLKPAIAEYIVKKAKQRIALQRWQDELNRRKNHKGMIFVENTVDLEG

SEQ ID NO: 5454 - protein, 136 aa, Homo sapiens [sequence omitted]

SEQ ID NO: 5455 - protein, 83 aa, Homo sapiens
MALLCYNRGCGQRFDPETNSDDACTYHPGVPVFHDALKGWSCCKRRTTDFSDFLSIVGCTKGRHNSEKPPEPVKPEVKTTEKK

SEQ ID NO: 5456 - protein, 64 aa, Homo sapiens
MLDGSVKTVMVDDSKTVGELLVTICSRIGITNYEEYSLIQETIEEKKEEGTGTLKKDRTLLRDE

SEQ ID NO: 5457 - protein, 99 aa, Homo sapiens
MSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRY

SEQ ID NO: 5458 - protein, 123 aa, Homo sapiens
  UNSURE 115: Xaa=Leu or Gln
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFIXLAVMTCLL

SEQ ID NO: 5459 - protein, 116 aa, Homo sapiens
MSSLPRRAKVQVQDVVLKDEFSSFSELSSASEEDDKEDSAWEPQKKVPRSRKQPPPKESKPKRMPRVKKNAPQISDGSEVVVVKEELNSSVAIADTALEDRKNKLDTVQTLKTAKT

SEQ ID NO: 5460 - protein, 112 aa, Homo sapiens
  UNSURE 19: Xaa= *  or Glu or Gly or Lys or Gln or Arg
MHPQSLAEEEIKTEQEVVXGHGYLYSLQRSWLCRENSPEKKVPQPSTFFQWPLAADTSTSPIKKKKKPGLLNSNNKEQDGRNDFYCWVCHREGQVLCCELCPRVYHAKCLRL

SEQ ID NO: 5461 - protein, 98 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMT

SEQ ID NO: 5462 - protein, 162 aa, Homo sapiens
  UNSURE 67: Xaa=Ile or Lys or Met or Asn
MSLSDKQTASLTAAYGQLSKGKPAECRMDSPKEISQAGFEWQRTEGKLNEIGLNVSMDGQPKDGLVXNASFLEQNKLCFFEGKLDKELSIEMQDKDCQEASGHLESRYVISETCHPLEGNSVHQKTSEFHLGLIEGPDKNKTIPVQGKVAGKNGLETKSQSD

SEQ ID NO: 5463 - protein, 51 aa, Homo sapiens
MERSDDLMRVRTRGRALRLRGRAWVRTTRAAATSDRHPSCALPFHENYHLL

SEQ ID NO: 5464 - protein, 74 aa, Homo sapiens
  UNSURE 7: Xaa=Arg or Thr
MSGDGAXEQAAEYVPEKVKKAEKKLEENPYDLDAWSILIREAQNQPIDKARKTYERLVAQFPSSGRFWKLYIEA

SEQ ID NO: 5465 - protein, 119 aa, Homo sapiens
  UNSURE 106: Xaa= *  or Phe or Leu or Tyr
MASPVAAQAGKLLRALALRPRFLAAGSQAVQLTSRRWLNLQEYQSKKLMSDNGVRVQRFFVADTANEALEAAKRLNAKEIVLKAQILAGGRGKGVFNSGLKGGVHXTKDPNVVGQLAKQ

SEQ ID NO: 5466 - protein, 81 aa, Homo sapiens
  UNSURE 46: Xaa= *  or Glu
MQGGNSGVRKREEEGDGAGAVAAPPAIDFPAEGPDPEYDESDVPAXIQVLKEPLQQPTFPFAVANQLLLVSLLEHLSHVHE

SEQ ID NO: 5467 - protein, 151 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSW

SEQ ID NO: 5468 - protein, 66 aa, Homo sapiens
MNLGARKSKKLGKLKGIHEEQPQQQQPPPPPPPPQSPEEGTTYIAPAKEPSVNTALVPQLSTISRT

SEQ ID NO: 5469 - protein, 128 aa, Homo sapiens
  UNSURE 17: Xaa=Lys or Asn
  UNSURE 73: Xaa=Leu or Met or Val
MDEDGLPLMGSGIDLTXVPAIQQKRTVAFLNQFVVHTVQFLNRFSTVCEEKLADLSLRIQQIETTLNILDAKXSSIPGLDDVTVEVSPLNVTSVTNGAHPEATSEQPQQNSTRDSGLQESEVSAENIL

SEQ ID NO: 5470 - protein, 97 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLE

SEQ ID NO: 5471 - protein, 56 aa, Homo sapiens
MAAQIVSGRGCSLCGGWRLMSAVDSRWALGHVSLLAYCLRGTEVKGRSLFGSFLHS

SEQ ID NO: 5472 - protein, 116 aa, Homo sapiens
  UNSURE 105: Xaa=Ile or Met
  UNSURE 106: Xaa=Asp or Asn
MSSRKSKSNSLIHTECLSQVQRILRERFCRQSPHSNLFGVQVQYKHLSELLKRTALHGESNSVLIIGPRGSGKTMLISHALKELMEIEEVSENVLQVHLNGLLQXXDKIALKEITR

SEQ ID NO: 5473 - protein, 105 aa, Homo sapiens
  UNSURE 73: Xaa=Ala or Gly
MATSATSPHAPGFPAEGRCGYYVEKKKRFCRMVVAAGKRFCGEHAGAMEEEDARKRILCPLDPKHTVYEDQLXKHLKKCNSREKPKPDFYIQDINAGLRDETEIP

SEQ ID NO: 5474 - protein, 140 aa, Homo sapiens
  UNSURE 74: Xaa=Glu or Val
MANQVNGNAVQLKEEEEPMDTSSVTHTEHYKTLIEAGLPQKVAERLDEIFQTGLVAYVDLDERAIDALREFNEXGALSVLQQFKESDLSHVQNKSAFLCGVMKTYRQREKQGSKVQESTKGPDEAKIKALLERTGYTLDV

SEQ ID NO: 5475 - protein, 101 aa, Homo sapiens
MSDMEDDFMCDDEEDYDLEYSEDSNSEPNVDLENQYYNSKALKEDDPKAALSSFQKVLELEGEKGEWGFKALKQMIKINFKLTNFPEMMNRYKQLLTYIRS

SEQ ID NO: 5476 - protein, 184 aa, Homo sapiens
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFA

SEQ ID NO: 5477 - protein, 119 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLEKDQPIECPSRSQEELCEAN

SEQ ID NO: 5478 - protein, 124 aa, Homo sapiens
  UNSURE 99: Xaa= *  or Tyr
  UNSURE 105: Xaa=Asp or Asn
MAGKQAVSASGKWLDGIRKWYYNAAGFNKLGLMRDDTIYEDEDVKEAIRRLPENLYNDRMFRIKRALDLNLKHQILPKEQWTKYEEVAQLYLPDSVAHXGWSFRXKRNMFICIVLEFSESCQIN

SEQ ID NO: 5479 - protein, 71 aa, Homo sapiens
  UNSURE 43: Xaa=Met or Arg
  UNSURE 48: Xaa=Leu or Arg
MAPRKGKEKKEEQVISLGPQVAEGENVFGVCHIFASFNDTLSXSLIFXASEYLGGEASSWQKAEEGNGWDG

SEQ ID NO: 5480 - protein, 188 aa, Homo sapiens
  UNSURE 8: Xaa=Ala or Val
  UNSURE 78: Xaa=Phe or Ser
MLPAVGSXDEEEDPAEEDCPELVPIETTQSEEEEKSGLGAKIPVTIITGYLGAGKTTLLNYILTEQHSKRVAVILNEXGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLAEEKPDGLIN

SEQ ID NO: 5481 - protein, 65 aa, Homo sapiens
MQKKGKFDYILLETTGLADPGAVASMFWVDAELGSDIYLDGIITIVDSKYGLKHLAEEKPDGLIN

SEQ ID NO: 5482 - protein, 69 aa, Homo sapiens
  UNSURE 61: Xaa=Asp or Glu
MLPAVGSADEEEDPAEEDCPELVPMETTQSEEEEKSGLGAKIPVTIITGYLGAGILAPRPXFSSSHFRR

SEQ ID NO: 5483 - protein, 126 aa, Homo sapiens
  UNSURE 82: Xaa=Ala or Gly or Ser or Thr
  UNSURE 105: Xaa= *  or Ala or Glu or Gly or Ile or Lys or Leu or Pro or Gln or Arg or Ser or Thr or Val
  UNSURE 113: Xaa=Phe or Leu
  UNSURE 114: Xaa=Cys or Ser
MASLLQSDRVLYLVQGEKKVRAPLSQLYFCRYCSELRSLECVSHEVDSHYCPSCLENMPSAEAKLKKNRCANCFDCPGCMHXLSTRATSISTQLPDDPAKTTMKXAYYLACGXXRWTSRDVGMADK

SEQ ID NO: 5484 - protein, 98 aa, Homo sapiens
MPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLE

SEQ ID NO: 5485 - protein, 74 aa, Homo sapiens
  UNSURE 17: Xaa=Glu or Lys
  UNSURE 68: Xaa= *  or Phe or Leu or Tyr
MTDSKYFTTNKKGEIFXLKAELNNEKKEKRKEAVKKVIAAMTVGKDVSSLFPDVVNCMQTDNLERENXHPSPRS

SEQ ID NO: 5486 - protein, 56 aa, Homo sapiens
MVDAFLGTWKLVDSKNFDDYMKSLGVGFATRQVASMTKPTTIIEKNGDILTLKTHS

SEQ ID NO: 5487 - protein, 76 aa, Homo sapiens
MGWSQDLFRALWRSLSREVKEHVGTDQFGNKYYYIPQYKNWRGQTIREKRIVEAANKKEVDYEAGDIPTEWEAWIR

SEQ ID NO: 5488 - protein, 69 aa, Homo sapiens
MKVRKSSTQEEIKKRKKAVLFCLSDDKRQIIVEEAKQILVGDIGDTVEDPYTSFVKLLPLNDCRYALYD

SEQ ID NO: 5489 - protein, 86 aa, Homo sapiens
MASGVTVNDEVIKVFNDMKVRKSSTQEEIKKRKKAVLFCLSDDKRQIIVEEAKQILVGDIGDTVEDPYTSFVKLLPLNDCRYALYD

SEQ ID NO: 5490 - protein, 74 aa, Homo sapiens
  UNSURE 56: Xaa=Lys or Asn
MTELETAMGMIIDVFSRYSGSEGSTQTLTKGELKVLMEKELPGFLQSGKDKDAVDXLLKDLDANGDAQVDFSEF

SEQ ID NO: 5491 - protein, 107 aa, Homo sapiens
MTELETAMGMIIDVFSRYSGSEGSTQTLTKGELKVLMEKELPGFLQVSQAGSAGLSGGWGRRGRRGRQRAESCGGVGGQGAQRQEGQILKCPGSPAKERTHPGIKAG

SEQ ID NO: 5492 - protein, 54 aa, Homo sapiens
  UNSURE 26: Xaa=Arg or Thr
  UNSURE 46: Xaa=Arg or Thr
MGRGPTQSPPSAVTVQPLTAAAPLRXAACSENTELPTSRRVSRRKXRPGLDPQS

SEQ ID NO: 5493 - protein, 113 aa, Homo sapiens
  UNSURE 111: Xaa=Ala or Pro
MWTVQNRESLGLLSFPVMITMVCCAHSTNEPSNMSYVKETVDRLLKGYDIRLRPDFGGPPVDVGMRIDVASIDMVSEVNMVSGLPRGPAVRLTQMGNGQVPLPSAFHWRSXRP

SEQ ID NO: 5494 - protein, 59 aa, Homo sapiens
  UNSURE 49: Xaa=Asp or Glu or Gly
MPNFSGNWKIIRSENFEELLKVLGVNVMLRKIAVAAASKPAVEIKQEGXTFYIKTSTTV

SEQ ID NO: 5495 - protein, 133 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFL

SEQ ID NO: 5496 - protein, 130 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYS

SEQ ID NO: 5497 - protein, 57 aa, Homo sapiens
MVGRNSAIAAGVCGALFIGYCIYFDRKRRSDPNFKNRLRERRKKQKLAKERAGLSKL

SEQ ID NO: 5498 - protein, 126 aa, Homo sapiens
MAFVKSGWLLRQSTILKRWKKNWFDLWSDGHLIYYDDQTRQNIEDKVHMPMDCINIRTGQECRDTQPPDGKSKDCMLQIVCRDGKTISLCAESTDDCLAWKFTLQDSRTNTAYVGSAVMTDETSVV

SEQ ID NO: 5499 - protein, 159 aa, Homo sapiens
MARGPKKHLKRVAAPKHWMLDKLTGVFAPRPSTGPHKLRECLPLIVFLRNRLKYALTGDEVKKICMQRFIKIDGKVRVDVTYPAGFMDVISIEKTGEHFRLVYDTKGRFAVHRITVEEAKYKLCKVRKITVGVKGIPHLVTHDARTIRYPDPVIKVNDT

SEQ ID NO: 5500 - protein, 128 aa, Homo sapiens
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTIS

SEQ ID NO: 5501 - protein, 83 aa, Homo sapiens
  UNSURE 68: Xaa=Ala or Thr
MDRSLGWQGNSVPEDRTEAGIKRFLEDTTDDGELSKFVKDFSGNASCHPPEAKTWASRPQVPEPRPQXPDLYDDDLEFRPPSR

SEQ ID NO: 5502 - protein, 152 aa, Homo sapiens
MATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKPKPGDLVGVNKDSYLILETLPTEY

SEQ ID NO: 5503 - protein, 81 aa, Homo sapiens
MCPKGYEDSMEFPDHSRHLLQCLSEQRHQGFLCDCTVLVGDAQFRAHRAVLASCSMYFHLFYKDQLDKRDIVHLNSDIVTA

SEQ ID NO: 5504 - protein, 72 aa, Homo sapiens
MEFPDHSRHLLQCLSEQRHQGFLCDCTVLVGDAQFRAHRAVLASCSMYFHLFYKDQLDKRDIVHLNSDIVTA

SEQ ID NO: 5505 - protein, 221 aa, Homo sapiens
  UNSURE 180: Xaa=Ala or Pro or Ser or Thr
MPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPIELVVFLPALCRKMGVXYCIIKGKARLGRLVHRKTCTTVAFTQVNSEDKGALAKLVEA

SEQ ID NO: 5506 - protein, 110 aa, Homo sapiens
  UNSURE 3: Xaa=Gly or Val
  UNSURE 100: Xaa= *  or Tyr
MPXFHTRTIESILEPVAQQISHLVIMHEEGEVDGKAIPDLTAPVAAVQAAVSNLVRVGKETVQTTEDQILKRDMPPAFIKVENACTKLVQAAQMLQSDPXSVPARDYLID

SEQ ID NO: 5507 - protein, 65 aa, Homo sapiens
  UNSURE 22: Xaa=Ala or Glu or Gly or Val
MLSRNDVKRLERSWAQGSSEQXLHYASLQRLPVPSSEGPDLRGRDKRGTKEDPRADYACIAENKP

SEQ ID NO: 5508 - protein, 54 aa, Homo sapiens
  UNSURE 4: Xaa= *  or Glu or Gly or Lys or Gln or Arg
  UNSURE 21: Xaa=Asp or Glu or Lys or Asn
  UNSURE 28: Xaa=Arg or Ser
  UNSURE 29: Xaa= *  or Ala or Glu or Gly or Lys or Leu or Met or Pro or Gln or Arg or Ser or Thr or Val or Trp
  UNSURE 40: Xaa=Asp or Glu
  UNSURE 41: Xaa=Ala or Glu or Gly or Leu or Pro or Gln or Arg or Val
  UNSURE 48: Xaa=Lys or Gln
MRGXEERMLPALLANSTLRGXICRSSSXXKTQRRSRRRLXXVRKVARXLFLRSM

SEQ ID NO: 5509 - protein, 57 aa, Homo sapiens
  UNSURE 43: Xaa=Lys or Thr
  UNSURE 44: Xaa=Lys or Gln
  UNSURE 45: Xaa=Ile or Lys or Arg or Thr
  UNSURE 46: Xaa=Ile or Lys or Arg or Thr
  UNSURE 48: Xaa=Ile or Lys or Arg or Thr
  UNSURE 50: Xaa=Glu or Lys
  UNSURE 51: Xaa=Gln or Arg
MGKKQKNKSEDSTKDDIDLDALAAEIEGAGAAKEQEPQKSKGXXXXEXKXXDFDEDD

SEQ ID NO: 5510 - protein, 101 aa, Homo sapiens
MDSLLPPSRFSYFKKYPLHAIRRYLSTLRNQRAEEQVARFQKIPNGENETMIPVLTSKKASELPVSEVASILQADLQNGLNKCEVSHRRAFHGWNEFDISE

SEQ ID NO: 5511 - protein, 136 aa, Homo sapiens
  UNSURE 126: Xaa=Ala or Asp or Gly or Val
MNRLFGKAKPKAPPPSLTDCIGTVDSRAESIDKKISRLDAELVKYKDQIKKMREGPAKNMVKQKALRVLKQKRMYEQQRDNLAQQSFNMEQANYTIQSLKDTKTTVDAMKLGVKEMKKAYKQVKIXQIEDLQDQLE

SEQ ID NO: 5512 - protein, 54 aa, Homo sapiens
MEDYQAAEETAFVVDEVSNIVKEAIESAIGGNAYQHSKVNQWTTNVVEQTLSQL

SEQ ID NO: 5513 - protein, 62 aa, Homo sapiens
MYSHFAQDLWSEQSIKDSFQKVILRRYEKCRHDNLQLKKGCESVDECPVHKRGYNGLKQCLA

SEQ ID NO: 5514 - protein, 54 aa, Homo sapiens
  UNSURE 42: Xaa=Glu or Lys
MLQPFDYDPNEKSKHKFMVQTIFAPPNTSDMEAVWKEAKPDXLMDSKLRCVFEM

SEQ ID NO: 5515 - protein, 65 aa, Homo sapiens
MQRYSKRVYIAYSTFYIVGLILSMQIPFVGFQPIRTSEHMAAAGVFALLQAYAFLQYLRDRLTKQ

SEQ ID NO: 5516 - protein, 64 aa, Homo sapiens
MAATEPILAATGSPAAVPPEKLEGAGSSSAPERNCVGSSLPEASPPAPEPSSPNAAVPEAIPTP

SEQ ID NO: 5517 - protein, 107 aa, Homo sapiens
  UNSURE 34: Xaa= *  or Trp
  UNSURE 72: Xaa=Ala or Gly or Val
MVFYFTSSSVNSSAYTIYMGKDKYENEDLIKHGXPEDIWFHVDKLSSAHVYLRLHKGENIEDIPKEVLMDCXNLVKANSIQGCKMNNVNVVYTPWSNLKKTADMDVG

SEQ ID NO: 5518 - protein, 128 aa, Homo sapiens
MGAAAAEADRTLFVGNLETKVTEELLFELFHQAGPVIKVKIPKDKDGKPKQFAFVNFKHEVSVPYAMNLLNGIKLYGRPIKIQFRSGSSHAPQDVSLSYPQHHVGNSSPTSTSPSRYERTMDNMTSSA

SEQ ID NO: 5519 - protein, 70 aa, Homo sapiens
  UNSURE 13: Xaa=Cys or Gly or Arg or Ser
  UNSURE 15: Xaa=Pro or Arg
MPKYYEDKPQARXVXGLKEDLGACLLQSDCVVQEGKSPRQCLKEGYCNSLKYAFFECKRSVLDNRARFRG

SEQ ID NO: 5520 - protein, 96 aa, Homo sapiens
MASTSRLDALPRVTCPNHPDAILVEDYRAGDMICPECGLVVGDRVIDVGSEWRTFSNDKATKDPSRVGDSQNPLLSDGDLSTMIGKGTGAASFDEV

SEQ ID NO: 5521 - protein, 95 aa, Homo sapiens
MYRNEFTAWYRRMSVVYGIGTWSVLGSLLYYSRTMAKSSDQKDGSASEVPSELSERPKGFYVETVVTYKEDFVPNTEKILNYWKSWTGGLVQNHD

SEQ ID NO: 5522 - protein, 87 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDK

SEQ ID NO: 5523 - protein, 145 aa, Homo sapiens
  UNSURE 34: Xaa=Phe or Ile or Leu or Val
  UNSURE 133: Xaa=Asp or His or Asn or Tyr
MINMGDSHVDTSSTVSEAVAEEVSLFSMTDMILXSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDXALVVFCMATYGE

SEQ ID NO: 5524 - protein, 96 aa, Homo sapiens
  UNSURE 32: Xaa=Asp or Glu
  UNSURE 66: Xaa= *  or Glu or Lys or Gln
  UNSURE 70: Xaa=Asp or Asn
  UNSURE 74: Xaa=Asp or Glu
  UNSURE 80: Xaa=Leu or Pro or Gln or Arg
MDEQDLNEPLAKVSLLKDDLQGAQSEIEAKQXIQHLRKELIEAQELARTSKQKCFELQALLEEERXAYRXQVEXSTKQIXVLQAQLQRLHIDTENL

SEQ ID NO: 5525 - protein, 88 aa, Homo sapiens
  UNSURE 78: Xaa=Lys or Arg
MSSGNASYRCSMSSSADFSDEDDFSQKSGSASPAPGDTLPWNLPKHERSKRKIQGGSVLDPAERAVLRIADERTKFRXNIYKMDKSAS

SEQ ID NO: 5526 - protein, 59 aa, Homo sapiens
MCQLQKISIAQESVGQAEKHTEHFWTCERALNMDLSGIFHPHQCFTNARAGQAETFNDN

SEQ ID NO: 5527 - protein, 143 aa, Homo sapiens
MKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHR

SEQ ID NO: 5528 - protein, 52 aa, Homo sapiens
MAFFNLYLLGYQNSFQNKKRNTTEETNQKEPEPTRLPPIISKDGNYSVHQNS

SEQ ID NO: 5529 - protein, 71 aa, Homo sapiens
MDKLNKITVPASQKLRQLQKMVHDIKNNEGGIMNKIKKLKVKAPPSVPRRDYASESPADEEEQWSDDFDSD

SEQ ID NO: 5530 - protein, 120 aa, Homo sapiens
  UNSURE 109: Xaa=Lys or Thr
  UNSURE 111: Xaa=Lys or Thr
  UNSURE 119: Xaa=Asp or Glu
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDXLXNEKELHSXR

SEQ ID NO: 5531 - protein, 77 aa, Homo sapiens
MFGFHKPKMYRSIEGCCICRAKSSSSRFTDSKRYEKDFQSCFGLHETRSGDICNACVLLVKRWKKLPAGSKKNWNHV

SEQ ID NO: 5532 - protein, 77 aa, Homo sapiens
  UNSURE 41: Xaa=Lys or Met or Arg or Thr
MTTSQKHRDFVAEPMGEKPVGSLAGIGEVLGKKLEERGFDXAYVVLGQFLVLKKDEDLFREWLKDTCGANAKQSRDC

SEQ ID NO: 5533 - protein, 90 aa, Homo sapiens
  UNSURE 5: Xaa=His or Gln
  UNSURE 7: Xaa=Leu or Trp
  UNSURE 8: Xaa=Ala or Gly
  UNSURE 16: Xaa=Ile or Thr
MAERXLXXPTPSSPGXASDAFESGATPSCDALWEALNPQPSSRVCSRVGTPPLSSTKEKIAIVVLTSDVLRGLLGVFSPNHFNFFLDSRS

SEQ ID NO: 5534 - protein, 106 aa, Homo sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVT

SEQ ID NO: 5535 - protein, 70 aa, Homo sapiens
MTSFQEVPLQTSNFAHVIFQNVAKSYLPNAHLECHYTLTPSAADIKIFFCRNRVSLCCPGWSAVLLSQFT

SEQ ID NO: 5536 - protein, 136 aa, Homo sapiens
MAAAGVVSGKIIYEQEGVYIHSSCGKTNDQDGLISGILRVLEKDAEVIVDWRPLDDALDSSSILYARKDSSSVVEWTQAPKERGHRGSEHLNSYEAEWDMVNTVSFKRKPHTNGDAPSHRNGKSKWSFLFSLTDLK

SEQ ID NO: 5537 - protein, 124 aa, Homo sapiens
MSDLEDDETPQLSAHALAALQEFYAEQKQQIEPGEDDKYNIGIIEENWQLSQFWYSQETALQLAQEAIAAVGEGGRIACVSAPSVYQKLRELCRENFSIYIFEYDKRFAMYGEEFIFYDYNNPL

SEQ ID NO: 5538 - protein, 113 aa, Homo sapiens
  UNSURE 106: Xaa=Lys or Asn or Arg or Ser
  UNSURE 111: Xaa=Ala or Gly
MPDPDHGAERTLGPDRDRQRAESANDKPHLVSLGSGRLSTAITLLPLEEGRTVIGSAARDISLQGPGLAPEHCYIENLRGTLTLYPCGNACTIDGLLSGSLPGSLXAACCXWV

SEQ ID NO: 5539 - protein, 111 aa, Homo sapiens
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYC

SEQ ID NO: 5540 - protein, 129 aa, Homo sapiens
MNDVKLAVLGGEGTGKSALTVRFLTKRFIGEYASNFESIYKKHLCLERKQLNLEIYDPCSQTQKAKFSLTSELHWADGFVIVYDISDRSSFAFAKALIYRIREPQTSHCKRAVESAVFLVGNKRDLCHV

SEQ ID NO: 5541 - protein, 98 aa, Homo sapiens
  UNSURE 48: Xaa=Asp or Glu
  UNSURE 69: Xaa=His or Tyr
  UNSURE 89: Xaa=Ala or Ser
MKYQEVRCLTSFNISVSFPAETDDYAEIIDEEDTYTMPSTRDYEIQRXRIELGRCIGEGQFGDVHQGIXMSPENPALAVAIKTCKNCTXDSVREKFLQ

SEQ ID NO: 5542 - protein, 81 aa, Homo sapiens
  UNSURE 56: Xaa=Ile or Asn or Ser or Thr
  UNSURE 67: Xaa=Ile or Asn or Ser or Thr
MTKSNGEEPKMGGRMERFQQGVRKRTLLAKKKVQNITKEDVKSYLFRNAFVLLTVXAVIVGTILGFXLRPYRMSYREVKYF

SEQ ID NO: 5543 - protein, 97 aa, Homo sapiens
MDEYNHLKERMDQCEKEKAGRKIDLTEAQETVPSRCLHLDAENEVLQLQQTLFSMKAIQKQCETLQKNKKQLKQEVVNLKSYMERNMLERGKLNGIN

SEQ ID NO: 5544 - protein, 111 aa, Homo sapiens
  UNSURE 40: Xaa=Cys or Phe or Leu or Trp
  UNSURE 86: Xaa=Asp or Glu
  UNSURE 87: Xaa=His or Asn
  UNSURE 105: Xaa=Ser or Thr
MAAAAAAAAEQITLVIWAVIRIGPNGCDSMEFHESGLLRXKQVSDMGVIHPLYKSTVGGRRNENLVITGNNQPIVFQQGTTKLSVXXNKTSITSDIGMQFFDPRXQNILFS

SEQ ID NO: 5545 - protein, 89 aa, Homo sapiens
  UNSURE 30: Xaa=Ile or Ser
  UNSURE 39: Xaa= *  or Tyr
  UNSURE 40: Xaa=Gly or Arg
  UNSURE 58: Xaa= *  or Glu or Leu or Val
MSKRKAPQETLNGGITDMLTELANFEKNVXQAIHKYNAXXKAASVIAKYPHKIKSGAXAKKLPGVGTKIAEKIDEFLATGKLRKLEKIR

SEQ ID NO: 5546 - protein, 89 aa, Homo sapiens
MDPLSELQDDLTLDDTSEALNQLKLASIDEKNWPSDEMPDFPKSDDSKSSSPELVTHLKWDDPYYDIARHQIVEVAGDDKYGRKIIVFS

SEQ ID NO: 5547 - protein, 134 aa, Homo sapiens
  UNSURE 13: Xaa= *  or Gly or Arg
MDVTDTLFSLIFXKAGKMSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSIT

SEQ ID NO: 5548 - protein, 236 aa, Homo sapiens
  UNSURE 146: Xaa= *  or Glu or Lys or Gln
  UNSURE 161: Xaa=Ala or Pro or Ser or Thr
MLGFVGRVAAAPASGALRRLTPSASLPPAQLLLRAAPTAVHPVRDYAAQTSPSPKAGAATGRIVAVIGAVVDVQFDEGLPPILNALEVQGRETRLVLEVAQHLGESTVRTIAMDGTEGLVRGQKVLDSGAPIKIPVGPETLGRIMXCHWRNLLMKEVPSKXKQFAPIHAEAPEFMEMSVEQEILVTGIKVVDLLAPYAKGGKIGLFGGAGVGKTVLIMELINNVAKAHGGYSVFAG

SEQ ID NO: 5549 - protein, 56 aa, Homo sapiens
  UNSURE 48: Xaa=Ala or Glu or Gly or Val
MLGFVGRVAAAPASGALRRLTPSASLPPAQLLLRAAPTAVHPGKCFSXGANVPFCR

SEQ ID NO: 5550 - protein, 67 aa, Homo sapiens
  UNSURE 46: Xaa=Ala or Pro
MEPTRLPEGEVKSSQTHKVIRTANWHPKELYGDLQPINKLDEGLKXSTTNNPKHQTEGNILTFTDRL

SEQ ID NO: 5551 - protein, 137 aa, Homo sapiens
  UNSURE 129: Xaa=Glu or Val
  UNSURE 130: Xaa=Asp or Asn
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIXXGGVILES

SEQ ID NO: 5552 - protein, 96 aa, Homo sapiens
  UNSURE 4: Xaa=Pro or Arg
MAEXRRHKKRIQEVGEPSKEEKAVAKYLRFNCPTKSTNMMGHRVDYFIASKAVDCLLDSKWAKAKKGEEALFTTRESVVDYCNRLLKKQFFHRALK

SEQ ID NO: 5553 - protein, 126 aa, Homo sapiens
MGSPLRFDGRVVLVTGAGAGLGRAYALAFAERGALVVVNDLGGDFKGVGKGSLAADKVVEEIRRRGGKAVANYDSVEEGEKVVKTALDAFGRIDVVVNNAGILRDRSFARISDEDWDIIHRVHLRG

SEQ ID NO: 5554 - protein, 67 aa, Homo sapiens
  UNSURE 49: Xaa=His or Leu or Pro or Arg
  UNSURE 66: Xaa=Ala or Asp or Gly or Val
MAVAAVKWVMSKRTILKHLFPVQNGALYCVCHKSTYSPLPDDYNCNVEXALTSDGRTIVCYHPSVXI

SEQ ID NO: 5555 - protein, 56 aa, Homo sapiens
MVEDELALFDKSINEFWNKFKSTDTSCQMAGLRDTYKDSIKAFAEKLSVKLKEEER

SEQ ID NO: 5556 - protein, 97 aa, Homo sapiens
  UNSURE 94: Xaa=Ala or Pro or Ser or Thr
MRRSEVLAEESIVCLQKALNHLREIWELIGIPEDQRLQRTEVVKKHIKELLDMMIAEEESLKERLIKSISVCQKELNTLCSELHVEPFQEEGEXTIL

SEQ ID NO: 5557 - protein, 123 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWED

SEQ ID NO: 5558 - protein, 51 aa, Homo sapiens
MLEPSRQISIFQWEPFGQEQVNPPEEKNVLLKWRRVFLPPRMRRRSQFQER

SEQ ID NO: 5559 - protein, 53 aa, Homo sapiens [sequence omitted]

SEQ ID NO: 5560 - protein, 103 aa, Homo sapiens
MPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKV

SEQ ID NO: 5561 - protein, 94 aa, Homo sapiens
  UNSURE 88: Xaa=Arg or Ser
MAASSSEISEMKGVEESPKVPGEGPGHSEAETGPPQVLAGVPDQPEAPQPGPNTTAAPVDSGPKAGLAPETTETPAGASETAQATDLXLSPGGE

SEQ ID NO: 5562 - protein, 52 aa, Homo sapiens
MRAGVGKDCHLTPPALFQVLKELQAMLREEKPATEEKPATEKKRSDLPFSSP

SEQ ID NO: 5563 - protein, 72 aa, Homo sapiens
  UNSURE 46: Xaa=Phe or Leu
  UNSURE 63: Xaa=Asp or Phe or His or Ile or Leu or Asn or Val or Tyr
MFNFDTFWKNFKSKLGFINWDAINKNQVPPPSTRALLYFSRLWEEXKQNTPFLNWKAIIEGAXASSLQKRAG

SEQ ID NO: 5564 - protein, 72 aa, Homo sapiens; identical to SEQ ID NO: 5563
  UNSURE 46: Xaa=Phe or Leu
  UNSURE 63: Xaa=Asp or Phe or His or Ile or Leu or Asn or Val or Tyr

SEQ ID NO: 5565 - protein, 65 aa, Homo sapiens
MLRPKALTQVLSQANTGGVQSTLLLNNEGSLLAYSGYGDTDARVTAAIASNIWAAYDRNGNQAFN

SEQ ID NO: 5566 - protein, 80 aa, Homo sapiens
MDENFISRAFATMGETVMSVKIIRNRLTGIPAGYCFVEFADLATAEKCLHKINGKPLPGATPAKRFKLNYATYGKQPDNS

SEQ ID NO: 5567 - protein, 86 aa, Homo sapiens
  UNSURE 84: Xaa=Ala or Pro
MSNYVNDMWPGSPQEKDSPSTSRSGGSSRLSSRSRSRSFSRSSRSHSRVSSRFSSRSRRSKSRSRSRSATSGSTGATRGHTRGXVA

SEQ ID NO: 5568 - protein, 119 aa, Homo sapiens
  UNSURE 39: Xaa=Asn or Thr
  UNSURE 113: Xaa= *  or Trp
MEEYHRHCDEVGFNAEEAHNIVKECVDGVLGGEDYNHNXINQWTASIVEQSLTHLVKLGKAYKYIVTCAVVQKSAYGFHTASSCFWDTTSDGTCTVRWENRTGSGTEVSLRMXITVDVG

SEQ ID NO: 5569 - protein, 82 aa, Homo sapiens
MAKYNTGGNPTEDVSVNSRPFRVTGPNSSSGIQARKNLFNNQGNASPPAGPSNVPKFGSPKPPVAVNLLLRKSLTRNPSPRF

SEQ ID NO: 5570 - protein, 122 aa, Homo sapiens
  UNSURE 99: Xaa=Asn or Thr
  UNSURE 112: Xaa=Asn or Thr
MSQKQEEENPAEETGEEKQDTQEKEGILPERAEEAKLKAKYPSLGQKPGGSDFLMKRLQKGQKYFDSGDYNMAKAKMKNKQLPSAGPDKNLVTGDHIPXPQDLPQRKSSLVXSKLAGGQLND

SEQ ID NO: 5571 - protein, 125 aa, Homo sapiens
  UNSURE 85: Xaa=Asn or Tyr
  UNSURE 86: Xaa= *  or Leu or Ser or Trp
MEEKPSKVSLKSSDRQGSDEESVHSDTRDLWTTTTLSQAQLNMPLSEVCEGFDEEGRNISKTRGWHSPGRGSLDEGYKASHKPEXXTSTRWWSWSCTAAAPWKSIWGRRTLHPRSRPVSVASPGR

SEQ ID NO: 5572 - protein, 140 aa, Homo sapiens
  UNSURE 28: Xaa=Ala or Val
MAPIPKTVGRIKLDCSLRPSCPLEVAAXPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSL

SEQ ID NO: 5573 - protein, 51 aa, Homo sapiens
MKIPNIGNVMNKFEILGVVGEGAYGVVLKCRHKETHEIVAIKKFKDSEENE

SEQ ID NO: 5574 - protein, 78 aa, Homo sapiens
  UNSURE 43: Xaa=Lys or Asn
  UNSURE 45: Xaa=Gly or Ile or Ser or Val
  UNSURE 49: Xaa=Lys or Gln
MAAPSAGSWSTFQHKELMAADRGRRILGVCGMHPHHQEILKKXRXGASXTAVVERIVRTSSGEGHHHLGNEGAHPGQS

SEQ ID NO: 5575 - protein, 87 aa, Homo sapiens
MDLHLFDYSEPGNFSDISWPCNSSDCIVVDTVMCPNMPNKSVLLYTLSFIYIFIFVIGMIANSVVVWVNIQAKTTGYDTHCYILKPG

SEQ ID NO: 5576 - protein, 52 aa, Homo sapiens
MVYGASEAIGQHQSSAAKPRRSQSESLGPEFQGIWEWLPDWDTGLLLPLDSD

SEQ ID NO: 5577 - protein, 102 aa, Homo sapiens
MEEPQKSYVNTMDLERDEPLKSTGPQISVSEFSCHCCYDILVNPTTLNCGHSFCRHCLALWDAIEKLFPDAIRLRFEDIQQNNDIVQSLAAFQKYGNDQIPL

SEQ ID NO: 5578 - protein, 71 aa, Homo sapiens
MDDADPEERNYDNMLKMLSDLNKDLEKLLEEMEKISVQATWMAYDMVVMRTNPTLAESMRRLEDAFVNCKE

SEQ ID NO: 5579 - protein, 71 aa, Homo sapiens
MKQTEVLLQPNPNARIEEFVYEKLDRKAPSRINNPELLGQYMIDAGTEFGPGTAYGNALIKCGETQKRIGT

SEQ ID NO: 5580 - protein, 58 aa, Homo sapiens
MMHQIYSCSDENIEVFTTVIPSKVSSPARRRAKSSQHLLTKNVVIESDLYTHQPLELL

SEQ ID NO: 5581 - protein, 101 aa, Homo sapiens
  UNSURE 60: Xaa=Asp or Gly
MAEKFDHLEEHLEKFVENIRQLGIIVSDFQPSSQAGLNQKLNFIVTGLQDIDKCRQQLHXITVPLEVFEYIDQGRNPQLYTKECLERALAKNEQVKGKIDT

SEQ ID NO: 5582 - protein, 85 aa, Homo sapiens
MWSGRKLGSSGGWFLRVLGPGGCNTKAARPLISSAVYVKNQLSGTLQIKPGVFNEYRTIWFKSYRTIFSCLNRIKSFRYPWARLY

SEQ ID NO: 5583 - protein, 51 aa, Homo sapiens
  UNSURE 45: Xaa=Ile or Val
MNIDAKILNKILANRIQQHIKKLIHHDQVGFIPGMQGWFNIRKSXNVIQHI

SEQ ID NO: 5584 - protein, 199 aa, Homo sapiens
  UNSURE 14: Xaa= *  or Ala or Glu or Gly or Lys or Leu or Met or Pro or Gln or Arg or Ser or Thr or Val or Trp
MANRGPSYGLSREXQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNRELPGGHDRVRDAQADHV

SEQ ID NO: 5585 - protein, 199 aa, Homo sapiens
MANRGPSYGLSREVQEKIEQKYDADLENKLVDWIILQCAEDIEHPPPGRAHFQKWLMDGTVLCKLINSLYPPGQEPIPKISESKMAFKQMEQISQFLKAAETYGVRTTDIFQTVDLWEGKDMAAVQRTLMALGSVAVTKDDGCYRGEPSWFHRKAQQNRRGFSEEQLRQGQNVIGLQMGSNRELPGGHDRVRDAQADHV

SEQ ID NO: 5586 - protein, 90 aa, Homo sapiens
MWYHRLSHLHSRLQDLLKGGVIYPALPQPNFKSLLPLAVHWHHTASKSLTCAWQQHEDHFELKYANTVMRFDYVWLRDHCRSASCYNSKT

SEQ ID NO: 5587 - protein, 120 aa, Homo sapiens
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVS

SEQ ID NO: 5588 - protein, 68 aa, Homo sapiens
  UNSURE 5: Xaa=Glu or Gly or Lys or Arg
MLASXELTAKRRKQQKVWMWNLIQESVLEHFRTHPTVREQIPLLEQKVLIGALSPGLAADFLLKAFKS

SEQ ID NO: 5589 - protein, 132 aa, Homo sapiens
  UNSURE 116: Xaa=Ala or Asp or Glu
MNPSMKQKQEEIKENIKNSSVPRRTLKMIQPSASGSLVGRENELSAGLSKRKHRNDHLTSTTSSPGVIVPESSENKNLGGVTQESFDLMIKENPSSQYWKEVAEKRRKALYEALKXNEKLHKEIEQKDNEIA

SEQ ID NO: 5590 - protein, 132 aa, Homo sapiens; identical to SEQ ID NO: 5589
  UNSURE 116: Xaa=Ala or Asp or Glu

SEQ ID NO: 5591 - protein, 132 aa, Homo sapiens; identical to SEQ ID NO: 5589
  UNSURE 116: Xaa=Ala or Asp or Glu

SEQ ID NO: 5592 - protein, 92 aa, Homo sapiens
  UNSURE 2: Xaa=Cys or Arg
  UNSURE 29: Xaa=His or Gln
  UNSURE 34: Xaa=Ala or Val
  UNSURE 50: Xaa=Gly or Ser
  UNSURE 52: Xaa=Ala or Thr
  UNSURE 54: Xaa=Cys or Gly or Arg or Ser
  UNSURE 59: Xaa=His or Gln
  UNSURE 63: Xaa=Phe or Ile or Leu or Met
  UNSURE 64: Xaa=Ala or Asp or Gly or Val
  UNSURE 86: Xaa=Ala or Ser
MXHKNGFPQEGGITAAFLQKRKLRLSKNXRPARXKVTEHVRGTRPGSCHXRXGXFGRGXPGPXXLTDGETEARPAAEAPRTYPSNXNSPPRT

SEQ ID NO: 5593 - protein, 98 aa, Homo sapiens
MSAAEAGGVFHRARGRTLAAFPAEKESEWKGPFYFILGADPQFGLIKAWSTGDCDNGGDEWEQEIRLTEQAVQAINKLNPKPKFFVLCGDLIHAMPGK

SEQ ID NO: 5594 - protein, 69 aa, Homo sapiens
MAERKGTAKVDFLKKIEKEIQQKWDTERVFEVNASNLEKQTSKGKYFVTFPYPYMNGRLHLGHTFSLSK

SEQ ID NO: 5595 - protein, 126 aa, Homo sapiens
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASS

SEQ ID NO: 5596 - protein, 84 aa, Homo sapiens
MFAPAVMRAFRKNKTLGYGVPMLMDPELEKKLKENKISLESEYEKIKDSKFDDWKNIRGPRPWEDPDLLQGRIQKALRLRQLDS

SEQ ID NO: 5597 - protein, 98 aa, Homo sapiens
MGGCPVRKRRRNGSKEGNHHSTQPKRNKRNPIFQDSQDTEVFSWSDNERSSSRINIPERASGPEGNLNQIVTEPDANFPQFLHEGYVPCQGLYSHINQ

SEQ ID NO: 5598 - protein, 75 aa, Homo sapiens
  UNSURE 48: Xaa=Asp or Glu
  UNSURE 74: Xaa=Asn or Thr
MNLFNLDRFRFEKRNKIEEAPEATPQPSQPGPSSPISLSAEEENAEGXVSRANTPDSDITEKTEDSSVPETPDXE

SEQ ID NO: 5599 - protein, 136 aa, Homo sapiens
MAAPWASLRLVAPMWNGRIRGIHRLGAAVAPEGSQKKKRTILQFLTNYFYDVEALRDYLLQREMYKVHEKNRFRDKEWIRPDKYGHFSQEFWNFCEVPVEAVDAGDCDINYEGLDNLLRLKELQSLSLQRCSHVDD

SEQ ID NO: 5600 - protein, 99 aa, Homo sapiens
  UNSURE 88: Xaa=Asp or Glu
  UNSURE 89: Xaa=Gly or Arg
  UNSURE 99: Xaa=His or Ile or Lys or Leu or Met or Asn or Pro or Gln or Arg or Ser or Thr
MEGAGYRVVFEKGGVYLHTSAKKYQDRDSLIAGVIRVVEKDNDVLLHWAPVEEAGDSTQILFSKKDSSGGDSCASEEEPTFDPGYEPXXAVISTVRPQX

SEQ ID NO: 5601 - protein, 54 aa, Homo sapiens
MATEEFIIRIPPYHYIHVLDQNSNVSRVEVGPKTYIRQDNERVLFAPMRMVTVP

SEQ ID NO: 5602 - protein, 96 aa, Homo sapiens
  UNSURE 30: Xaa=Asp or Asn
MKEAKDARYTNGHLFTTISVSGMTMCYACXKSITAKEALICPTCNVTIHNRCKDTLANCTKVKQKQQKAALLKNNTALQSVSLRSKTTIRERPSSA

SEQ ID NO: 5603 - protein, 66 aa, Homo sapiens
MTGKAKTREKEKMKEAKDARYTNGHLFTTISVSGMTMCYACNKSITAKEALICPTCNVTIHNRCKD

SEQ ID NO: 5604 - protein, 131 aa, Homo sapiens
MGPLPRTVELFYDVLSPYSWLGFEILCRYQNIWNINLQLRPSLITGIMKDSGNKPPGLLPRKGLYMANDLKLLRHHLQIPIHFPKDFLSVMLEKGSLSAMRFLTAVNLEHPEMLEKASRELWMRVWSRNED

SEQ ID NO: 5605 - protein, 61 aa, Homo sapiens
  UNSURE 60: Xaa=Ile or Met
  UNSURE 61: Xaa=His or Ile or Leu or Asn
MKSCQKMEGKPENESEPKHEEEPKPEEKPEEEEKLEEEAKAKGTFRERLIQSLQEFKEDXX

SEQ ID NO: 5606 - protein, 66 aa, Homo sapiens
MTEKEVLESPKPSFPAETRQSGRLKQLLRKGSTGTKEMELPPEPQANGEAVGAGGGPIYYIYEEEE

SEQ ID NO: 5607 - protein, 94 aa, Homo sapiens
MSLRRHIGNPEYLMKRIPQNPRYQHIKSRLDTGNSMTKYTEKLEEIKKNYRYKKDELFKRLKVTTFAQLIIQVASLSDQTLEVTAEEIQRLEDN

SEQ ID NO: 5608 - protein, 122 aa, Homo sapiens
  UNSURE 104: Xaa=Lys or Gln
MCFSRADAADNYPFGTCQQRKLFPHFHPPNLIGNKFVPLRGSPHRGPGCYFSDGYGLAYDLSKIPTSIKGYTLGARTAVRFKPIQKEMTPHAGRYQNVSPQQEXHKQNFAPFNVLVPRFKNY

SEQ ID NO: 5609 - protein, 62 aa, Homo sapiens
  UNSURE 10: Xaa=Cys or Phe or Ser or Tyr
MAAETQTLNXGPEWLRALSSGGSITSPPLSPALPKYKLADYRYGREEMLALFLKDNKIPSDL

SEQ ID NO: 5610 - protein, 126 aa, Homo sapiens
MASHRHSGPSSYKVGTMAEKFDCHYCRDPLQGKKYVQKDGHHCCLKCFDKFCANTCVECRKPIGADSKEVHYKNRFWHDTCFRCAKCLHPLANETFVAKDNKILCNKCTTREDSPKCKGCFKAIVT

SEQ ID NO: 5611 - protein, 104 aa, Homo sapiens
  UNSURE 23: Xaa= *  or Cys or Phe or Leu or Trp
  UNSURE 54: Xaa=Asp or His or Asn or Tyr
  UNSURE 59: Xaa=His or Arg
  UNSURE 103: Xaa= *  or Gly or Arg
MASHRHSGPSSYKVGTMAEKFDXPLLQGSLAGEEVCAKGWPPLQALREVQQGHXIWRNXLPGSALACRLLCVCYLIRSWLGSVSPLWRTSITAWIATRTLWPXS

SEQ ID NO: 5612 - protein, 73 aa, Homo sapiens
MNKLFSFWKRKNETRSQGYNLREKDLKKLHRAASVGDLKKLKEYLQIKKYDVNMQDKKYSVVQSSRWLLSYTT

SEQ ID NO: 5613 - protein, 60 aa, Homo sapiens
MAGNFWQSSHYLQWILDKQDLLKERQKDLKFLSEEEYWKLQIFFTNVIQALGEHLKLRQQ

SEQ ID NO: 5614 - protein, 89 aa, Homo sapiens
  UNSURE 79: Xaa=Lys or Arg
MEFLLGNPFSTPVGQCLEKATDGSLQSEDWTLNMEICDIINETEEGPKDAIRALKKRLNGNRNYREVMLALTVLETCVXNCGHRFHILV

SEQ ID NO: 5615 - protein, 79 aa, Homo sapiens
MWDSTINLASSHCFSSRTCRKSFRLCAGSCGCPWNGRGSPVFPLGYQYPSLDQLADMIPCVLQYLNFSTIIGVVLELEP

SEQ ID NO: 5616 - protein, 92 aa, Homo sapiens
  UNSURE 3: Xaa=Asp or Glu
  UNSURE 91: Xaa=Asn or Thr
MAXCRRCRSQRRSHCCQDRRLRRPRLTLWRHHTALSLSLSMAPPNPNAQRSLPTTMWDSTINLASSHCFSSRTCRKSFRTLCGFNVDAPGXG

SEQ ID NO: 5617 - protein, 97 aa, Homo sapiens
MVVSKMNKDAQMRAAINQKLIETGERERLKELLRAKLIECGWKDQLKAHCKEVIKEKGLEHVTVDDLVAEITPKGRALVPDSVKKELLQRIRTFLAQ

SEQ ID NO: 5618 - protein, 92 aa, Homo sapiens
  UNSURE 41: Xaa= *  or Leu or Ser or Trp
MNKDAQMRAAINQKLIETGERERLKELLRAKLIECGWKDQXKAHCKEVIKEKGLEHVTVDDLVAEITPKGRALVPDSVKKELLQRIRTFLAQ

SEQ ID NO: 5619 - protein, 117 aa, Homo sapiens
MVVSYARGPQGRDPGPAQAPFDVSKMNKDAQMRAAINQKLIETGERERLKELLRAKLIECGWKDQLKAHCKEVIKEKGLEHVTVDDLVAEITPKGRALVPDSVKKELLQRIRTFLAQ

SEQ ID NO: 5620 - protein, 156 aa, Homo sapiens
  UNSURE 142: Xaa=Ala or Asp or Gly or Val
MASGGSGGVSVPALWSEVNRYGQNGDFTRALKTVNKILQINKDDVTALHCKVVCLIQNGSFKEALNVINTHTKVLANNSLSFEKAYCEYRLNRIENALKTIESANQQTDKLKELYGQVLYRLERYDECLAVYRDLVRNSQDXMMRRGKQTFSSCCS

SEQ ID NO: 5621 - protein, 61 aa, Homo sapiens
MCCEKWSRVAEMFLFTEEREDCKILCLCSRAFVEDRKLYNLGLKGYYIRDSGNNSGDQATE

SEQ ID NO: 5622 - protein, 146 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADR

SEQ ID NO: 5623 - protein, 69 aa, Homo sapiens
MAELIQKKLQGEVEKYQQLQKDLSKSMSGRQKLEAQLTENNIVKEELALLDGSNVVFKLLGPVLVKQEL

SEQ ID NO: 5624 - protein, 77 aa, Homo sapiens
  UNSURE 33: Xaa=Ser or Thr
  UNSURE 34: Xaa= *  or Leu
  UNSURE 35: Xaa=Ala or Pro or Ser or Thr
  UNSURE 47: Xaa=Lys or Gln
MAAPCLLRQGRAGALKTMLQEAQVFRGLASTVXXXAESGKSEKGQPXNSKKQSPPKKPAPVPAEPFDNTTYKNLQHH

SEQ ID NO: 5625 - protein, 83 aa, Homo sapiens
MANVLCNRARLVSYLPGFCSLVKRVVNPKAFSTAGSSGSDESHVAAAPPDICSRTVWPDETMGPFGPQDQRFQLPGNIGFDCH

SEQ ID NO: 5626 - protein, 54 aa, Homo sapiens
MYSYMTEEKTWRRGGSSCDRGGREWSNVIINQGMLTATKAGEGQGQIFNPPVEV

SEQ ID NO: 5627 - protein, 60 aa, Homo sapiens
MAQESPKNSAAEIPVTSNGEVDDSREHSFNRDLKHSLPSGLGLSETQITSHGFDNTKEGV

SEQ ID NO: 5628 - protein, 60 aa, Homo sapiens
MSGTLEKVLCLRNNTIFKQAFSLLRFRTSGEKPIYSVGGILLSISRPYKTKPTHGIGKYK

SEQ ID NO: 5629 - protein, 56 aa, Homo sapiens
MMEQRSRDPGMVRSPQNQYPAELMRRFELYFQGPSSNKPRVIREVRADSVGKLVTV

SEQ ID NO: 5630 - protein, 122 aa, Homo sapiens
MYHNSSQKRHWTFSSEEQLARLRADANRKFRCKAVANGKVLPNDPVFLEPHEEMTLCKYYEKRLLEFCSVFKPAMPRSVVGTACYFKRFYLNNSVMEYHPRIIMLTCAFLACKVDEFNVSSP

SEQ ID NO: 5631 - protein, 99 aa, Homo sapiens
MAVQVVQAVQAVHLESDAFLVCLNHALSTEKEEVMGLCIGELNDDTRSDSKFAYTGTEMRTVAEKVDAVRIVHIHSVIILRRSDKRKDRVEISPEQLSA

SEQ ID NO: 5632 - protein, 64 aa, Homo sapiens
  UNSURE 7: Xaa=Lys or Thr
  UNSURE 8: Xaa=Leu or Trp
  UNSURE 10: Xaa= *  or Ser or Tyr
  UNSURE 13: Xaa= *  or Lys
MKYVLLXXPXSLXKVLCIRVKDYILPGAKHGASCKQAAFLLGETDNLKGLLCQKHSQLHHQPFP

SEQ ID NO: 5633 - protein, 114 aa, Homo sapiens
MASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPSST

SEQ ID NO: 5634 - protein, 121 aa, Homo sapiens
  UNSURE 104: Xaa=Lys or Arg
  UNSURE 116: Xaa=Ile or Thr
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLXNLQLDYVDLYLXHFPVS

SEQ ID NO: 5635 - protein, 105 aa, Homo sapiens
  UNSURE 53: Xaa=Met or Val
MSTAGKVIKCKAAVLWEVKKPFSIEDVEVAPPKAYEVRIKMVAVGICRTDDHXVSGNLVTPLPVILGHEAAGIVESVGEGVTTVKPGTGFTLREHVWFTIQDFPA

SEQ ID NO: 5636 - protein, 148 aa, Homo sapiens
  UNSURE 134: Xaa=Asp or His or Asn or Tyr
  UNSURE 135: Xaa=Leu or Val
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYXXIFFFGSDFENYIK

SEQ ID NO: 5637 - protein, 141 aa, Homo sapiens
  UNSURE 68: Xaa=Lys or Asn
METSAPRAGSQVVATTARHSAAYRADPLRVSSRDKLTEMAASSQGNFEGNFESLDLAEFAKKQPWWRXCSGRNLDLQQKSIAWQPSCSLEVSLDGAQVSYSRRLESWLQQLWEVDFFSFRSVCEMFSDVWKFHLPIKECGV

SEQ ID NO: 5638 - protein, 91 aa, Homo sapiens
  UNSURE 19: Xaa=Ala or Cys or Asp or Phe or Gly or Ser or Val or Tyr
  UNSURE 26: Xaa=Cys or Ser
MIGSFLRPPQPCGTDNLPXDDFQESXAMMWQKYAGSRRSMPLGARILFHGVFYAGGFAIVYYLIQKFHSRALYYKLAVEQLQSHPEAQEAL

SEQ ID NO: 5639 - protein, 91 aa, Homo sapiens
MSERKVLNKYYPPDFDPSKIPKLKLPKDRQYVVRLMAPFNMRCKTCGEYIYKGKKFNARKETVQNEVYLGLPIFRFYIKCTRCLAEITFKT

SEQ ID NO: 5640 - protein, 73 aa, Homo sapiens
  UNSURE 62: Xaa=Met or Val
MEPEQMLEGQTQVAENPHSEYGLTDNVERIVENEKINAEKSSKQKVDLQSLPTRAYLDQTVXPILLQGLAVAC

SEQ ID NO: 5641 - protein, 104 aa, Homo sapiens
MPDHGGFVWGLTFVTIKIISQEVQLLQVGKRENPTIQLHLLSIFHIKMMFATLLITIHIRIQLYRCIFKNWNQHTILSKSIFGKMCYVKPCLEQLPLGDYNSNA

SEQ ID NO: 5642 - protein, 129 aa, Homo sapiens
  UNSURE 12: Xaa=Ala or Val
  UNSURE 103: Xaa=Asp or Glu or Gly
  UNSURE 114: Xaa=Ala or Asp or Glu or Gly or Val
  UNSURE 115: Xaa=Phe or Ile or Leu or Val
  UNSURE 116: Xaa=Phe or Leu
MTLLEPEMLMMXVQSVLQLKLQQRRTREELVSQGIMPPLKSPAAFHEQRRSLERARTEDYLKRKIRSRPERSELVRMHILEETSAEPSLQAKQLKLKRARLAXDLNEKIAQRPXXXELVEKNILPVESS

SEQ ID NO: 5643 - protein, 89 aa, Homo sapiens
MEAVATATAAKEPDKGCIEPGPGHWGELSRTPVPSKPQDKVEAAEATPVALDSDTSGAENAAVSAMLHAVAASRLPVCSQQQGEPDLTE

SEQ ID NO: 5644 - protein, 78 aa, Homo sapiens
  UNSURE 11: Xaa=Ala or Gly
  UNSURE 16: Xaa=Asp or His or Asn or Tyr
  UNSURE 17: Xaa=Pro or Ser
  UNSURE 18: Xaa=Glu or Lys
MGEEATSRTLXSDSVXXXDRSDSRAAQPAHDSGHGDDESPSTSSGTAGTSSVPELPGFYFDPEKKRYFRLLPGHNNCN

SEQ ID NO: 5645 - protein, 56 aa, Homo sapiens
MDWLNVFKDFFSIGKVKRKPSVPDSASPADDSFVDPGERLYDLNMPAYVKFNYMAD

SEQ ID NO: 5646 - protein, 132 aa, Homo sapiens
  UNSURE 7: Xaa=Asp or Glu
  UNSURE 15: Xaa=Ala or Asp or Glu
  UNSURE 28: Xaa=Asp or Glu
  UNSURE 29: Xaa=Pro or Thr
MQNDTAXNETTEKEXKSESRQERYEIEXXETVTKSYQKNDWRDAEENKKEDKEKEEEEEEKPKRGSIGENQVEVMVEEKTTESQEETVVMSLKNGQISSEEPKQEEEREQGSDEISHHEKMEEEDKERAEAE

SEQ ID NO: 5647 - protein, 106 aa, Homo sapiens
MSDKSELKAELERKKQRLAQIREEKKRKEEERKKKETDQKKEAVAPVQEESDLEKKRREAEALLQSMGLTPESPIVPPPMSPSSKSVSTPSEAGSKTLEMAPWDLD

SEQ ID NO: 5648 - protein, 166 aa, Homo sapiens
  UNSURE 92: Xaa=Asp or Glu
  UNSURE 94: Xaa=Asp or Glu or Gly
  UNSURE 126: Xaa=His or Arg
MTLYSYGMLLPCGVDQFHGTEYVCCPQTKIIGSVSKEEEEEDEEEEEEEDEEEDYDVYKSEFPTEADLEDFTEAAVDEDDEDEEEGEEVVEXRXYYYDTFKGDDYNEENPTEPGSDGTMSDKEITXDVKAVCSQEAMTGPCRAVMPRWYFDLSKGKCVRFIYGGCG

SEQ ID NO: 5649 - protein, 66 aa, Homo sapiens
  UNSURE 60: Xaa=Ala or Glu or Gly or Val
MTQPPASTSGIMGTLSSWNLKILQINQLHLVHWNAVKFENFEDAALEENGLAVIGVFLKXNSQSPL

SEQ ID NO: 5650 - protein, 130 aa, Homo sapiens
  UNSURE 107: Xaa=Lys or Asn
MQLFVRAQELHTFEVTGQETVAQIKAHVASLEGIAPEDQVVLLAGAPLEDEATLGQCGVEALTTLEVAGRMLGGKVHGSLARAGKVRGQTPKVAKQEKKKKKTGRAXRRMQYNRRFVNVVPPLARRRAQC

SEQ ID NO: 5651 - protein, 95 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGF

SEQ ID NO: 5652 - protein, 148 aa, Homo sapiens
  UNSURE 39: Xaa=Asp or Glu
MAVTGWLESLRTAQKTALLQDGRRKVHYLFPDGKEMAEXYDEKTSELLVRKWRVKSALGAMGQWQLEVGDPAPLGAGNLGPELIKESNANPIFMRKDTKMSFQWRIRNLPYPKDVYSVSVDQKERCIIVRTTNKKYYKKFSIPDLDRH

SEQ ID NO: 5653 - protein, 161 aa, Homo sapiens
MLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVE

SEQ ID NO: 5654 - protein, 88 aa, Homo sapiens
MGDTSEDASIHRLEGTDLDCQVGGLICKSKSAASEQHVFKAPAPRPSLLGLDLLASLKRREREEKDDGEDKKKSKVSSYKDWEESKDD

SEQ ID NO: 5655 - protein, 105 aa, Homo sapiens
  UNSURE 43: Xaa=Ile or Met
MAAMAVGGAGGSRVSSGRDLNCVPEIADTLGAVAKQGFDFLCXPVFHPRFKREFIQEPAKNRPGPQTRSDLLLSGRDWNTLIVGKLSPWIRPDSKVEKIRRNSEA

SEQ ID NO: 5656 - protein, 76 aa, Homo sapiens
  UNSURE 66: Xaa=Glu or Lys
MALSTIVSQRKQIKRKAPRGFLKRVFKRKKPQLRLEKSGDLLVHLNCLLFVHRLAEESRTNACASXCRVINKEHVL

SEQ ID NO: 5657 - protein, 61 aa, Homo sapiens
MVRTKADSVPGTYRKVVAARAPRKVLGSSTSATNSTSVSSRKAENKYAGGNPVCVRPTPKW

SEQ ID NO: 5658 - protein, 60 aa, Homo sapiens
  UNSURE 38: Xaa=Cys or Ser
  UNSURE 51: Xaa=Cys or Gly or Arg or Ser
MNLLPKSSREFGSVDYWEKFFQQRGKKAFEWYGPTWNXAGCYINISSQGKXAGDWVWHSE

SEQ ID NO: 5659 - protein, 126 aa, Homo sapiens
  UNSURE 49: Xaa=Glu or Gly
  UNSURE 110: Xaa=Glu or Lys
MSHLPMKLLRKKIEKRNLKLRQRNLKFQGASNLTLSETQNGDVSEETMXSRKVKKSKQKPMNVGLSETQNGGMSQEAVGNIKVTKSPQKSTVLTNGEAAMQSSNSESKKXKKKKRKMVNDAEPDTK

SEQ ID NO: 5660 - protein, 56 aa, Homo sapiens
  UNSURE 4: Xaa=Lys or Met
MDAXASPGKDNYRMKSYKNKALNPQEMRRRREEEGIQLRKQKREEQLFKRRNVYLP

SEQ ID NO: 5661 - protein, 103 aa, Homo sapiens
  UNSURE 47: Xaa=Ser or Thr
MEQPGQDPTSDDVMDSFLEKFQSQPYRGGFHEDQWEKEFEKVPLFMXRAPSEIDPRENPDLACLQSIIFDEERSPEEQAKTYKDEGNDYFKEKDYKKAVISYT

SEQ ID NO: 5662 - protein, 75 aa, Homo sapiens
MVSSQKLEKPIEMGSSEPLPIADGDRRRKKKRRGRATDSLPGKFEDMYKLTSELLGEGAYAKVQGAVSLQNGKEY

SEQ ID NO: 5663 - protein, 135 aa, Homo sapiens
  UNSURE 102: Xaa=Lys or Thr
  UNSURE 105: Xaa= *  or Lys or Leu or Met
MYVIDQYMLHLLQDLANKITELYKQYDFGKVVRLLRTFYTRELSNFYFSIIKDRLYCEKENDPKRRSCQTALVEILDVIVRSFAPILPHLAEEVFQHIPYIXEPXSVFRTGRISTSSIWEKPGLEEAVESACAMR

SEQ ID NO: 5664 - protein, 116 aa, Homo sapiens
MSFLKSFPPPGPAEGLLRQQPDTEAVLNGKGLGTGTLYIAESRLSWLDGSGLGFSLEYPTISLHALSRDRSDCLGEHLYVMVNAKFEEESKEPVADEEEEDSDDDVEPITEFRFVP

SEQ ID NO: 5665 - protein, 84 aa, Homo sapiens
MELTQPAEDLIQTQQTPASELGDPEDPGEEAADGSDTVVLSLFPCTPEPVNPEPDASVSSPQGSSLKHSTTLTNRQRGNEVSAL

SEQ ID NO: 5666 - protein, 59 aa, Homo sapiens
MVKPKYKGRSTINPSKASTNPDRVQGAGGQNMRDRATIRRLNMYRQKERRNSRGKIIKP

SEQ ID NO: 5667 - protein, 80 aa, Homo sapiens
  UNSURE 25: Xaa=Cys or Arg
  UNSURE 26: Xaa=Gly or Arg
  UNSURE 66: Xaa=Ala or Gly
MSSNECFKCGRSGHWARECPTGGGXXRGMRSRGRGFQFVSSSLPDICYRCGESGHLAKDCDLQEDXKYLTLPFHTPLELG

SEQ ID NO: 5668 - protein, 70 aa, Homo sapiens
  UNSURE 26: Xaa=Gly or Arg
MSSNECFKCGRSGHWARECPTGGGRXRGMRSRGRGFQFVSSSLPDICYRCGESGHLAKDCDLQEDAAITA

SEQ ID NO: 5669 - protein, 69 aa, Homo sapiens
MHVIKRDGRQERVMFDKITSRIQKLCYGLNMDFVDPAQITMKVIQGLYSGVTTVELDTLAAETAATLTT

SEQ ID NO: 5670 - protein, 134 aa, Homo sapiens
  UNSURE 12: Xaa=Leu or Pro
  UNSURE 68: Xaa= *  or Ala or Glu or Gly or Ile or Lys or Leu or Pro or Gln or Arg or Ser or Thr or Val
  UNSURE 69: Xaa=Cys or Ser
  UNSURE 75: Xaa=Pro or Arg
  UNSURE 76: Xaa=Ile or Val
  UNSURE 81: Xaa=Lys or Arg
  UNSURE 87: Xaa=Ala or Pro or Ser or Thr
MDRRNDYGYRVXLFQGPLPPPGSLGLPFPPDIQTETTEEDSVLLMHTLLAATKDSLAMDPPVVNRPKXXKTKKAXXKTITXAAPAAXPVPAANEIATNKPKITWQALNLPVITQISQALPTTEVTNTQASSVTA

SEQ ID NO: 5671 - protein, 235 aa, Homo sapiens
  UNSURE 70: Xaa=His or Tyr
  UNSURE 113: Xaa=Leu or Pro
  UNSURE 169: Xaa= *  or Ala or Glu or Gly or Ile or Lys or Leu or Pro or Gln or Arg or Ser or Thr or Val
  UNSURE 170: Xaa=Cys or Ser
  UNSURE 176: Xaa=Pro or Arg
  UNSURE 177: Xaa=Ile or Val
  UNSURE 182: Xaa=Lys or Arg
  UNSURE 188: Xaa=Ala or Pro or Ser or Thr
MDRRNDYGYRVPLFQGPLPPPGSLGLPFPPDIQTETTEEDSVLLMHTLLAATKDSLAMDPPVVNRPKKRXKERLGESRRLLDSRRRGPFPSGSPVTRPPRKMDRRNDYGYRVXLFQGPLPPPGSLGLPFPPDIQTETTEEDSVLLMHTLLAATKDSLAMDPPVVNRPKXXKTKKAXXKTITXAAPAAXPVPAANEIATNKPKITWQALNLPVITQISQALPTTEVTNTQASSVTA

SEQ ID NO: 5672 - protein, 85 aa, Homo sapiens
MLTNLRIFAMSHQTIPSVYINNICCYKIRASLKRLKPHVPLGRNCSSLPGLIGNDIKSLHSIINPPIAKIRNIGIMAHIDAGKTT

SEQ ID NO: 5673 - protein, 118 aa, Homo sapiens
  UNSURE 37: Xaa=Ile or Thr
  UNSURE 101: Xaa=Asp or Glu
  UNSURE 109: Xaa=Pro or Thr
MNLELLESFGQNYPEEADGTLDCISMALTCTFNRWGXLLAVGCNDGRIVIWDFLTRGIAKIISAHIHPVCSLCWSRDGHKLVSASTDNIVSQWDVLSGDCXQRFRFPSXILKVQYHPR

SEQ ID NO: 5674 - protein, 64 aa, Homo sapiens
  UNSURE 57: Xaa=Asp or Glu
MEPEEGTPLWRLQKLPAELGPQLLHKIIDGICGRAYPVYQDYHTVWESEEWMHVLEXIAKFFKA

SEQ ID NO: 5675 - protein, 92 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHL

SEQ ID NO: 5676 - protein, 146 aa, Homo sapiens
MATGLSEHHNMVWEVKTNQMPNAVQKLLLVMDKRASGMNDSLELLQCNENLPSSPGYNSCDEHMELDDLPELQAVQSDPTQSGMYQLSSDVSHQEYPRSSWNQNTSDIPETTYRENEVDWLTELANIATSPQSPLMQCSFYNRSSP

SEQ ID NO: 5677 - protein, 106 aa, Homo sapiens
MAAPPEPGEPEERKSLKLLGFLDVENTPCARHSILYGSLGSVVAGFGHFLFTSRIRRSCDVGVGGFILVTLGCWFHCRYNYAKQRIQERIAREEIKKKILYEGTHL

SEQ ID NO: 5678 - protein, 120 aa, Homo sapiens
  UNSURE 48: Xaa=Arg or Ser
  UNSURE 112: Xaa=Lys or Gln
  UNSURE 115: Xaa=Gly or Ser
MDFSKLPKILDEDKESTFGYVHGVSGPVVTACDMAGAAMYELVRVGHXELVGEIIRLEGDMATIQVYEETSGVSVGDPVLRTGKPLSVELGPGIMGAIFDGIQRPLSDISSXTQXIYIPR

SEQ ID NO: 5679 - protein, 152 aa, Homo sapiens
MALGPRCGAIRACRRVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEV

SEQ ID NO: 5680 - protein, 57 aa, Homo sapiens
  UNSURE 44: Xaa=Ala or Asp
  UNSURE 45: Xaa=Lys or Gln
MASCLATAPHQLGFGLCPQLLPDDQRDGQHLDSLPAHLVRGGSXXAAALSSEGVPGG

SEQ ID NO: 5681 - protein, 87 aa, Homo sapiens
MLSLKLPQLLQVHQVPRVFWEDGIMSGYRRPTSSALDCVLSSFQMTNETVNIWTHFLPTCFLELESPGLSKSPPAQEPSPIQFLFDN

SEQ ID NO: 5682 - protein, 57 aa, Homo sapiens; identical to SEQ ID NO: 5680
  UNSURE 44: Xaa=Ala or Asp
  UNSURE 45: Xaa=Lys or Gln

SEQ ID NO: 5683 - protein, 87 aa, Homo sapiens; identical to SEQ ID NO: 5681

SEQ ID NO: 5684 - protein, 99 aa, Homo sapiens
  UNSURE 60: Xaa=Lys or Asn
  UNSURE 96: Xaa=Cys or Phe or Gly or Ile or Leu or Arg or Ser or Val
  UNSURE 97: Xaa=Ile or Met
  UNSURE 98: Xaa= *  or Glu or Lys or Gln
MPADLSGTWTLLSSDNFEGYMLALGIDFATRKIAKLLKPQKVIEQNGDSFTIHTNSSLRXYFVKFKVGEEFDEDNRGLDNRKCKSLVIWDNDRLTXXXK

SEQ ID NO: 5685 - protein, 79 aa, Homo sapiens
MEGERKNNNKRWYFTREQLENSPSRRFGVDPDKELSYRQQAANLLQDMGQRLNVSQLTINTAIVYMHRFYMIQSFTQFP

SEQ ID NO: 5686 - protein, 67 aa, Homo sapiens
  UNSURE 51: Xaa=Glu or Gln
MFLTAVNPQPLSTPSWQIETKYSTKVLTGNWMEERRKFTRDTDKDTPIHLXKRIHPLPRPQTRPDLQ

SEQ ID NO: 5687 - protein, 60 aa, Homo sapiens
  UNSURE 49: Xaa=Ile or Lys or Met or Arg or Thr
  UNSURE 52: Xaa=Asp or Gly
MLVLFETSVGYAIFKVLNEKKLQEVDSLWKEFETPEKANKIVKLKHFEXFQXTAEALAAS

SEQ ID NO: 5688 - protein, 109 aa, Homo sapiens
MPNWGGGKKCGVCQKTVYFAEEVQCEGNSFHKSCFLCMVCKKNLDSTTVAVHGEEIYCKSCYGKKYGPKGYGYGQGAGTLSTDKGESLGIKHEEAPGHRPPPTPMHPNL

SEQ ID NO: 5689 - protein, 53 aa, Homo sapiens
MEIGDHFQNILRSPLSRQGGLREIRDDFQFSGLENGVTSQFRFWREDVWFWTC

SEQ ID NO: 5690 - protein, 77 aa, Homo sapiens
MSVAFAAPRQRGKGEITPAAIQKMLDDNNHLIQCIMDSQNKGKTSECSQYQQMLHTNLVYLATIADSNQNMQSLLPA

SEQ ID NO: 5691 - protein, 86 aa, Homo sapiens
  UNSURE 35: Xaa=Ala or Gly or Val
  UNSURE 63: Xaa= *  or Ala or Glu or Gly or Ile or Lys or Leu or Pro or Gln or Arg or Ser or Thr or Val
MRQMIRSFSEPFGRDLLSISDGRGRAHNRRGHNDXEDSLTHTDVSSFQTMDQMVSNMRNYMQXLERNFGQLSVDPNGHSFCSSSVM

SEQ ID NO: 5692 - protein, 86 aa, Homo sapiens; identical to SEQ ID NO: 5691
  UNSURE 35: Xaa=Ala or Gly or Val
  UNSURE 63: Xaa= *  or Ala or Glu or Gly or Ile or Lys or Leu or Pro or Gln or Arg or Ser or Thr or Val

SEQ ID NO: 5693 - protein, 111 aa, Homo sapiens
  UNSURE 60: Xaa=Ala or Gly or Val
  UNSURE 88: Xaa= *  or Ala or Glu or Gly or Ile or Lys or Leu or Pro or Gln or Arg or Ser or Thr or Val
MFRMLNSSFEDDPFFSESILAHRENMRQMIRSFSEPFGRDLLSISDGRGRAHNRRGHNDXEDSLTHTDVSSFQTMDQMVSNMRNYMQXLERNFGQLSVDPNGHSFCSSSVM

SEQ ID NO: 5694 - protein, 86 aa, Homo sapiens
  UNSURE 18: Xaa=Arg or Ser
  UNSURE 23: Xaa=Ile or Arg
  UNSURE 35: Xaa=Ala or Gly or Val
  UNSURE 63: Xaa= *  or Ala or Glu or Gly or Ile or Lys or Leu or Pro or Gln or Arg or Ser or Thr or Val
MRQMIRSFSEPFGRDLLXISDGXGRAHNRRGHNDXEDSLTHTDVSSFQTMDQMVSNMRNYMQXLERNFGQLSVDPNGHSFCSSSVM

SEQ ID NO: 5695 - protein, 141 aa, Homo sapiens
MAAAAARVVLSSAARRRLWGFSESLLIRGAAGRSLYFGENRLRSTQAATQVVLNVPETRVTCLESGLRVASEDSGLSTCTVGLWIDAGSRYENEKNNGTAHFLEHMAFKGTKKRSQLDLELEIENMGAHLNAYTSREQTVY

SEQ ID NO: 5696 - protein, 147 aa, Homo sapiens
  UNSURE 138: Xaa=Ile or Asn
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGXLRQITVNDL

SEQ ID NO: 5697 - protein, 153 aa, Homo sapiens
  UNSURE 141: Xaa= *  or Glu or Lys or Gln
MADGGAASQDESSAAAAAAADSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAXQQLLLQQAQAQA

SEQ ID NO: 5698 - protein, 112 aa, Homo sapiens
  UNSURE 39: Xaa=Leu or Arg
MAEAATGFLEQLKSCIVWSWTYLWTVWFFIVLFLVYILXVPLKINDNLSTVSMFLNTLTPKFYVALTGTSSLISGLILIFEWWYFRKYGTSFIEQVSVSHLRPLLGGVDNNS

SEQ ID NO: 5699 - protein, 124 aa, Homo sapiens
  UNSURE 50: Xaa=Asp or Asn
  UNSURE 77: Xaa= *  or Cys or Phe or Leu or Ser or Trp or Tyr
  UNSURE 91: Xaa= *  or Cys or Gly or Arg or Ser
MTTTTTFKGVDPNSRNSSRVLRPPGGGSNFSLGFDEPTEQPVRKNKMASXIFGTPEENQASWAKSAGAKSSGGREDXESSGLQRRNSSEAXSGDFLDLKGEGDIHENVDTDLPGSLGQSEEKPC

SEQ ID NO: 5700 - protein, 80 aa, Homo sapiens
  UNSURE 62: Xaa= *  or Trp
MAAESLPFSFGTLSSWELEAWYEDLQEVLSSDENGGTYVSPPGNEEEESKIFTTLDPASLAXLTEEEPEPAEVTSTSQSP

SEQ ID NO: 5701 - protein, 98 aa, Homo sapiens
  UNSURE 74: Xaa= *  or Glu or Lys or Gln
  UNSURE 82: Xaa=His or Ile or Leu or Asn
MAALTTLFKYIDENQDRYIKKLAKWVAIQSVSAWPEKRGEIRRMMEVAAADVKQLGGSVELVDIGKQKLPDGSXIPLPPILXGRLGSDPQKKTVCIYG

SEQ ID NO: 5702 - protein, 98 aa, Homo sapiens; identical to SEQ ID NO: 5701
  UNSURE 74: Xaa= *  or Glu or Lys or Gln
  UNSURE 82: Xaa=His or Ile or Leu or Asn

SEQ ID NO: 5703 - protein, 79 aa, Homo sapiens
MKVNRETKRLYVGGLSQDISEADLQNQFSRFGEVSDVEIITRKDDQGNPQKVFAYINISVAEADLKKCMSVLNKTKWKG

SEQ ID NO: 5704 - protein, 107 aa, Homo sapiens
  UNSURE 95: Xaa=Lys or Asn
MDMTWEKRLAKKYYDKLFKEYCIADLSKYKENKFGFRWRVEKEVISGKGQFFCGNKYCDKKEGLKSWEVNFGYIEHGEKRNALVKLRLCQECSIXVKFPSQEKEIKS

SEQ ID NO: 5705 - protein, 55 aa, Homo sapiens
MADEIAKAQVARPGGDTIFGKIIRKEIPAKIIFEDDRVGTGHHLSRLLSALLSMT

SEQ ID NO: 5706 - protein, 137 aa, Homo sapiens
MVRSGNKAAVVLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTD

SEQ ID NO: 5707 - protein, 129 aa, Homo sapiens
  UNSURE 89: Xaa=Ile or Met
MSGFSPELIDYLEGKISFEEFERRREERKTREKKSLQEKGKLSAEENPDDSEVPSSSGINSTKSQDKDVNEGETSDGVRKSVHKVFASXLGENEDDEEEEEEEEEEEEEEETPEQPTAGDVFVLEMVLN

SEQ ID NO: 5708 - protein, 83 aa, Homo sapiens
  UNSURE 44: Xaa=Leu or Met or Val
  UNSURE 74: Xaa=Ala or Pro or Ser or Thr
MRLSALLALASKVTLPPHYRYGMSPPGSVADKRKNPPWIRRRPXVVEPISDEDWYLFCGDTVEILEGKDAGKQXKWFKLSGSE

SEQ ID NO: 5709 - protein, 113 aa, Homo sapiens
MDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPP

SEQ ID NO: 5710 - protein, 108 aa, Homo sapiens
MAAVVAVCGGLGRKKLTHLVTAAVSLTHPGTHTVLWRRGCSQQVSSNEDLLLSQFVSPFTGCIYGRHITGLCGKKQKEITKAIKRAQIMGFMPVTYKDPAYLKDPKVC

SEQ ID NO: 5711 - protein, 136 aa, Homo sapiens
MAAVVAVCGGLGRKKLTHLVTAAVSLTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVC

SEQ ID NO: 5712 - protein, 82 aa, Homo sapiens
  UNSURE 73: Xaa=Lys or Met
  UNSURE 76: Xaa=Asp or Glu
MSVFGKLFGAGGGKAGKGGPTPQEAIQRLRDTEEMLSKKQEFLEKKIEQELTAAKKHGTKNKRAALQALKRKXRYXKQLAQI

SEQ ID NO: 5713 - protein, 107 aa, Homo sapiens
MGKIALQLKATLENITNLRPVGEDFRWYLKMKCGNCGEISDKWQYIRLMDSVALKGGRGSASMVQKCKLCARENSIEILSSTIKPYNAEDNENFKTIVEFECRGTGD

SEQ ID NO: 5714 - protein, 105 aa, Homo sapiens
  UNSURE 71: Xaa=Ile or Asn or Ser or Thr
  UNSURE 83: Xaa=Ile or Thr
  UNSURE 87: Xaa=Lys or Met or Arg or Thr
MPYQYPALTPEQKKELSDIAHRIVAPGKGILAADESTGSIAKRLQSIGTENTEENRRFYRQLLLTADDRVXPCIGGVILFHEXLYQXADDGRPFPQVIKSKGGVV

SEQ ID NO: 5715 - protein, 105 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVV

SEQ ID NO: 5716 - protein, 105 aa, Homo sapiens; identical to SEQ ID NO: 5715

SEQ ID NO: 5717 - protein, 105 aa, Homo sapiens; identical to SEQ ID NO: 5714
  UNSURE 71: Xaa=Ile or Asn or Ser or Thr
  UNSURE 83: Xaa=Ile or Thr
  UNSURE 87: Xaa=Lys or Met or Arg or Thr

SEQ ID NO: 5718 - protein, 105 aa, Homo sapiens; identical to SEQ ID NO: 5714
  UNSURE 71: Xaa=Ile or Asn or Ser or Thr
  UNSURE 83: Xaa=Ile or Thr
  UNSURE 87: Xaa=Lys or Met or Arg or Thr

SEQ ID NO: 5719 - protein, 95 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVA

SEQ ID NO: 5720 - protein, 52 aa, Homo sapiens
  UNSURE 13: Xaa=Ser or Thr
MDVWARLPLCTGXILEYLTAEVLELAGNASKDLKVKRITPRHLQLAIRGDEE

SEQ ID NO: 5721 - protein, 131 aa, Homo sapiens
MNLIFHKDILFGIPANKVPQDEWTGYTPRGKDDEIPCRRMRSGSYIKAMGDEDSGDSDTSPKPSPKVAARRESYLKATQPSLTELTTLKISNEHSPKLQIRSHSYLRAVSEVSINRSLDSLDLQLAHITKV

SEQ ID NO: 5722 - protein, 77 aa, Homo sapiens
MAHLRVPQDEWTGYTPRGKDDEIPCRRMRSGSYIKAMGDEDSGDSDTSPKPSPKVAARRESYLKATQPSLTELTTLK

SEQ ID NO: 5723 - protein, 76 aa, Homo sapiens
  UNSURE 58: Xaa= *  or Glu or Lys or Gln
MQTVLQKRAAPYVQAFDSLLAGPVAEYLKISKEIGGDVQKHAEMVHTGLKLERALLVXLLSVNSQQKISFPICWHP

SEQ ID NO: 5724 - protein, 107 aa, Homo sapiens
  UNSURE 89: Xaa= *  or Glu or Lys or Gln
MADMQNLVERLERAVGRLEAVSHTSDMHRGYADSPSKAGAAPYVQAFDSLLAGPVAEYLKISKEIGGDVQKHAEMVHTGLKLERALLVXLLSVNSQQKISFPICWHP

SEQ ID NO: 5725 - protein, 145 aa, Homo sapiens
MSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAP

SEQ ID NO: 5726 - protein, 92 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCF

SEQ ID NO: 5727 - protein, 106 aa, Homo sapiens
MVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSV

SEQ ID NO: 5728 - protein, 55 aa, Homo sapiens
MGDPGSEIIESVPPAGPEASESTTDENEDDIQFVSEGPSRPVLEYIDLVCGDDEN

SEQ ID NO: 5729 - protein, 58 aa, Homo sapiens
MKRERGALSRASRALRLAPFVYLLLIQTDPLEGVNITSPVRLIHGTVGKSALLSVQYS

SEQ ID NO: 5730 - protein, 104 aa, Homo sapiens
  UNSURE 89: Xaa=Cys or Asn or Ser or Tyr
MAAESDVLHFQFEQQGDVVLQKMNLLRQQNLFCDVSIYINDTEFQGHKVILAACSTFMRDQFLLTQSKHVRITILQSAEVGRKLLLSCXTGALEVKRKELLKYL

SEQ ID NO: 5731 - protein, 63 aa, Homo sapiens
MTDTAEAVPKFEEMFASRFTENDKEYQEYLKRPPESPPIVEEWNSRAGGNKETEAIGCKTTDS

SEQ ID NO: 5732 - protein, 150 aa, Homo sapiens
  UNSURE 104: Xaa= *  or Ala or Glu or Gly or Ile or Lys or Leu or Pro or Gln or Arg or Ser or Thr or Val
MAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEXDDVEGKIRQIIPPGFCTNTNDFLSLLEKEVDFKPFGTLLHTYSVLS

SEQ ID NO: 5733 - protein, 114 aa, Homo sapiens
  UNSURE 113: Xaa= *  or Gly
MKLVRFLMKLSHETVTIELKNGTQVHGTITGVDVSMNTHLKAVKMTLKNREPVQLETLSIRGNNIRYFILPDSLPLDTLLVDVEPKVKSKKREAVAGRGRGRGRGRGRGRGRXR

SEQ ID NO: 5734 - protein, 133 aa, Homo sapiens
MASTDYSTYSQAAAHRATVLTPPSPLKDMHRPPRHMGNKAMEPMDSPLMSAIPRLRPLQPMGRPPMQLLMDSLPLVILLQLPPRHTASLSRGMALVLMIPPLLQSPPPRPPMQLSLHMALSLLIQPMGSSQQP

SEQ ID NO: 5735 - protein, 61 aa, Homo sapiens
  UNSURE 38: Xaa=Asp or Asn
  UNSURE 41: Xaa=Asn or Ser
MDVENEQILNVNPADPDNLSDSLFSGDEENAGTEEVKXEIXGNWISASSINEARINAKAKR

SEQ ID NO: 5736 - protein, 101 aa, Homo sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKS

SEQ ID NO: 5737 - protein, 81 aa, Homo sapiens
  UNSURE 11: Xaa= *  or Glu
  UNSURE 19: Xaa= *  or Ala or Gly or Ser
  UNSURE 32: Xaa=Glu or Gly
  UNSURE 49: Xaa=His or Arg
  UNSURE 57: Xaa=His or Leu
  UNSURE 65: Xaa=Pro or Ser
  UNSURE 79: Xaa=Ala or Ser
  UNSURE 81: Xaa=Asp or Asn
MSLHGASGGHXRSRDRRRXSDRSRDSSHERTXSQLTPCIRNVTSPTRQXHVEREKDXSSSRPSSXRPQKASPNGSISSXGX

SEQ ID NO: 5738 - protein, 91 aa, Homo sapiens
  UNSURE 53: Xaa=Asp or Glu
  UNSURE 66: Xaa=Ile or Lys or Met or Arg or Thr
MEPFILRWRGLSFAVLAENDRAPENDLEVRFDFKVVLTGRARCLTPVILALWXAEVGGSPEVRSSXPGLTNMVKPVSTKNTNISRAWWRAF

SEQ ID NO: 5739 - protein, 65 aa, Homo sapiens
MASIMEGPLSKWTNVMKGWQYRWFVLDYNAGLLSYYTSKDKMMRGSRRGCVRLRGAVIGIDDEDD

SEQ ID NO: 5740 - protein, 129 aa, Homo sapiens
  UNSURE 110: Xaa=Ala or Pro or Ser or Thr
MMPTPVILLKEGTDSSQGIPQLVSNISACQVIAEAVRTTLGPRGMDKLIVDGRGKATISNDGATILKLLDVVHPAAKTLVDIAKSQDAEVGDGTTSVTLLAAEFLKQVKXYVEEGLHPQIIIRAFRTAT

SEQ ID NO: 5741 - protein, 153 aa, Homo sapiens
MMDSQLVAGVAFKKTFSYAGFEMQPKKYHNPKIALLNVELELKAEKDNAEIRVHTVEDYQAIVDAEWNILYDKLEKIHHSGAKVVLSKLPIGDVATQYFADRDMFCAGRVPEEDLKRTMMACGGSIQTSVNALSADVLGRCQVFEETQIGGER

SEQ ID NO: 5742 - protein, 121 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTM

SEQ ID NO: 5743 - protein, 127 aa, Homo sapiens
  UNSURE 114: Xaa= *  or Glu or Lys or Gln
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIXMEDFAFIANPSST

SEQ ID NO: 5744 - protein, 88 aa, Homo sapiens
  UNSURE 69: Xaa=Ala or Ser
MPSRKFADGEVVRGRWPGSSLYYEVEILSHDSTSQLYTVKYKDGTELELKENDIKPLTSFRQRKGGSNXSSPSRRRGSRSRSRSRSPG

SEQ ID NO: 5745 - protein, 75 aa, Homo sapiens
MPSVSKAAAAALSGSPPQTEKPTHYRYLKEFRTEQCPLFSQHKCAQTGRSPASTGTSSTSGAAGPPQARRHLQLQ

SEQ ID NO: 5746 - protein, 106 aa, Homo sapiens
MAMFEQMRANVGKLLKGIDRYNPENLATLERYVETQAKENAYDLEANLAVLKLYQFNPAFFQTTVTAQILLKALTNLPHTDFTLCKCMIDQAHQEERPIRQILYSG

SEQ ID NO: 5747 - protein, 114 aa, Homo sapiens
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQA

SEQ ID NO: 5748 - protein, 61 aa, Homo sapiens
  UNSURE 55: Xaa=Asn or Thr
MLLGGDRCPLELCISQYSQRTLLPSSPFPNPSSNLLRTQNQRPGNVGLLSLPNSXGPHPPL

SEQ ID NO: 5749 - protein, 53 aa, Homo sapiens
  UNSURE 31: Xaa=Lys or Asn
MLRYPYFCRMYKECLSCWLESGIPNLGVWPXRIHTTAEKYREYEAREQTDQTQ

SEQ ID NO: 5750 - protein, 55 aa, Homo sapiens
MEEAGDEIVSNAISYALYKAFSTSEQDKDNWNGQLKLLLEWNQLDLANDEIFTND

SEQ ID NO: 5751 - protein, 131 aa, Homo sapiens
MGSAGLSRLHGLFAVYKPPGLKWKHLRDTVELQLLKGLNARKPPAPKQRVRFLLGPMEGSEEKELTLTATSVPSFINHPLVCGPAFAHLKVGVGHRLDAQASGVLVLGVGHGCRLLTDMYNAHLTKDYTVH

SEQ ID NO: 5752 - protein, 76 aa, Homo sapiens
MEAPLVQQPLLQFRPQSQDTREWSSNQPPLTATKKSTLKPQPAPQAGPIPVAPIGTLKPQPQPVPASYTTASTSSR

SEQ ID NO: 5753 - protein, 114 aa, Homo sapiens
MKLKDTKSRPKQSSCGKFQTKGIKVVGKWKEVKIDPNMFADGQMDDLVCFEELTDYQLVSPAKNPSSLFSKEAPKRKAQAVSEEEEEEEGKSSSPKKKIKLKKSKNVATEGTST

SEQ ID NO: 5754 - protein, 111 aa, Homo sapiens
MACPALGLEALQPLQPEPPPEPAFSEAQKWIEQVTGRSFGDKDFRTGLENGILLCELLNAIKPGLVKKINRLPTPIAGLDNIILFLRGCKELGLKESQLFDPSDLQDTSNR

SEQ ID NO: 5755 - protein, 106 aa, Homo sapiens
  UNSURE 88: Xaa=His or Gln
MAQKMDCGAGLLGFQAEASVEDSALLMQTLMEAIQISEAPPTNQATAAASPQSSQPPTANEMADIQVSAAAARLSQPLKSRMPPQKAXMVSMISLRLIMPRMCPTH

SEQ ID NO: 5756 - protein, 52 aa, Homo sapiens
MSKKEMIAQQREYKKKKALKKAQRIKELEQEREDQKVKWQHSTTEPILKTKK

SEQ ID NO: 5757 - protein, 89 aa, Homo sapiens
MAASSRAQVLSLYRAMLRESKRFSAYNYRTYAVRRIRDAFRENKNVKDPVEIQTLVNKAKRDLGVIRRQVHIGQLYSTDKLIIENRDMP

SEQ ID NO: 5758 - protein, 96 aa, Homo sapiens
MAASSRAQVLSLYRAMLRESKRFSAYNYRTYAVRRIRDAFRENKNVKDPVEIQTLVNKAKRDLGVIRRQVHIGQLYSTDKRKTKTTNFPRLTTTTV

SEQ ID NO: 5759 - protein, 125 aa, Homo sapiens
MLVNVLNICSDDELGSEEDGFDGATAAARKEVIRNKIRAIGKMARVFSVLREESESVLTLKGLTPTGMLPSGVLSGGKQTLQSAIKGFSPQHKITSFEEAKGLDRINERMPPRRDAMPSDANLNS

SEQ ID NO: 5760 - protein, 141 aa, Homo sapiens
  UNSURE 71: Xaa=Cys or Tyr
MTAWTMGARGLDKRGSFFKLIDTIASEIGELKQEMVRTDVNLENGLEPAETHSMVRHKDGGYSEEEDVKTXARDSGYDSLSNRLSILDRLLHTHPIWLQLSLSEEEAAEVLQAQPPGIFLVHKSTKMQKKVLSLRLPCEFG

SEQ ID NO: 5761 - protein, 112 aa, Homo sapiens
  UNSURE 36: Xaa=Ile or Asn or Ser or Thr
  UNSURE 50: Xaa=Ala or Asp or Gly or Val
MKVVNLKQAILQAWKERWSDYQWAINMKKFFPKGAXWDILNLADALLEQXMIGPSPNPLILSYLKYAISSQMVSYSSVLTAISKFDDFSRDLCVQALLDIMDMFCDRLSCHG

SEQ ID NO: 5762 - protein, 125 aa, Homo sapiens
MAPYSLLVTRLQKALGVRQYHVASVLCQRAKVAMSHFEPNEYIHYDLLEKNINIVRKRLNRPLTLSEKIVYGHLDDPASQEIERGKSYLRLRPDRVAMQDATAQMAMLQFISSGLSKVAVHPPST

SEQ ID NO: 5763 - protein, 120 aa, Homo sapiens
  UNSURE 10: Xaa= *  or Lys or Leu or Met or Arg or Ser or Thr or Trp
MAECGASGTXSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIEDHLVNTETKVI

SEQ ID NO: 5764 - protein, 72 aa, Homo sapiens
  UNSURE 9: Xaa=Asp or Glu
  UNSURE 11: Xaa=His or Arg
  UNSURE 15: Xaa=Ile or Lys or Arg or Thr
  UNSURE 19: Xaa=Ile or Val
  UNSURE 26: Xaa=Ala or Gly
  UNSURE 65: Xaa=Gly or Arg
MDQCRHTWXQXNWNXEAAXQDRLNEXEGVPSVFNPPPSRPLQVNTADHRIYSYVVSRPQPRGLLXWGYYLIM

SEQ ID NO: 5765 - protein, 98 aa, Homo sapiens
  UNSURE 15: Xaa=Ala or Asp
  UNSURE 21: Xaa=Phe or Ile
  UNSURE 45: Xaa=Asp or Glu
  UNSURE 58: Xaa=any one of the twenty amino acids
  UNSURE 63: Xaa= *  or Lys or Arg
  UNSURE 70: Xaa=Pro or Gln
  UNSURE 78: Xaa= *  or Tyr
MHQFQLDITVKMGRXKVREMXMKNAHVTDPRVVDLLVIKGKIELXETIKSMEAADTCXAVLPXKQKRQGXKDFLSKFXVGHESMKSFSGKMHVDTILE

SEQ ID NO: 5766 - protein, 95 aa, Homo sapiens
  UNSURE 69: Xaa=His or Gln
MAAAVLGQLGALWIHNLRSRGKLALGVLPQSYIHTSASLDISRKWEKKNKIVYPPQLPGEPRRPAEIYXCRRQIKYSKDKMWYLAKLIRGMSIDQ

SEQ ID NO: 5767 - protein, 159 aa, Homo sapiens
  UNSURE 120: Xaa=Ala or Thr
MPWRGRRFRLCRRKMAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYXGEPSKRSRGALGSIALLGLVGTTVCSAFQHLGWVKSGLG

SEQ ID NO: 5768 - protein, 114 aa, Homo sapiens
  UNSURE 68: Xaa=Asn or Ser
  UNSURE 105: Xaa=Asp or Asn
MHLVTNSGKMVVLDKLLPKLKEQGSRVLIFSQMTRVLDILEDYCMWRNYEYCRLDGQTPHDERQDSIXAYNEPNSTKFVFMLSTRAGGLGINLATADVVILYDSXWNPQVDLQA

SEQ ID NO: 5769 - protein, 58 aa, Homo sapiens
  UNSURE 42: Xaa=Cys or Gly or Arg or Ser
MIVQMETHMLHKDIPVEHGSMAADRQPPLSAPASALRTAVPXMSALLFCTARSPETEP

SEQ ID NO: 5770 - protein, 90 aa, Homo sapiens
MAVSESQLKKMVSKYKYRDLTVRETVNVITLYKDLKPVLDSYVFNDGSSRELMNLTGTIPVPYRGNTYNIPICLWLLDTYPYNPPICFVK

SEQ ID NO: 5771 - protein, 77 aa, Homo sapiens
MDTPENVLQMLEAHMQSYKGNDPLGEWERYIQWVEENFPENKEYLITLLEHLMKEFLDKKKYHNDPRFISYCLKFAE

SEQ ID NO: 5772 - protein, 92 aa, Homo sapiens
MSVPGPYQAATGPSSAPSAPPSYEETVAVNSYYPTPPAPMPGPTTGLVTGPDGKGMNPPSYYTQPAPIPNNNPSTCGLPGPPYHSLALHPGN

SEQ ID NO: 5773 - protein, 94 aa, Homo sapiens
MAAAADERSPEDGEDEEEEEQLVLVELSGIIDSDFLSKCENKCKVLGIDTERPILQVDSCVFAGEYEDTLGTCVIFEENVEHADTEGNNKTVLK

SEQ ID NO: 5774 - protein, 127 aa, Homo sapiens
  UNSURE 95: Xaa=Ala or Cys or Asp or Phe or Gly or His or Ile or Leu or Asn or Pro or Arg or Ser or Thr or Val or Tyr
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPXRAQPKMVTRTKKIFVGGLSANTVVEDVKQYFE

SEQ ID NO: 5775 - protein, 128 aa, Homo sapiens
MAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDK

SEQ ID NO: 5776 - protein, 71 aa, Homo sapiens
MKENKENSSPSVTSANLDHTKPCWYWDKKDLAHTPSQLEGLDPATEARYRREGARFIFDVGTRLGLHYDTL

SEQ ID NO: 5777 - protein, 114 aa, Homo sapiens
MRVPRNPTIGDKFASRHGQKGILSRLWPAEDMPFTESGMVPDILFNPHGFPSRMTIGMLIESMAGKSAALHGLCHDATPFIFSEENSALEYFGEMLKAAGYNFYGTERLYSGIS

SEQ ID NO: 5778 - protein, 110 aa, Homo sapiens
MAAVGRVGSFGSSPPGLSSTYTGGPLGNEIASGNGGAAAGDDEDGQNLWSCILSEVSTRSRSKLPAGKNVLLLGEDGAGKTSLIRKIQGIEEYKKGRGLEYLYLNVHDED

SEQ ID NO: 5779 - protein, 66 aa, Homo sapiens
  UNSURE 31: Xaa=Gly or Arg or Trp
MNAMLETPELPAVFDGVKLAAVAAVLYVIVXCLNLKSPTAPPDLYFQDSGLSRFLLKSCPLLTKEY

SEQ ID NO: 5780 - protein, 104 aa, Homo sapiens
MPPPVAAIQGSALFLRSSPPRRRLVTTSTSVQHRRKCHAENSRTAGTQRGATTACAARDMSLFLGQKHSRMRARTPVKMWTSAAPGSISVTAPPSASTPWVHTA

SEQ ID NO: 5781 - protein, 60 aa, Homo sapiens
  UNSURE 49: Xaa=Ala or Pro
MALVHKLLRGTYFLRKFSKPTSALYPFLGIRFAEYSSSLQKPVASPGKXPHRGRLKGICK

SEQ ID NO: 5782 - protein, 145 aa, Homo sapiens
  UNSURE 117: Xaa=Gly or Ile or Ser or Val
  UNSURE 120: Xaa=Glu or Lys
MASLSLAPVNIFKAGADEERAETARLTSFIGAIAIGDLVKSTLGPKGMDKILLSSGRDASLMVTNDGATILKNIGVDNPAAKVLVDMSRVQDDEVGDGTTSVTVLAAELLREAESLXAKXIHPQTIIAGWREPRGCREALLSSAV

SEQ ID NO: 5783 - protein, 96 aa, Homo sapiens
MVMAEGTAVLRRNRPGTKAQDFYNWPDESFDEMDSTLAVQQYIQQNIRADCSNIDKILEPPEGQDEGVWKYEHLRQFCLELNGLAVKLQSECHPDT

SEQ ID NO: 5784 - protein, 104 aa, Homo sapiens
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENG

SEQ ID NO: 5785 - protein, 106 aa, Homo sapiens
  UNSURE 47: Xaa= *  or Ala or Glu or Gly or Ile or Lys or Leu or Met or Pro or Gln or Arg or Ser or Thr or Val or Trp
  UNSURE 79: Xaa=Asp or Tyr
MFLLLLHLQIKWRATINLLSVTEDGLHFVEYYLNRIIHLDVDSEAKXLLGLGQKHLVMGDIPAAVNAFQEAASLLGKKXGETANECGEAFFFYGKSLLELARMENG

SEQ ID NO: 5786 - protein, 55 aa, Homo sapiens
  UNSURE 47: Xaa=Asn or Thr
MVLHISILKTGEVRPQTSQAFSFHWKLDIFPPGFLGKPNGAQEAVWXSVWVLSWS

SEQ ID NO: 5787 - protein, 74 aa, Homo sapiens
MASFPPRVNEKEIVRLRTIGELLAPAAPFDKKCGRENWTVAFAPDGSYFAWSQGHRTVKLVPWSQCLQNFLLHG

SEQ ID NO: 5788 - protein, 107 aa, Homo sapiens
  UNSURE 84: Xaa= *  or Glu or Lys or Gln
  UNSURE 88: Xaa=Ala or Asp or Gly or Val
MMLPLQGAQMLQMLEKSLRKSLPASLKVYGTVFHINHGNPFNLKAVVDKWPDFNTVVVCPQEQDMTDDLDHYTNTYQIYSKDPXNCQXFLGSPELINWKQHLQIQSS

SEQ ID NO: 5789 - protein, 70 aa, Homo sapiens
MLRPLRTVAPADRQALLQWMRTNRKSLYRTAETSSTMQNYHQDWPTPGGIPETTLQGAYRKKIKRSDAAA

SEQ ID NO: 5790 - protein, 114 aa, Homo sapiens
MAASQCLCCSKFLFQRQNLACFLTNPHCGSLVNADGHGEVWTDWNNMSKFFQYGWRCTTNENTYSNRTLMGNWNQERYDLRNIVQPKPLPSQFGHYFETTYDTSYNNKMPLSTH

SEQ ID NO: 5791 - protein, 85 aa, Homo sapiens
MVGREKELSIHFVPGSCRLVEEEVNIPNRRVLVTGATGLLGRAVHKEFQQNNWHAVGCGFRRARPKFEQVNLLDSNAVHHIIHDF

SEQ ID NO: 5792 - protein, 119 aa, Homo sapiens
  UNSURE 106: Xaa= *  or Glu or Lys or Gln
MASCPDSDNSWVLAGSESLPVETLGPASRMDPESERALQAPHSPSKTDGKELAGTMDGEGTLFQTESPQSGSILTEETEVKGTWKVMFVVWSSWPRRHSSPGRLQXTRVTGLGQTHRTG

SEQ ID NO: 5793 - protein, 100 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPT

SEQ ID NO: 5794 - protein, 132 aa, Homo sapiens
  UNSURE 126: Xaa=Gly or Val
MRQPYLSSREVSSSRKRWRTFPVDCVAMCGDCVEKEYPNRGNTCLENGSFLLNFTGCAVCSKRDFMLITNKSLKEEDGEEIVTYDHLCKNCHHVIARHEYTFSIMDEFQEYTMLCLLCGKAKILSXFSLMTP

SEQ ID NO: 5795 - protein, 159 aa, Homo sapiens
  UNSURE 16: Xaa=Glu or Gly
MDSLFVEEVAASLVRXFLSRKGLKKTCVTMDQERPRSDLSINNRNDLRKVLHLEFLYKENKAKENPLKTSLELITRYFLDHFGNTANNFTQDTPIPALSVPKKNNKVPSRCSETTLVNIYDLSDEDAGWRTSLSETSKARHDNLDGDVLGNFVSSKRPP

SEQ ID NO: 5796 - protein, 124 aa, Homo sapiens
  UNSURE 98: Xaa=Lys or Thr
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATXINEKPQVIADYESGRAIPNNQVLGKI

SEQ ID NO: 5797 - protein, 181 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSGGNWFYITA

SEQ ID NO: 5798 - protein, 97 aa, Homo sapiens
MQAQLLELRTNNYQLSDELRKNGVELTSLRQKVAYLDKEFSKAQKALSKSKKAQEVEVLLSENEMLQAKLHSQEEDFRLQNTLMAEFSKLCSQMEQL

SEQ ID NO: 5799 - protein, 56 aa, Homo sapiens
  UNSURE 16: Xaa=Asp or Tyr
MLMDSPLNRAGLLQVXIHTQKNVLIEVNPQTRIPRTFDRFCGLMVQLLHKLSVRAA

SEQ ID NO: 5800 - protein, 109 aa, Homo sapiens
MSQAEFEKAAEEVRHLKTKPSDEEMLFIYGHYKQATVGDINTERPGMLDFTGKAKWDAWNELKGTSKEDAMKAYINKVEELKKNTGYERLDLVTVPCVYPKLRQCLVFF

SEQ ID NO: 5801 - protein, 123 aa, Homo sapiens
MEALIPVINKLQDVFNTVGADIIQLPQIVVVGTQSSGKSSVLESLVGRDLLPRGTGIVTRRPLILQLVHVSQEDKRKTTGEENGVEAEEWGKFLHTKNKLYTDFDEIRQEIENETERISGNNK

SEQ ID NO: 5802 - protein, 164 aa, Homo sapiens
  UNSURE 6: Xaa=Ile or Val
MATLVXNKLGAGVDSGRQGSRGTAVVKVLECGVCEDVFSLQGDKVPRLLLCGHTVCHDCLTRLPLHGRAIRCPFDRQVTDLGDSGVWGLKKNFALLELLERLQNGPIGQYGAAEESIGISGESIIRCDEDEAHLASVYCTVCATHLCSECSQVTHSTKTLAKHR

SEQ ID NO: 5803 - protein, 111 aa, Homo sapiens
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANP

SEQ ID NO: 5804 - protein, 63 aa, Homo sapiens
  UNSURE 11: Xaa=Ala or Val
MLGRSLREVSXALKQGQITPTELCQKCLSLIKKTKFLNAYITVSEEVALKQAEESEKRYKNGQ

SEQ ID NO: 5805 - protein, 54 aa, Homo sapiens
MAQFGGQKNPPWATQFTATAVSQPAALGVQQPSLLGASPTIYTQQTALAAAGLT

SEQ ID NO: 5806 - protein, 73 aa, Homo sapiens
  UNSURE 14: Xaa=Asp or Glu
MEGGSEREGKPEIXGKPESEGEPGSETRAAGKRPAEDDVPRKAKRKTNKGLAHYLKEYKEAIHDMNFSNEDMI

SEQ ID NO: 5807 - protein, 53 aa, Homo sapiens
MKCKCGIFTFIPMKFQQYFTSVYDFFNLLIIIISHIFVICIFNKSLRTILNKT

SEQ ID NO: 5808 - protein, 95 aa, Homo sapiens
  UNSURE 55: Xaa=Glu or Gly
MNPAAEAEFNILLATDSYKVTHYKQYPPNTSKVYSYFECREKKTENSKLRKVKYXETVFYGLQYILNKYLKGKVVTKEKIQEAKDVYKEHFQDDV

SEQ ID NO: 5809 - protein, 113 aa, Homo sapiens
  UNSURE 112: Xaa=His or Gln
MANRGPAYGLSREVQQKIEKQYDADLEQILIQWITTQCRKDVGRPQPGRENFQNWLKDGTVLCELINALYPEGQAPVKKIQASTMAFKQMEQISQFLQAAERYGINTTDIFXT

SEQ ID NO: 5810 - protein, 60 aa, Homo sapiens
MFGQIQSPGYPDSYPSDSEVTWNITVPDGFRIKLYFMHFNLESSYLCEYDYVKVETEDQV

SEQ ID NO: 5811 - protein, 69 aa, Homo sapiens
  UNSURE 48: Xaa= *  or Leu or Ser or Trp
  UNSURE 56: Xaa=Ser or Thr
MLLATFKLCAGSSYRHMRNMKGLRQQAVMAISQELNRRALGGPTPSTXINQVRRRXLYSVLGWKRLSTV

SEQ ID NO: 5812 - protein, 56 aa, Homo sapiens
MATVQEKAAALNLSALHSPAHRPPGFSVAQKPFGATYVWSSIINTLQTQVEVKKRR

SEQ ID NO: 5813 - protein, 128 aa, Homo sapiens
  UNSURE 80: Xaa= *  or Tyr
  UNSURE 81: Xaa=Leu or Val
  UNSURE 106: Xaa=Lys or Asn
MIRFILIQNRAGKTRLAKWYMQFDDDEKQKLIEEVHAVVTVRDAKHTNFVEFRNFKIIYRRYAGLYFCICVDVNDNNLAXXEAIHNFVEVLNEYFHNVCELDLVFXFLQGLHGRGRDVPGWRNPRDQP

SEQ ID NO: 5814 - protein, 127 aa, Homo sapiens
MTRPTIVSSCLWAVRSWLGPAPTLGSSCNTVDTICHGYSEIRPLFYLSFCDLLLGLCWLTETLLYGASVANKDIICYNLQAVGQIFYISSFLYTVNYIWYLYTELRMKHTQSGQSTSPLVIDYTCRV

SEQ ID NO: 5815 - protein, 84 aa, Homo sapiens
MQGNEVEVEAKRNQVNIKMKVKKNQINEVEVAVKEELTVLKNQKNGNIVPAKKNLESVVEAKNVPTNEITVIVRTSQTNMIVEG

SEQ ID NO: 5816 - protein, 63 aa, Homo sapiens
  UNSURE 52: Xaa=Lys or Asn
MASAVPRLQLELPYSHLRQTQQGWPRPPTVNRCSREMDQPLFCLFYQGKRSXHGQGWNTPGSG

SEQ ID NO: 5817 - protein, 135 aa, Homo sapiens
MMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDI

SEQ ID NO: 5818 - protein, 58 aa, Homo sapiens
  UNSURE 5: Xaa= *  or Glu or Lys or Gln
  UNSURE 13: Xaa=Asp or Glu
  UNSURE 25: Xaa= *  or Cys or Phe or Leu or Ser or Trp or Tyr
  UNSURE 26: Xaa=Ser or Trp
  UNSURE 42: Xaa=Asn or Thr
  UNSURE 46: Xaa=Ala or Asp
  UNSURE 51: Xaa=Lys or Gln
MVDCXEVRKPSLXSCSCLNTLRAWXXRAGYPLGLPPATAPNXQAGXTLWHXKVALISQ

SEQ ID NO: 5819 - protein, 76 aa, Homo sapiens
MMTAESREATGLSPQAAQEKDGIVIVKVEEEDEEDHMWGQDSTLQDTPPPDPEIFRQRFRRFCYQNTFGPREALSR

SEQ ID NO: 5820 - protein, 125 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGG

SEQ ID NO: 5821 - protein, 149 aa, Homo sapiens
  UNSURE 111: Xaa=Glu or Gly
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPXALIWGIYFAILSFLHIWAVVPCIKSFLIEIQCISRVYS

SEQ ID NO: 5822 - protein, 118 aa, Homo sapiens
  UNSURE 22: Xaa=Lys or Asn
  UNSURE 80: Xaa=Glu or Gly
MADELSEKQVYDAHTKEIDLVXRDPKHLNDDVVKIDFEDVIAEPEGTHSFDGIWKASFTTFTVTKYWFYRLLSALFGIPXALIWGIYFAILSFLHIWAVVPCIKSFLIEIQCISRVYS

SEQ ID NO: 5823 - protein, 103 aa, Homo sapiens
  UNSURE 89: Xaa=His or Leu or Pro or Gln or Arg
  UNSURE 94: Xaa=Asp or Glu
MPKRKVTFQGVGDEEDEDEIIVPKKKLVDPVAGSGGPGSRFKGKHSLDSDEEEDDDDGGSSKYDILASEDVEGQEAATLPSEGGVRITXFNLQXEMEEGHFDA

SEQ ID NO: 5824 - protein, 51 aa, Homo sapiens
MSNRNNNKLPSNLPQLQNLIKRDPPAYIEEFLQQYNHYKSNVEIFKLQPNK

SEQ ID NO: 5825 - protein, 71 aa, Homo sapiens
MNRTQELSGQLSAATGDMPTYQIRAPTAALPQGVVMAASPGSLHSPQQLAEEATRKRELRLMKNREAAKEG

SEQ ID NO: 5826 - protein, 114 aa, Homo sapiens
MSYTGFVQGSETTLQSTYSDTSAQPTCDYGYGTWNSGTNRGYEGYGYGYGYGQDNTTNYGINQRLDMVPHLETDMMQGGVYGSGGERYDSYESCDSRAVLSERDLYRSGYDYSE

SEQ ID NO: 5827 - protein, 148 aa, Homo sapiens
  UNSURE 81: Xaa=Ser or Thr
MSYTGFVQGSETTLQSTYSDTSAQPTCDYGYGTWNSGTNRGYEGYGYGYGYGQDNTTNYGYGMATSHSWEMPSSDTNANTXASGSASADSVLSRINQRLDMVPHLETDMMQGGVYGSGGERYDSYESCDSRAVLSERDLYRSGYDYSE

SEQ ID NO: 5828 - protein, 57 aa, Homo sapiens
MEVDAPGVDGRDGLRERRGFSEGGRQNFDVRPQSGANGLPKHSYWLDLWLFILQIST

SEQ ID NO: 5829 - protein, 113 aa, Homo sapiens
  UNSURE 32: Xaa=Asp or Glu
  UNSURE 33: Xaa=Lys or Arg
  UNSURE 34: Xaa=Ala or Pro
  UNSURE 36: Xaa=Ala or Gly
  UNSURE 43: Xaa=Gly or Arg
  UNSURE 45: Xaa=Pro or Ser
  UNSURE 51: Xaa=Cys or Phe
  UNSURE 60: Xaa=Leu or Val
MPAGGERCNPLLAAGGCDHPHSPKGRLRRRRXXXPXTPVGAPXRXPDEEVXEEQRCEEEXFPLAMNYLDRYLSCVPTRKAQLQLLGAVCMLLASKLRETTPLTIEKLCIYTDH

SEQ ID NO: 5830 - protein, 59 aa, Homo sapiens
  UNSURE 15: Xaa= *  or Gly or Arg
  UNSURE 16: Xaa=Asp or His
  UNSURE 17: Xaa=Ala or Asp or Gly or Val
  UNSURE 18: Xaa=Leu or Ser
  UNSURE 20: Xaa=Cys or Phe or Ser or Tyr
  UNSURE 21: Xaa= *  or Cys or Ser
  UNSURE 24: Xaa=His or Pro
  UNSURE 27: Xaa=Cys or Phe
MTAIMNEQLEIHYAXXXXTXXQMXSVXQRSGQALAQSSLFWKSGPGGAGHWPLNYARAH

SEQ ID NO: 5831 - protein, 54 aa, Homo sapiens
  UNSURE 12: Xaa=Pro or Thr
  UNSURE 23: Xaa=Leu or Met or Val
MGPRIGPAGEVXQVPDKETKATXGTENTLEAKPAQTLRTCGKCVPYIKLFVLCT

SEQ ID NO: 5832 - protein, 66 aa, Homo sapiens [sequence omitted]

SEQ ID NO: 5833 - protein, 121 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGK

SEQ ID NO: 5834 - protein, 55 aa, Homo sapiens
MEYKKTDAPQPDVKEEEEEKEEEKDKGDEEEEGEEKLEEKQKSDAEEDGGTVSQE

SEQ ID NO: 5835 - protein, 55 aa, Homo sapiens
MESEALVGLPSQGLNSSCEAQMFTVDSQMSYTVPIMAFAFVCHPEVLPIYTELCR

SEQ ID NO: 5836 - protein, 110 aa, Homo sapiens
MATNWGSLLQDKQQLEELARQAVDRALAEGVLLRTSQEPTSSEVVSYAPFTLFPSLVPSALLEQAYAVQMDFNLLVDAVSQNAAFLEQTLSSTIKQDDFTARLFDIHKQV

SEQ ID NO: 5837 - protein, 74 aa, Homo sapiens
MEIPPTNYPASRAALVAQNYINYQQGTPHRVFEVQKVKQASMEDIPGRGHKYHLKFAVEEIIQKQVKVNCTAEV

SEQ ID NO: 5838 - protein, 125 aa, Homo sapiens
  UNSURE 118: Xaa=Cys or Phe or Ser or Tyr
MRAPMLQKQQAPRMDTPPPEERLEKQNEKLNNQEEETEFKELDGLREALANLRGLSEEERSEKAMLRSRIEEQSQLICILKRRSDEALERCQILELLNAELEEKMMQEAEKLKAQGEXSRKLEER

SEQ ID NO: 5839 - protein, 133 aa, Homo sapiens
MSGLGRLFGKGKKEKGPTPEEAIQKLKETEKILIKKQEFLEQKIQQELQTAKKYGTKNKRAALQALRRKKRFEQQLAQTDGTLSTLEFQREAIENATTNAEVLRTMELAAQSMKKAYQDMDIDKVDELMTDIT

SEQ ID NO: 5840 - protein, 66 aa, Homo sapiens
MAATARRGWGAAAVAAGLRRRFCHKLKNPYTIKKQPLHQFVQRPLFPLPAAFYHPVRYMFIQTQDT

SEQ ID NO: 5841 - protein, 74 aa, Homo sapiens
MSIEKIWAREILDSRGNPTVEVDLYTAKGLFRAAVPSGASTGIYEALELRDGDKQRYLGKGVLKAVDHINSTIA

SEQ ID NO: 5842 - protein, 73 aa, Homo sapiens
MADAWEEIRRLAADFQRAQFAEATQRLSERNCIEIVNKLIAQKQLEVVHTLDGKEYITPAQISKEMRDELHVR

SEQ ID NO: 5843 - protein, 140 aa, Homo sapiens
MKPILLQGHERSITQIKYNREGDLLFTVAKDPIVNVWYSVNGERLGTYMGHTGAVWCVDADWDTKHVLTGSADNSCRLWDCETGKQLALLKTNSAVRTCGFDFGGNIIMFSTDKQMGYQCFVSFFDLRDPSQIDNNEPYM

SEQ ID NO: 5844 - protein, 80 aa, Homo sapiens
MGDSEMAVFGAAAPYLRKSEKERLEAQTRPFDLKKDVFVPDDKQEFVKAKIVSREGGKVTAETEYGKTVTVKEDQVMQQN

SEQ ID NO: 5845 - protein, 51 aa, Homo sapiens
MFLGKVQGQDKHEEYFAENFGGPEGEFHFSVPHAAGASTDFSSASAPDQSA

SEQ ID NO: 5846 - protein, 135 aa, Homo sapiens
MDHTDNELQGTNSSGSLGGLDVRRRIPIKLISKQANKAKPAPRTQRTINRMPAKAPPGDEGFDYNEEERYDCKGGELFANQRRFPGHLFWDFQINILGEKDDTPVHFCDKCGLPIKIYGRMIPCKHVFCYDCAIL

SEQ ID NO: 5847 - protein, 95 aa, Homo sapiens
MYAVYKQAHPPTGLEFSMYCNFFNNSERNLVVAGTSQLYVYRLNRDAEALTKNDRSTEGKAHREKLELAASFSFFGNVMSMASVQLAGAKRDALL

SEQ ID NO: 5848 - protein, 119 aa, Homo sapiens
  UNSURE 22: Xaa=Leu or Pro
  UNSURE 60: Xaa= *  or Cys or Trp
  UNSURE 71: Xaa=Leu or Met or Val
MSDCCSAPGISWEAGVGRPAVXGLELQIRRGAMSEETVSESQFSLKTAALRVFDLPLTWXYSLSQIKFSPXAKKLFVVTAVSAISVIFLAHHFKRKRGKKKGKILPWEPEHLILEYTKR

SEQ ID NO: 5849 - protein, 111 aa, Homo sapiens
MHFRNFNYSFSSLIACVANSDIFSESETRAKFESLFRTYDKDITFQYFKSFKRVRINFSNPFSAADARLQLHKTEFLGKEMKLYFAQTLHIGSSHLAPPNPDKQFLISPPA

SEQ ID NO: 5850 - protein, 66 aa, Homo sapiens
MMWQCHLSAQDYRYYPVDGYSLLKRFPLHPLTGPRCPVQTVGQWLESIGLPQYENHLMANGFDNVQ

SEQ ID NO: 5851 - protein, 125 aa, Homo sapiens
  UNSURE 111: Xaa=Ala or Thr
  UNSURE 114: Xaa=Ala or Thr
  UNSURE 118: Xaa=His or Gln
  UNSURE 123: Xaa= *  or Trp
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGTQSLXPRXQCGXHHCQXRC

SEQ ID NO: 5852 - protein, 122 aa, Homo sapiens
  UNSURE 31: Xaa=Lys or Arg
  UNSURE 48: Xaa= *  or Cys or Phe or Ile or Lys or Leu or Met or Asn or Arg or Ser or Thr or Trp or Tyr
MAIMKEENTGAGAEAKRTNFFLKQGRRHESXDKSSKKHKSEEHNDKEXSSDKGRERLNSSENGEDRHKRKERKSSRGRSHSRSRSRERRHRSRSRERKKSRSRSRERKKSRSRSRERKKSRS

SEQ ID NO: 5853 - protein, 71 aa, Homo sapiens
  UNSURE 14: Xaa=Leu or Val
MCVVAAAEELVCGXRGLWMRRTRRPRFVLMNKMDDLNLHYRFLNWRRRIREIREVRAFRYQERFKHILVDG

SEQ ID NO: 5854 - protein, 57 aa, Homo sapiens
MPPNLTGYYRFVSQKNMEDYLQALNISLAVRKIALLLKPDKEIEHQGNHMTVRTLST

SEQ ID NO: 5855 - protein, 142 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIILSSFSLTCSSTGFTEAFI

SEQ ID NO: 5856 - protein, 79 aa, Homo sapiens
MAAAVRCMGRALIHHQRHSLSKMVYQTSLCSCSVNIRVPNRHFAAATKSAKKTKKGAKEKTPDEKKDEIEKIKAYPYME

SEQ ID NO: 5857 - protein, 51 aa, Homo sapiens
MLRKLWQLPKTLKENQFFNSRCLIYCEFAQSLMTLKTFWGIHTQKAGSNTQ

SEQ ID NO: 5858 - protein, 75 aa, Homo sapiens
  UNSURE 29: Xaa=Leu or Met or Val
  UNSURE 48: Xaa=Ala or Glu or Gly or Val
MLVGNKSDLRHLRAVPTDEARAFAEKNNXSFIETSALDSTNVEEAFKXILTEIYRIVSQKQIADRAAHDESPGNN

SEQ ID NO: 5859 - protein, 194 aa, Homo sapiens
  UNSURE 148: Xaa=Leu or Met or Val
  UNSURE 167: Xaa=Ala or Glu or Gly or Val
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERWLKELRDHADSNIVIMLVGNKSDLRHLRAVPTDEARAFAEKNNXSFIETSALDSTNVEEAFKXILTEIYRIVSQKQIADRAAHDESPGNN

SEQ ID NO: 5860 - protein, 75 aa, Homo sapiens
  UNSURE 66: Xaa=Ser or Tyr
METIEIATVMPSGNRELLTPPPQPEKAQEEEEEEESTPRLIDGSSPQEPEFTGVLGPHTNGLSNLXFVYLYKYHR

SEQ ID NO: 5861 - protein, 62 aa, Homo sapiens
MTNMTQSLERMKQSWKEAPKHIKETYGQQYFDALYNIMKEGLLNCSTNLNLVTDCMEHALTS

SEQ ID NO: 5862 - protein, 115 aa, Homo sapiens
MSKNTVSSARFRKVDVDEYDENKFVDEEDGGDGQAGPDEGEVDSCLRQGNMTAALQAALKNPPINTKSQAVKDRAGSIVLKVLISFKANDIEKAVQSLDKNGVDLLMKYIYKGFE

SEQ ID NO: 5863 - protein, 76 aa, Homo sapiens [sequence omitted]

SEQ ID NO: 5864 - protein, 119 aa, Homo sapiens
  UNSURE 62: Xaa=Leu or Gln
MGTPQKDVIIKSDAPDTLLLEKHADYIASYGSKKDDYEYCMSEYLRMSGIYWGLTVMDLMGXLHRMNREEILAFIKSCQHECGGISASIGHDPHLLYTLSAVQVNTNQNCNDLDSMFSY

SEQ ID NO: 5865 - protein, 87 aa, Homo sapiens
MPKVVSRSVVCSDTRDREEYDDGEKPLHVYYCLCGQMVLVLDCQLEKLPMRPRDRSRVIDAAKHAHKFCNTEDEETMYLRRPEGIER

SEQ ID NO: 5866 - protein, 76 aa, Homo sapiens
MESIFHEKQEGSLCAQHCLNNLLQGEYFSPVELSSIAHSWMRKRMRMAEGGVTSEDYRTFLQVLILNSLSHISFFF

SEQ ID NO: 5867 - protein, 92 aa, Homo sapiens
  UNSURE 29: Xaa=Phe or Ile or Leu or Val
MAEYTRLHNALALIRLRNPPVNAISTTLXRDIKEGLQKAVIDHTIKAIVICGAEGKFSAGADIRGFSAPRTFGLTLGHVVDEIQRNEKPVVA

SEQ ID NO: 5868 - protein, 57 aa, Homo sapiens
  UNSURE 24: Xaa= *  or Glu or Lys or Gln
  UNSURE 30: Xaa= *  or Cys or Phe or His or Leu or Pro or Gln or Arg or Ser or Trp or Tyr
  UNSURE 34: Xaa=Ile or Lys or Arg or Thr
  UNSURE 35: Xaa=Ala or Pro
  UNSURE 40: Xaa=any one of the twenty amino acids
MSLGPLYAERALRVKAVKLEKEVXDLTVRXQRAXXDCENXRRRTQRCVEDAKIFGIQ

SEQ ID NO: 5869 - protein, 148 aa, Homo sapiens
  UNSURE 83: Xaa=Lys or Asn
  UNSURE 84: Xaa=Ala or Cys or Asp or Phe or Gly or His or Ile or Leu or Asn or Pro or Arg or Ser or Thr or Val or Tyr
  UNSURE 96: Xaa=Phe or Leu
  UNSURE 103: Xaa=Ala or Ser
MAAPLGGMFSGQPPGPPQAPPGLPGQASLLQAAPGAPRPSSSTLVDELESSFEACFASLVSQDYVNGTDQEEIRTGVDQCIQXXLDIARQTECFFXQKRLQLXVQKPEQVIKEDVSELRNELQRKDALVQKHLTKLRHWQQVLEDINV

SEQ ID NO: 5870 - protein, 82 aa, Homo sapiens
MAQSRDGGNPFAEPSELDNPFQDPAVIQHRPSRQYATLDVYNPFETREASAAAATAELLKKQEELNRKAEELDRRKRELQHA

SEQ ID NO: 5871 - protein, 134 aa, Homo sapiens
  UNSURE 15: Xaa=Ala or Thr
MAAKVFESIGKFGLXLAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARF

SEQ ID NO: 5872 - protein, 134 aa, Homo sapiens
  UNSURE 15: Xaa=Ala or Thr
  UNSURE 28: Xaa=Asp or Tyr
MAAKVFESIGKFGLXLAVAGGVVNSALXNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARF

SEQ ID NO: 5873 - protein, 64 aa, Homo sapiens
MGKVNVAKLRYMSRDDFRVLTAVEMGMKNHEIVPGSLIASIASLKHGGCNKVLRELVKHKLIAW

SEQ ID NO: 5874 - protein, 126 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMT

SEQ ID NO: 5875 - protein, 78 aa, Homo sapiens
MPGSQGQIHIPPILGALEVPILPTHHLLIHPFPQAPVLLPQELPMAIQLSPQVGPLILCHSQGIQDANRWVPTLLHTH

SEQ ID NO: 5876 - protein, 56 aa, Homo sapiens
MSETQNSTSQKAMDEDNKAASQTMPNTQDKNYEDELTQVALALVEDVINYAVKIVE

SEQ ID NO: 5877 - protein, 103 aa, Homo sapiens
  UNSURE 79: Xaa=Asp or Glu
  UNSURE 80: Xaa=Gly or Arg or Trp
  UNSURE 98: Xaa=Lys or Gln
MSRRALRRLRGEQRGQEPLGPGALHFDLRDDDDAEEEGPKRELGVRRPGGAGKEGVRVNNRFELINIDDLEDDPVVNGXXSGCALTDAVAPGNKGRGXRGNTE

SEQ ID NO: 5878 - protein, 159 aa, Homo sapiens
  UNSURE 11: Xaa=Lys or Gln
  UNSURE 21: Xaa=Asp or Glu
  UNSURE 142: Xaa=Ala or Asp
MAMHNKAAPPXIPDTRRELAXLVKRKQELAETLANLERQIYAFEGSYLEDTQMYGNIIRGWDRYLTNQKNSNSKNDRRNRKFKEAERLFSKSSVTSAAAVSALAGVQDQLIEKREPGSGTESDTSPDFHNQENEPSQEDPEXLDGSVQGVNLRRLLLLL

SEQ ID NO: 5879 - protein, 100 aa, Homo sapiens
  UNSURE 85: Xaa=Asp or Gly
  UNSURE 90: Xaa=Asp or Asn
MSLVIRNLQRVIPIRRAPLRSKIEIVRRILGVQKFDLGIICVDNKNIQHINRIYRDRNVPTDVLSFPFHEHLKAGEFPQPDFPDXYNLGXIFLGVEYIFH

SEQ ID NO: 5880 - protein, 83 aa, Homo sapiens
  UNSURE 56: Xaa=Asp or Glu
MEPNSLQWVGSPCGLHGPYIFYKAFQFHLEGKPRILSLGDFFFVRCTPKDPICIAXSSCCGKRGPAGNFYPALNFISSQKTLP

SEQ ID NO: 5881 - protein, 52 aa, Homo sapiens
MEKWYLMTVVVLIGLTVRWTVSLNSYSGAGKPPMFGDYEAQRHWQEITFNLP

SEQ ID NO: 5882 - protein, 131 aa, Homo sapiens
MSDTEEQEYEEEQPEEEAAEEEEEAPEEPEPVAEPEEERPKPSRPVVPPLIPPKIPEGERVDFDDIHRKRMEKDLLELQTLIDVHFEQRKKEEEELVALKERIERRRSERAEQQRFRTEKERERQAKLAEE

SEQ ID NO: 5883 - protein, 219 aa, Homo sapiens
  UNSURE 90: Xaa=Arg or Ser
  UNSURE 92: Xaa=Cys or Ser
  UNSURE 212: Xaa=Asp or Glu
MSDEEVEQVEEQYEEEEEAQEEEEKPRPKLTAPKIPEGEKVDFDDIQKKRQNKDLMELQALIDSHFEARKKEEEELVALKERIEKRRAEXAXSRCCPQGAPALLTLDPQKPPTFTMSDEEVEQVEEQYEEEEEAQEEEEVQEEEKPRPKLTAPKIPEGEKVDFDDIQKKRQNKDLMELQALIDSHFEARKKEEEELVALKERIEKRRAERAXSRGFVQR

SEQ ID NO: 5884 - protein, 55 aa, Homo sapiens
  UNSURE 53: Xaa=Ile or Leu
MSRERFSPPVSAVTALGFSSGWLFNFSLGARRGMLCGTSYCLFLRFLPFSLPXLS

SEQ ID NO: 5885 - protein, 62 aa, Homo sapiens
MTVLQEPVQAAIWQALNHYAYRDAVFLAERLYAEVHSEEALFLLATCYYRSGKAYKAYRLLK

SEQ ID NO: 5886 - protein, 79 aa, Homo sapiens
MAKPAQGAKYRGSIHDFPGFDPNQDAEALYTAMKGFGSDKEAILDIITSRSNRQRQEVCQSYKSLYGKDLIADLKYELT

SEQ ID NO: 5887 - protein, 67 aa, Homo sapiens
  UNSURE 57: Xaa=Glu or Lys
  UNSURE 58: Xaa= *  or Ser
MNGTANPLLDREEHCLRLGESFEKRPRASFHTIRYDFKPASIDTSCEGELQVGKGDXXQLHCHISLD

SEQ ID NO: 5888 - protein, 82 aa, Homo sapiens
MAQHFSLAACDVVGFDLDHTLCRYNLPESALPRDPRSPAPDLSAINQPAGRAERRSGPATLSASIQSINCCREARVSSSPVN

SEQ ID NO: 5889 - protein, 122 aa, Homo sapiens
MAAAVAGMLRGGLLPQAGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKIL

SEQ ID NO: 5890 - protein, 60 aa, Homo sapiens
  UNSURE 51: Xaa=Phe or Leu
  UNSURE 53: Xaa=Ala or Asp or Glu
MHFQRQKLMAVTEYIPPKPAIHPSCLPSPPSPPQEEIGLIRLLRREIAAVXQXASSAVVG

SEQ ID NO: 5891 - protein, 83 aa, Homo sapiens
MFEARLVQGSILKKVLEALKDLINEACWDISSSGVNLQSMDSSHVSLVQLTLRSEGFDTYRCDRNLAMGVNLTSMSKILKCAG

SEQ ID NO: 5892 - protein, 116 aa, Homo sapiens
  UNSURE 77: Xaa=Glu or Gly
MSFLGGFFGPICEIDIVLNDGETRKMAEMKTEDGKVEKHYLFYDGESVSGKVNLAFKQPGKRLEHQGIRIEFVGQIXLFNDKSNTHEFVNLVKELALPGELTQSRSYDFEFMQVEK

SEQ ID NO: 5893 - protein, 128 aa, Homo sapiens
MASGCKIGPSILNSDLANLGAECLRMLDSGADYLHLDVMDGHAHDGVQARTVGKANGCSRSQSVHLSSEATENPGALIKDIRENGMKVGLAIKPGTSVEYLAPWANQIDMALVMTVDRGLEGRIHGDM

SEQ ID NO: 5894 - protein, 110 aa, Homo sapiens
  UNSURE 5: Xaa=Gly or Trp
  UNSURE 63: Xaa=any one of the twenty amino acids
  UNSURE 71: Xaa=Asp or Glu
MLDSXADYLHLDVMDGHFVPNITFGHPVVESLRKQLGQDPFFDMHMMVSKPEQWVKPMAVAGXNQYTFHLXATENPGALIKDIRENGMKVGLAIKPGTSVEYLAPWANQI

SEQ ID NO: 5895 - protein, 53 aa, Homo sapiens
MSCSSEIHELVYRYIWIYINQGQCRKGITSRLQQICACQISFISMHFTNDEIR

SEQ ID NO: 5896 - protein, 119 aa, Homo sapiens
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRL

SEQ ID NO: 5897 - protein, 85 aa, Homo sapiens
  UNSURE 67: Xaa=Asn or Thr
  UNSURE 72: Xaa=Ala or Gly
  UNSURE 74: Xaa=Ala or Thr
MLKKFDKKDEESGGGSNPFQHLEKSAVLQEARVFNETPINPRKCAHILTKILYLINQGEHLGTTEAXEAFFXMXKLFQSNDPTLR

SEQ ID NO: 5898 - protein, 115 aa, Homo sapiens
MAASAKKKNKKGKTISLTDFLAEDGGTGGGSTYVSKPVSWADETDDLEGDVSTTWHSNDDDVYRAPPIDRSILPTAPRAAREPNIDRSRLPKSPPYTAFLGNLPYDVTEESIKEF

SEQ ID NO: 5899 - protein, 86 aa, Homo sapiens
  UNSURE 63: Xaa= *  or Ala or Cys or Asp or Glu or Phe or Gly or His or Ile or Lys or Leu or Asn or Pro or Gln or Arg or Ser or Thr or Val or Tyr
MNCEREQLRGNQEAAAAPDTMAQPYASAQFAPPQNGIPAEYTAPHPHPAPEYTGQTTVPEHTXNLYPPAQTHSEQSPADTSAQTVS

SEQ ID NO: 5900 - protein, 53 aa, Homo sapiens
MDDKPNPEALSDSSERLFSFGVIADVQFADLEDGFNFQGTRRRYYRHSLLHLQ

SEQ ID NO: 5901 - protein, 61 aa, Homo sapiens
  UNSURE 24: Xaa=His or Gln
  UNSURE 59: Xaa=Ala or Gly or Pro or Arg
MGIKSEDEAGCSSVDEESYKTLKXQEEVFRNLDAQYEMARSQTHTQRGMGLGFTSSMRXMD

SEQ ID NO: 5902 - protein, 110 aa, Homo sapiens
  UNSURE 73: Xaa=Ile or Thr
  UNSURE 75: Xaa=Phe or Val
  UNSURE 99: Xaa=Leu or Met or Val
MAGLPRRIIKETQRLLAEPVPGIKAEPDESNARYFHVVIAGPQDSPFEGGTFKLELFLPEEYPMAAPKVRFMXKXYHPNVDKLGRICLDILKDKWSPAXQIRTVLLSIQA

SEQ ID NO: 5903 - protein, 116 aa, Homo sapiens
  UNSURE 31: Xaa=Leu or Gln
  UNSURE 109: Xaa= *  or Tyr
MAFTEHSPLTPHRRDLCSRSIWLARKIRSDXTALTESYVKHQGLNKNINLDSADGMPVASTDQWSELTEAERLQENLQAYRTFHVLLARLLEDQQVHFTPTEVTSIKLXIPFFSKS

SEQ ID NO: 5904 - protein, 53 aa, Homo sapiens
  UNSURE 27: Xaa=Arg or Ser or Thr
MALAARLWRLLPFRRGAAPGSRLPAGXSGSRGHCGPCRFRGFEVMGNPGTFKR

SEQ ID NO: 5905 - protein, 67 aa, Homo sapiens
  UNSURE 2: Xaa=Ala or Ser
  UNSURE 27: Xaa=Arg or Ser or Thr
MXLAARLWRLLPFRRGAAPGSRLPAGXSGSRGHCGPCRFRGFEVPPWSWLPLLTSYSVMGNPGTFKR

SEQ ID NO: 5906 - protein, 106 aa, Homo sapiens
  UNSURE 8: Xaa=His or Pro
  UNSURE 57: Xaa=Glu or Gly
  UNSURE 75: Xaa=His or Leu or Pro or Gln or Arg
  UNSURE 100: Xaa=Pro or Arg
  UNSURE 101: Xaa= *  or Gln
MAAPEAPXLDRVFRTTWLSTECDSHPLPPSYRKFLFETQAADLAGGTTVAAGNLLNXSEKDCGQDRRAPGVQPCXLVTMTSVVKTVYSLQPPSALSGGQXXYTQTR

SEQ ID NO: 5907 - protein, 142 aa, Homo sapiens
MVACRAIGILSRFSAFRILRSRGYICRNFTGSSALLTRTHINYGVKGDVAVVRINSPNSKVNTLSKELHSEFSEVMNEIWASDQIRSAVLISSKPGCFIAGADINMLAACKTLQEVTQLSQEAQRIVEKLEKSTKPIVAAIN

SEQ ID NO: 5908 - protein, 71 aa, Homo sapiens
MLSSHHYKSFKVSMIHRLRFTTDVQLGISGDKVEIDPVTNQKASTKFWIKQKPISIDSDLLCACDLAEEKS

SEQ ID NO: 5909 - protein, 62 aa, Homo sapiens
MTGVGGLSRGRSHMGEELRIGLNFERPILFPTGTKNLKSWPGVVAHACNPSTLGGQGGSQGQ

SEQ ID NO: 5910 - protein, 112 aa, Homo sapiens
  UNSURE 9: Xaa=Ile or Asn
MASAARLNXDVGGGHMPYLPGPLRGACEHRVCHSFCQECISQVGKGGGSVCPVCRQRFLLKNLRPNRQLANMVNNLKEISQEAREGTQGERCAVHGERLHLFCEKDGKAFAG

SEQ ID NO: 5911 - protein, 132 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRL

SEQ ID NO: 5912 - protein, 151 aa, Homo sapiens
MTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQ

SEQ ID NO: 5913 - protein, 194 aa, Homo sapiens
  UNSURE 13: Xaa=His or Gln
MTWVPRLPASEAXSRHRGKVKSFPKDDPSKPVHLTAFLGYKAGMTHIVREVDRPGSKVNKKEVVEAVTIVETPPMVVVGIVGYVETPRGLRTFKTVFAEHISDECKRRFYKNWHKSKKKAFTKYCKKWQDEDGKKQLEKDFSSMKKYCQVIRVIAHTQMRLLPLRQKKAHLMEIQVNGGTVAEKLDWARERLEQ

SEQ ID NO: 5914 - protein, 108 aa, Homo sapiens
  UNSURE 82: Xaa=Lys or Arg
MSAFDTNPFADPVDVNPFQDPSVTQLTNAPQAAWRNSTPSQRQMQRQQFLSPNSLGPHSQRFSSHQWNQPSRPPRPWCLQPXQGLLRQQEELDRKAAELERKERELQN

SEQ ID NO: 5915 - protein, 58 aa, Homo sapiens
  UNSURE 37: Xaa=Leu or Arg
MGSNGSTCKPDTERQGTLSTAAPTTSPAPCLSNHHNXYLLIIKSYRKSFIHPRGITYL

SEQ ID NO: 5916 - protein, 54 aa, Homo sapiens
  UNSURE 5: Xaa=Asn or Ser
  UNSURE 14: Xaa=Ala or Asp or Glu or Gly or Ile or Lys or Asn or Arg or Ser or Thr or Val
  UNSURE 17: Xaa= *  or Tyr
  UNSURE 19: Xaa=Cys or Gly
  UNSURE 22: Xaa=Pro or Thr
MSNPXAPPPYEDRXPLXPXPLXPGGYGQPSVLPGGYPAYPGYPQPGYGHPAGYP

SEQ ID NO: 5917 - protein, 60 aa, Homo sapiens
MPAERKKPASMEEKDSLPNNKEKDCSERRTVSSKERPKDDIKLTAKKEVSKAPEDKKKRL

SEQ ID NO: 5918 - protein, 91 aa, Homo sapiens
  UNSURE 56: Xaa=Gly or Leu or Met or Arg or Val or Trp
  UNSURE 73: Xaa=Gly or Ser
  UNSURE 74: Xaa=Arg or Ser
MELGSCFKTYEDFKECFSAYKRENRCSFILRDCVSVRFHNLNHGTSIREDILYVQXEICLHSDPIKQEENAGXXHVPAYLLLRYNERLDRL

SEQ ID NO: 5919 - protein, 87 aa, Homo sapiens
  UNSURE 87: Xaa=Ile or Lys or Asn or Arg or Ser or Thr
MAQETNHSQVPMLCSTGCGFYGNPRTNGMCSVCYKEHLQRQNSSNGRISPPATSVSSLSESLPVQCTDGSVPEAQSALDSTSSMQPX

SEQ ID NO: 5920 - protein, 88 aa, Homo sapiens
  UNSURE 31: Xaa=Pro or Thr
MCKDSQKPSVPSHGPKTPSCKGVKAPHSSRXRAWKQDLEQSLAAAYVPVVVDSKGQNPDKLRFNFYTSQYSNSLNPFYTLQKPTCGLP

SEQ ID NO: 5921 - protein, 53 aa, Homo sapiens
MAAVAAASAELLIIGWYIFRVLLQVSLTGFRVGEGSQLAPLEPARLRRDCRFP

SEQ ID NO: 5922 - protein, 116 aa, Homo sapiens
  UNSURE 58: Xaa=Phe or Val
MRRGGGDRTKKPKESSAAAATFSFISTDPPAWAAAAAAMPSKFSCRQLREAGQCFESXLVVRGLDMETDRERLRTIYNRDFKISFGTPAPGFSSMLYGMKIANLAYVTKTRVRFFR

SEQ ID NO: 5923 - protein, 142 aa, Homo sapiens
  UNSURE 9: Xaa=Gly or Arg
  UNSURE 61: Xaa=Ala or Thr
  UNSURE 137: Xaa= *  or Glu
MSPERRRRXSRAELSARPRAQAAFSCRSVERTPSFIPVSSFFFPVAQPVRWTANRAPVCLXDFHEDNLQGPVWPHFSCFSVLELLLAPSFPGPGVTVATERHEGCPRKECCPDTLGARTGCSGHGSSAASAGAGRRXNPVDE

SEQ ID NO: 5924 - protein, 116 aa, Homo sapiens
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVL

SEQ ID NO: 5925 - protein, 62 aa, Homo sapiens
  UNSURE 46: Xaa= *  or Lys
MVGFGPEDDHFVAELTYNYGVGDYKLGNDFMGITLASSQAVSNARXLEWPLTEVAEGVFETE

SEQ ID NO: 5926 - protein, 94 aa, Homo sapiens
  UNSURE 86: Xaa=Cys or Gly
MADEGKSYSEHDDERVNFPQRKKKGRGPFRWKYGEGNRRSGRGGSGIRSSRLEEDDGDVAMSDAQDGPRVRYTPYTTRLTVGVILXMIEIAFML

SEQ ID NO: 5927 - protein, 74 aa, Homo sapiens
  UNSURE 46: Xaa= *  or Gly or Arg
  UNSURE 52: Xaa=Ile or Leu or Ser or Thr
MVMAGSGNLKVLQLCRFLHMKTGGEMNYGFHLAHHMALGLLFLGGXRYSLSXSNSSIAALLCALYPHFPAHSTD

SEQ ID NO: 5928 - protein, 108 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFT

SEQ ID NO: 5929 - protein, 60 aa, Homo sapiens
MPNASWTGNLRAIKWSDMEDRHGGCHGHYVHGICIYGNGDLKWLVNSPSLFANKFELNTY

SEQ ID NO: 5930 - protein, 60 aa, Homo sapiens
MASAYCNDSIFAYEELRLDSFKDWPRESAVGVAALAKAGLFYTGIKDIVQCFSCGGCLEK

SEQ ID NO: 5931 - protein, 80 aa, Homo sapiens
  UNSURE 30: Xaa=Glu or Gln
  UNSURE 68: Xaa=Ile or Asn or Ser or Thr
  UNSURE 72: Xaa=Ser or Thr
MAMQKIFAREILDSRGNPTVEVDLHTAKGXFRAAVPSGASTGIYEALELRDGDKGRYLGKGVLKAVEXINSXLGPALLQK

SEQ ID NO: 5932 - protein, 85 aa, Homo sapiens
  UNSURE 34: Xaa=Cys or Ser
  UNSURE 85: Xaa=Lys or Met or Arg or Thr
MNPPRFFAQAFPKPPPGLRGFSYWAVVKTRCGDXSSPGLGAAGRESFPLGRFSLLTQEHLQRQLVAEDPGAGRFGTRGELGRREX

SEQ ID NO: 5933 - protein, 64 aa, Homo sapiens
MALSKSMHARNRYKDKPPDFAYLASKYPDFKQHVQINLNGRVSLNFKDPEAVRALTCTLLREDF

SEQ ID NO: 5934 - protein, 100 aa, Homo sapiens
  UNSURE 23: Xaa=Asp or Glu
  UNSURE 66: Xaa=Asp or His or Asn or Tyr
MATAAETSASEPEAESKAGPKAXGEEDEVKAARTRRKVLSRAVAAATYKTMGPAWDQQEEGVSESXGDEYAMASSAESSPGEYEWNMTKRRRKTSWRLRD

SEQ ID NO: 5935 - protein, 102 aa, Homo sapiens
MLSEQGLLSDCGNNYFQMTSCILSGSIQTTPQVSAGGSEAKPLIFTFVPTVRRLPTHTQLADTSKFLVKIPEESSDKSPETVNRSKSNDYLTLNAGSQQERD

SEQ ID NO: 5936 - protein, 96 aa, Homo sapiens
MADAEVIILPKKHKKKKERKSLPEEDVAEIQHAEEFLIKPESKVAKLDTSQWPLLLKNFDKLNVRTTHYTPLACGSNPLKREIGDYIRTGFINLDK

SEQ ID NO: 5937 - protein, 102 aa, Homo sapiens
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHH

SEQ ID NO: 5938 - protein, 93 aa, Homo sapiens
MAERPEDLNLPNAVITRIIKEALPDGVNISKEARSAISRAASVFVLYATSCANNFAMKGKRKTLNASDVLSAMEEMEFQRFVTPLKEALEAYR

SEQ ID NO: 5939 - protein, 105 aa, Homo sapiens
MGSRLSQPFESYITAPPGTAAAPAKPATPATPGAPTSPAEHRLLKTCWSCRVLSGLGLMGAGGYVYWVARKPMKMGYPPSPWTITQMVIGLSENQGIATWGIVVM

SEQ ID NO: 5940 - protein, 128 aa, Homo sapiens
  UNSURE 90: Xaa=Lys or Asn
MGAPATRRCVEWLLGLYFLSHIPITLFMDLQAVLPRELYPVEFRNLLKWYAKEFKDPLLQEPPAWFKSFLFCELVFQLPFFPIATYAFLXGSCKWIRTPAIIYSVHTMTTLIPILSTFLFEDFSKAKW

SEQ ID NO: 5941 - protein, 65 aa, Homo sapiens
  UNSURE 4: Xaa= *  or Tyr
MAEXSYAKSTKLVLKGTKTKRWVLHLRREPPQFFSDALHPPRIRWKPWRGEPALWPPRLCPGPCP

SEQ ID NO: 5942 - protein, 87 aa, Homo sapiens
MAEYSYVKSTKLVLKGTKTKSKKKKSKDKKRKREEDEETQLDIVGIWWTVTNFGEISGTIAIEMDKGTYIHALDNGLFTLGAPHKEV

SEQ ID NO: 5943 - protein, 105 aa, Homo sapiens
  UNSURE 85: Xaa= *  or Tyr
MRLVILDNYDLASEWAAKYICNRIIQFKPGQDRYFTLGLPTGSTPLGCYKKLIEYHKNGHLSFKYVKTFNMDEYVGLPRNHPESXHSYMWNNFFKHIDIDPNNAH

SEQ ID NO: 5944 - protein, 108 aa, Homo sapiens
  UNSURE 95: Xaa=Arg or Ser
MRAPIPEPKPGDLIEIFRPFYRHWAIYVGDGYVVHLAPPSEVAGAGAASVMSALTDKAIVKKELLYDVAGSDKYQVNKQNMMTSTRRCPAAKSSXGRRSWWGRRCSTS

SEQ ID NO: 5945 - protein, 121 aa, Homo sapiens
  UNSURE 6: Xaa=Arg or Ser
  UNSURE 108: Xaa=His or Gln
MGPAGXGKSTYCATMVQHCEALNRSVQVVNLDPAAEHFNYSVMADIRELIEVDDVMEDDSLRFGPNGGLVFCMEYFANNFDWLENCLGHVEDDYILFDCPGQIELYTXLPVMNSWSSSSSS

SEQ ID NO: 5946 - protein, 66 aa, Homo sapiens
MDMGNPGTLSPTKPGSQYYQYSSNNPRRRPLHSSAMEVQTKKVRKVPPGLPSSVYAPSASTADYNR

SEQ ID NO: 5947 - protein, 66 aa, Homo sapiens; identical to SEQ ID NO: 5946

SEQ ID NO: 5948 - protein, 66 aa, Homo sapiens; identical to SEQ ID NO: 5946

SEQ ID NO: 5949 - protein, 123 aa, Homo sapiens
  UNSURE 10: Xaa= *  or Ser
  UNSURE 13: Xaa=Gly or Val
  UNSURE 33: Xaa=Leu or Pro
  UNSURE 105: Xaa=Glu or Gly
  UNSURE 109: Xaa=Phe or Val
  UNSURE 114: Xaa=Gly or Arg
  UNSURE 121: Xaa=Ala or Pro
  UNSURE 123: Xaa=Ala or Pro
MLAKGLPPRXVLXKGCQTFLSAPREGLGRLRVXTGEGAGISTRSPRPFNEIPSPGDNGWLNLYHFWRETGTHKVHLHHVQNFQKYGPIYREKLGNVESVYVIDPXDVAXSLSPXAQPRTIXHX

SEQ ID NO: 5950 - protein, 98 aa, Homo sapiens
MRSSRRRRRRRRRKQRKVKRESRERNAERMESILQALEDIQLDLEAVNIKAGKAFLRLKRKFIQMRRPFLERRDLIIQHIPGFWVKAFLNHPRISILI

SEQ ID NO: 5951 - protein, 51 aa, Homo sapiens
MEYHQPEDPAPGKAGTAEAVIPENHEVLAGPDEHPQDTDARDADGEARETG

SEQ ID NO: 5952 - protein, 149 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGM

SEQ ID NO: 5953 - protein, 89 aa, Homo sapiens
  UNSURE 79: Xaa=Leu or Pro or Gln or Arg
  UNSURE 84: Xaa=Leu or Pro or Gln or Arg
  UNSURE 85: Xaa=Leu or Pro or Gln or Arg
  UNSURE 86: Xaa=Phe or Ile or Leu or Val
  UNSURE 88: Xaa=Ala or Val
MNFEFEREIGFINSQPSLAECLTSFPAVLETFQTSSIKESTLIPPPPPFEQTFPSLQPGASTLQRPRSQKRAEDGPALXPPPPXXXPXA

SEQ ID NO: 5954 - protein, 108 aa, Homo sapiens
  UNSURE 97: Xaa=His or Gln
MVLEVARRMTRTMTTSLYRAQQIIQLNIQASPKVRLSLANEALLPTLICDIAGYYPGCGGDVDPRGAGWIPSPSLWCLLLQPQAKRGRHLQHLLLSXRRTWLCRCHLH

SEQ ID NO: 5955 - protein, 58 aa, Homo sapiens
MTYQDKYCFWLDGAAHEHPPALRTSCTVSEKPWALRNERTATDNCPPSATTTKCCWHY

SEQ ID NO: 5956 - protein, 88 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCH

SEQ ID NO: 5957 - protein, 125 aa, Homo sapiens
MQAIKCVVVGDGAVGKTCLLISYTTNAFPGEYIPTVFDNYSANVMVDSKPVNLGLWDTAGQEDYDRLRPLSYPQTDVFLICFSLVSPASYENVRAKWFPEVRHHCPSTPIILVGTKLDLRDDKDT

SEQ ID NO: 5958 - protein, 66 aa, Homo sapiens
MQTSEREGSGPELSPSVMPEAPLESPPFPTKSPAFDLFNLVLSYKRLEIYLEPLKDAGDGVRYLLR

SEQ ID NO: 5959 - protein, 78 aa, Homo sapiens
  UNSURE 18: Xaa=Phe or Leu
MVGTPVVLFCSCFVFLNXNFTSLDFIILSWHSSKRTLRWELWGTGRRGQLGTGPVGVAVWGMGVCSLALVLGGMRVKK

SEQ ID NO: 5960 - protein, 126 aa, Homo sapiens
  UNSURE 125: Xaa=His or Leu
MTEWETAAPAVAETPDIKLFGKWSTDDVQINDISLQDYIAVKEKYAKYLPHSAGRYAAKRFRKAQCPIVERLTNSMMMHGRNNGKKLMTVRIVKHAFEIIHLLTGENPLQVLVNAIINKWSPGGXA

SEQ ID NO: 5961 - protein, 172 aa, Homo sapiens
  UNSURE 111: Xaa=Ile or Lys
  UNSURE 134: Xaa= *  or Ala or Glu or Gly or Leu or Ser or Val
  UNSURE 156: Xaa=Lys or Arg
MALEGMSKRKRKRSVQEGENPDDGVRGSPPEDYRLGQVASSLFRGEHHSRGGTGRLASLFSSLEPQIQPVYVPVPKQTIKKTKRNEEEESTSQIERPLSQEPAKKVKAKKXHTNAEKKLADRESALASADLEEXIHQKQGQKRKNSQPGVKVADRXILDDTEDTVVSQRKKI

SEQ ID NO: 5962 - protein, 100 aa, Homo sapiens
  UNSURE 65: Xaa=Leu or Pro
MALEGMSKRKRKRSVQEGENPDDGVRGSPPEDYRLGQVASSLFRGEHHSRGGTGRLASLFSSLEXQIQPVYVPVPKVSHWAFFPNSSLEPLTYKAIFLPT

SEQ ID NO: 5963 - protein, 141 aa, Homo sapiens
MRGYLVAIFLSAVFLYYVLHCILWGTNVYWVAPVEMKRRNKIQPCLSKPAFASLLRFHQFHPFLCAADFRKIASLYGSDKFDLPYGMRTSAEYFRLALSKLQSCDLFDEFDNIPCKKCVVVGNGGVLKNKTLGEKIDSYDV

SEQ ID NO: 5964 - protein, 123 aa, Homo sapiens
  UNSURE 97: Xaa=Ala or Asp or Gly or His or Leu or Pro or Arg or Val
MEVGSGSRELSLRPSRSGAQQLEEEGPMEEEEAQPMAAPEGKRSLANGPNAGEQPGQVAGADFESEDEGEEFDDWEDDYDYPEEEQLSGAGYRVSAXLEEADKMFLRTREPAWMAGFRCIMRR

SEQ ID NO: 5965 - protein, 155 aa, Homo sapiens
  UNSURE 102: Xaa=Lys or Asn
  UNSURE 103: Xaa=His or Ile or Lys or Leu or Met or Asn or Pro or Gln or Arg or Ser or Thr
MASSASARTPAGKRVINQEELRRLMKEKQRLSTSRKRIESPFAKYNRLGQLSCALCNTPVKSELLWQTHVLGKQHREKVAELKGAKEASQGSSASSAPQSVXXKAPDADDQDVKRAKATLVPQVQPSTSAWTTNFDKIGKEFIRATPSKPSGLSL

SEQ ID NO: 5966 - protein, 94 aa, Homo sapiens
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNS

SEQ ID NO: 5967 - protein, 106 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKP

SEQ ID NO: 5968 - protein, 69 aa, Homo sapiens
  UNSURE 65: Xaa=Pro or Ser
MILQRLFRFSSVIRSAVSVHLRRNIGVTAVAFNKELDPIQKLFVDKIREYKSKRQTSGGPVDASXEYQQ

SEQ ID NO: 5969 - protein, 103 aa, Homo sapiens
MDLPDSASRVFCGRILSMVNTDDVNAIILAQKNMLDRFEKTNEMLLNFNNLSSARLQQMSERFLHHTRTLVEMKRDLDSIFRRIRTLKGKLARQHPEAFSHIP

SEQ ID NO: 5970 - protein, 52 aa, Homo sapiens
MPSSPLRVAVVCSSNQNRSMEAHNILSKRGFSVRSFGTGTHVKLPGPAPDKP

SEQ ID NO: 5971 - protein, 129 aa, Homo sapiens
MRQKHYLEAAARGLHDSCPGQARYLLWAYTSSHDDKSTFEETCPYCFQLLVLDNSRVRLKPKARLTPKIQKLLNREARNYTLSFKEAKMVKKFKDSKSVLLITCKTCNRTVKHHGKSRSFVSTLQEQSC

SEQ ID NO: 5972 - protein, 121 aa, Homo sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYERQSRDTPILL

SEQ ID NO: 5973 - protein, 91 aa, Homo sapiens
MGICDSSECGGCERCDGCQMFPINGSRFKCRNCDDFDFCETCFKTKKHNTRHTFGRINEPGFSRRNTSYKSRPNRKVQFFSCSKPENTLSS

SEQ ID NO: 5974 - protein, 71 aa, Homo sapiens
  UNSURE 56: Xaa=Ser or Thr
MQAVWDLEQGKYGFAVQRGRMPPTQPTHGQFALTNGDPSTATRTCPDIFPCCCARXLSHVALRQPMHAAQQ

SEQ ID NO: 5975 - protein, 71 aa, Homo sapiens
MKVLNELYSVMKTYHMYNADSISAQSKLKEAEKQEEKQIGKSVKQEDRQTPRSPDSTANVRIEEKHVRRSS

SEQ ID NO: 5976 - protein, 121 aa, Homo sapiens
MASPQGGQIAIAMRLRNQLQSVYKMDPLRNEEEVRVKIKDLNEHIVCCLCAGYFVDATTITECLHTFCKSCIVKYLQTSKYCPMCNIKIHETQPLLNLKLDRVMQDIVYKLVPGLQDSEEK

SEQ ID NO: 5977 - protein, 62 aa, Homo sapiens
MTCLGFLMTTTSKHAAYCLKGSCLTQARVQWPLKLTTASNFWAQVILSLPVVFVDCLMESHG

SEQ ID NO: 5978 - protein, 55 aa, Homo sapiens
  UNSURE 18: Xaa=Asn or Thr
  UNSURE 28: Xaa=His or Leu
  UNSURE 53: Xaa=Ser or Tyr
MTTTSKHAAYCLKGSCLXQARVQWPLKXTTASNFWAQVILSLPVVFVDCLMEXHG

SEQ ID NO: 5979 - protein, 62 aa, Homo sapiens; identical to SEQ ID NO: 5977

SEQ ID NO: 5980 - protein, 55 aa, Homo sapiens; identical to SEQ ID NO: 5978
  UNSURE 18: Xaa=Asn or Thr
  UNSURE 28: Xaa=His or Leu
  UNSURE 53: Xaa=Ser or Tyr

SEQ ID NO: 5981 - protein, 55 aa, Homo sapiens; identical to SEQ ID NO: 5978
  UNSURE 18: Xaa=Asn or Thr
  UNSURE 28: Xaa=His or Leu
  UNSURE 53: Xaa=Ser or Tyr

SEQ ID NO: 5982 - protein, 58 aa, Homo sapiens
MDRLLRLGGGMPGLGQGPPTDAPAVDTAEQVYISSLALLKMLKHGRAGVPMEVMGLML

SEQ ID NO: 5983 - protein, 86 aa, Homo sapiens
MPLEKFVDMEFLDQMILRGTCLEADLCPQYTNSPFNAHTDQITQTHLPPQHLDSSHSTHTCLPVHRHIQRHTDKHHSKKMFPRTHG

SEQ ID NO: 5984 - protein, 131 aa, Homo sapiens
MERIILDKLNWDLHTATPLDFLHIFHAIAVSTRPQLLFSLPKLSPSQHLAVLTKQLLHCMACNQLLQFRGSMLALAMVSLEMEKLIPDWLSLTIELLQKAQMDSSQLIHCRELVAHHLSTLQSSLPLNSVY

SEQ ID NO: 5985 - protein, 57 aa, Homo sapiens
  UNSURE 57: Xaa=Arg or Trp
MSLPSGHTTGHTDQVVQRRARCWDIYQRRFSSRSEPVNPGMHSSSHQQQRWRCSNAX

SEQ ID NO: 5986 - protein, 56 aa, Homo sapiens
MAMASVKLLAGVLRKPDAWIGLWGVLRGTPSSYKLCTSWNRYLYFSSTKLRAPNYK

SEQ ID NO: 5987 - protein, 78 aa, Homo sapiens
  UNSURE 37: Xaa=Leu or Pro or Gln or Arg
MDHHQPGTGRYQVLLNEEDNSESSAIEQPPTSNPAPXIVQAASSAPALETDSSPPPYSSITVEVPTTSDTEVYGEFYP

SEQ ID NO: 5988 - protein, 71 aa, Homo sapiens
MPCAYLSIDAMDVAGEQQLDVEHNLFKQRLDKDGIPVSSEAERHELGKVEVTVFDPDSLDPDRCESCYGAE

SEQ ID NO: 5989 - protein, 60 aa, Homo sapiens
MLDKEISQFVSEGYSVDELEDHITQLHEYNDIKDVGQMLMGKLAVIRGVTTKELYPEFGL

SEQ ID NO: 5990 - protein, 120 aa, Homo sapiens
  UNSURE 86: Xaa=Ala or Asp or Glu or Gly or Val
  UNSURE 87: Xaa= *  or Lys
  UNSURE 101: Xaa=Arg or Ser
  UNSURE 102: Xaa=Ala or Asp or Glu or Gly or Ile or Lys or Met or Asn or Arg or Ser or Thr or Val
  UNSURE 113: Xaa=Ala or Cys or Asp or Phe or Gly or His or Ile or Leu or Asn or Pro or Arg or Ser or Thr or Val or Tyr
MVDYSVWDHIEVSDDEDETHPNIDTASLFRWRHQARVERMEQFQKEKEELDRGCRECKRKVAECQRKLKELEVAEGGKAELERLQXXAQQLRKEERTGSRXXEEMRKKEKSMXGTWTRSA

SEQ ID NO: 5991 - protein, 87 aa, Homo sapiens
MVDYSVWDHIEVSDDEDETHPNIDTASLFRWRHQARVERMEQFQKEKEELDRGCRECKRKVAECQRKLKELEVAEGGKAAPPSLPLL

SEQ ID NO: 5992 - protein, 116 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIY

SEQ ID NO: 5993 - protein, 93 aa, Homo sapiens
  UNSURE 76: Xaa= *  or Glu
MEGKRGEQRKHIQKSPRGLCASAPFSCCLEQGVSRKMFLSKVFMEPLLPLYLCSSLKLRTHVSAKTSGDPKRERHXQVTSGGLATKEYLKFNS

SEQ ID NO: 5994 - protein, 60 aa, Homo sapiens
  UNSURE 5: Xaa=Ala or Thr
MASVXLSEAEKVYIVHGVQEDLRVDGRGCEDYRCVEVETDVVSNTSGSARVKLGHTDILV

SEQ ID NO: 5995 - protein, 105 aa, Homo sapiens
  UNSURE 93: Xaa= *  or Leu
MDAILNYRSEDTEDYYTLLGCDELSSVEQILAEFKVRALECHPDKHPENPKAVETFQKLQKAKEILTNEESRARYDHWRRSQMSMPFQQWEAXNDSVKTSMHWVV

SEQ ID NO: 5996 - protein, 94 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSH

SEQ ID NO: 5997 - protein, 105 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTN

SEQ ID NO: 5998 - protein, 96 aa, Homo sapiens
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASF

SEQ ID NO: 5999 - protein, 81 aa, Homo sapiens
MSDKLPYKVADIGLAAWGRKALDIAENEMPGLMRMRERYSASKPLKGARIAGCLHMTVETAVLIETLVTLGAEVQWSSCNI

SEQ ID NO: 6000 - protein, 103 aa, Homo sapiens
  UNSURE 19: Xaa=Ala or Glu or Gly or Val
  UNSURE 61: Xaa= *  or Trp
  UNSURE 86: Xaa= *  or Cys or Trp
MFSAGAESLLHQAREIQDXELKKFCSRICKLLQAEDLGPDTLDSLQRLFLIISATKYSRRXKKTCVDLLQATLGLPACPEQLQVLXAPSCERCPPLTASALGL

SEQ ID NO: 6001 - protein, 79 aa, Homo sapiens
  UNSURE 67: Xaa=Ile or Met
MEEAVPCQRHLFQAKRFNRRAYCGQCSERIWGLARQGYRCINCKLLVHKRCHGLVPLTCRKHMDSVXPSQEPPVDDKNE

SEQ ID NO: 6002 - protein, 82 aa, Homo sapiens
MDGEDIPDFSSLKEETAYWKELSLKYKQSFQEARDELVEFQEGSRELEAELEAQLVQAEQRNRDLQADNQRLKYEVEALKES

SEQ ID NO: 6003 - protein, 67 aa, Homo sapiens
  UNSURE 4: Xaa=Pro or Gln
  UNSURE 63: Xaa=Asn or Thr
MASXAASSVRPPRPKKEPQTLVIPKNAAEEQKLKLERLMKNPVQVLGPAVESSTCTDICAGEXISDR

SEQ ID NO: 6004 - protein, 83 aa, Homo sapiens
  UNSURE 43: Xaa=Phe or Leu
MTEFWLISAPGEKTCQQTWEKLHAATSKNNNLAVTSKFNIPDXKVGTLDVLVGLSDELAKLDAFVEGVVKKVAQYMADVLEDS

SEQ ID NO: 6005 - protein, 103 aa, Homo sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTI

SEQ ID NO: 6006 - protein, 57 aa, Homo sapiens
MMMDLFETGSYFFYLDGENVTLQPLEVAEGSPLYPGSDGTLSPCQDQMPPEAGSDSS

SEQ ID NO: 6007 - protein, 121 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQA

SEQ ID NO: 6008 - protein, 77 aa, Homo sapiens
MTVHDKFLALGTHYGKVYLLDVQGNITQKFDVSPVKINQISLDESGEHMGVCSEDGKVQVFGLYSGEEFHETFDCPI

SEQ ID NO: 6009 - protein, 54 aa, Homo sapiens
  UNSURE 16: Xaa=Gly or Ser
MATFPPATSAPQQPPXPEDEDSSLDESDLYSLAHSYLGKAHSAISTVLPPLPKS

SEQ ID NO: 6010 - protein, 100 aa, Homo sapiens
  UNSURE 44: Xaa=Ile or Val
MTTLRAFTCDDLFRFNNINLDPLTETYGIPFYLQYLAHWPEYFXVAEAPGGELMGYIMGKAEGSVAREEWHGHVTALSVAPEFRRLGLAAKLMELLEEIQ

SEQ ID NO: 6011 - protein, 143 aa, Homo sapiens
  UNSURE 127: Xaa= *  or Ala or Glu or Gly or Lys or Leu or Met or Pro or Gln or Arg or Ser or Thr or Val or Trp
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMDMLASTGSGLCCSVAVQPXASSSTLCVFVPSSVHA

SEQ ID NO: 6012 - protein, 90 aa, Homo sapiens
MSAHLQWMVVRNCSSFLIKRNKQTYSTEPNTLVAGITGACHHTQLIFIFLVKTGFHHVGQASHELLTSGDPPASASQSAGITGMNHCAQG

SEQ ID NO: 6013 - protein, 113 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYQRVGLFSLMLV

SEQ ID NO: 6014 - protein, 73 aa, Homo sapiens
  UNSURE 6: Xaa=Ile or Met
  UNSURE 7: Xaa=Glu or Gly
  UNSURE 33: Xaa=His or Gln
  UNSURE 50: Xaa=Cys or Trp
  UNSURE 59: Xaa=Ala or Pro
  UNSURE 64: Xaa=Lys or Asn
  UNSURE 71: Xaa=Met or Arg
MSNDKXXDRVSRAKTTKRPPKFVFKKTNEKSKXSEREVQDHGCAYLHSHXWVLKFSSGXVPAAXPLPKGQXRP

SEQ ID NO: 6015 - protein, 59 aa, Homo sapiens
MRASWLLPGLREIKLWAQVMKPTSPGDTVSELQGPASGARSRAEEHFRRHWPLPQWLRS

SEQ ID NO: 6016 - protein, 75 aa, Homo sapiens
MANMADTKLYDILGVPPGASENELKKAYRKLAKEYHPDKNPNAGDKFKEISFAYEVLSNPEKRELYDRYGEQGLR

SEQ ID NO: 6017 - protein, 127 aa, Homo sapiens
  UNSURE 67: Xaa=Asp or His or Asn or Tyr
MLKPALEPRGGFSFENCQRNASLERVLPGLKVPHARKTGTTIAGLVFQDGVILGADTRATNDSVVAXKSCEKIHFIAPKIYCCGAGVAADAEMTTRMVASKMALHALSTGREPRVATVTRILRQTLF

SEQ ID NO: 6018 - protein, 132 aa, Homo sapiens
MANMQGLVERLERAVSRLESLSAESHRPPGNCGEVNGVIAGVAPSVEAFDKLMDSMVAEFLKNSRILAGDVETHAEMVHSAFQAQRAFLLMASQYQQPHENDVAALLKPISEKIQEIQTFRERNRGSNMFNH

SEQ ID NO: 6019 - protein, 104 aa, Homo sapiens
  UNSURE 50: Xaa=Phe or Ser
MCAVSSIEEQCRASVYRYYGKNISLTLYDEANTNTMKATERYDIFDPRQXIPVRESTVVTRTWDSSCQITDGSLQLTSWLTTVKKNLGLFYFIFVGHHNPKSKG

SEQ ID NO: 6020 - protein, 88 aa, Homo sapiens
MESSSSSNSYFSVGPTSPSAVVLLYSKELKKWDEFEDILEERRHVSDLKFAMKCYTPLVYKGITPCKPIDIKCSVLNSEEIHYVIKQL

SEQ ID NO: 6021 - protein, 112 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMP

SEQ ID NO: 6022 - protein, 88 aa, Homo sapiens
MTVGKSSKMLQHIDYRMRCILQDGRIFIGTFKAFDKHMNLILCDCDEFRKIKPKNSKQAEREEKRVLGLVLLRGGFITDHQRNASQNH

SEQ ID NO: 6023 - protein, 61 aa, Homo sapiens
MVMEKPSPLLVGREFVRQYYTLLNQAPDMLHRFYGKNSSYVHGGLDSNGKPADAVYGQKEI

SEQ ID NO: 6024 - protein, 52 aa, Homo sapiens
MVMEKPSPLLVGREFVRQYYTLLNQAPDMLHRFYGKNSSYVHGGLDSNGKPA

SEQ ID NO: 6025 - protein, 123 aa, Homo sapiens
MAEASFGSSSPVGSLSSEDHDFDPTAEMLVHDYDDERTLEEEEMMDEGKNFSSEIEDLEKEGTMPLEDLLAFYGYEPTIPAVANSSANSSPSELADELPDMTLDKEEIAKDLLSGDDEETQSS

SEQ ID NO: 6026 - protein, 124 aa, Homo sapiens
  UNSURE 46: Xaa=Gln or Arg
MGLFGKTQEKPPKELVNEWSLKIRKEMRVVDRQIRDIQREEEKVKXSVKDAAKKGQKDVCIVLAKEMIRSRKAVSKLYASKAHMNSVLMGMKNQLAVLRVAGSLQKSTEVMKAMQSLVKIPEIQ

SEQ ID NO: 6027 - protein, 92 aa, Homo sapiens
  UNSURE 86: Xaa=Met or Arg
MGSKAKKRVLLPTRPAPPTVEQILEDVRGAPAEDPVFTILAPEDPPVPFRMMEDAEAPGEQLYQQSRAYVAANQRLQQAGNVLRQXCELLQR

SEQ ID NO: 6028 - protein, 121 aa, Homo sapiens
  UNSURE 16: Xaa=Ala or Ser
  UNSURE 33: Xaa=Asp or Glu
  UNSURE 34: Xaa=Asp or Tyr
  UNSURE 56: Xaa=Gly or Val
  UNSURE 110: Xaa= *  or Gly or Arg
MGSKAKKRVLLPTRPXPPTVEQILEDVRGAPAXXPVFTILAPEGRGSPVPGKSGPXTPAARGRERSTPLTPDPTPWEPPQHGHGPYPLRVSLYSSVEWDRFSEGSSDRGXGRALWFRPVSP

SEQ ID NO: 6029 - protein, 80 aa, Homo sapiens
  UNSURE 23: Xaa=Asp or Asn
MGSKAKKRVLLPTRPAPPTVEQXPGGCAGCAGRGSSVHHPGPGRLECSGEISTHCRLRLPSSSDSPASASGVAGTTDTRH

SEQ ID NO: 6030 - protein, 86 aa, Homo sapiens
MAAIRKKLVIVGDGACGKTCLLIVFSKDQFPESTSLLSLRTILRTLRWTASRWSWLCGTQQGRKTMIDCGLSPTRTLMSSSCASPS

SEQ ID NO: 6031 - protein, 86 aa, Homo sapiens
  UNSURE 15: Xaa=Ala or Thr
  UNSURE 27: Xaa=Lys or Met
  UNSURE 43: Xaa=Phe or Ile
MAAIRKKLVIVGDGXCGKTCLLIVFSXDQFPEVYVPTVFENYXADIEVDGKQVELALWDTAGQEDYDRLRPLSYPDTDVILMCFSI

SEQ ID NO: 6032 - protein, 69 aa, Homo sapiens
MAAIRKKLVIVGDGACGKTCLLIVFSKDQFPEVYVPTVFENYIADIEVDGKQVELALWDTAGQEDYDRP

SEQ ID NO: 6033 - protein, 86 aa, Homo sapiens
  UNSURE 77: Xaa=Ile or Lys or Arg or Thr
MAVTKELLQMDLYALLGIEEKAADKEVKKAYRQKALSCHPDKNPDNPRAAELFHQLSQALEVLTDAAARAAYDKVRXAKKQAAERT

SEQ ID NO: 6034 - protein, 63 aa, Homo sapiens
MRSMASGGGVPTDEEQATGLEREIMLAAKKGLDPYNVLAPKGASGTREDPNLVPSISNKRIVG

SEQ ID NO: 6035 - protein, 59 aa, Homo sapiens
MNDISQKAEIKEMLASDDEEDVSSKVEKAYVPKLTGTVKGRFAEMEKQRQEEQRKRTEE

SEQ ID NO: 6036 - protein, 154 aa, Homo sapiens
  UNSURE 143: Xaa=Ile or Asn or Ser or Thr
MAFWCQRDSYAREFTTTVVSCCPAELQTEGSNGKKEVLSGFQVVLEDTVLFPEGGGQPDDRGTINDISVLRVTRRGEQADHFTQTPLDPGSQVLVRVDWERRFDHMQQHSGQHLITAVADHLFKLKTTSWELGRFRSAIELDXPSMTAEQVAAI

SEQ ID NO: 6037 - protein, 225 aa, Homo sapiens
  UNSURE 203: Xaa= *  or Cys or Trp
MAGVEEVAASGSHLNGDLDPDDREEGAASTAEEAAKKKRRKKKKSKGPSAAGEQEPDKESGASVDEVARQLERSALEDKERDEDDEDGDGDGDGATGKKKKKKKKKRGPKVQTDPPSVPICDLYPNGVFPKGQECEYPPTQDGRTAAWRTTSEEKKALDQASEEIWNDFREAAEAHRQVRKYVMSWIKPGMTMIEICEKLEDXSRKLIKENGLNAGLAFPTGCSL

SEQ ID NO: 6038 - protein, 53 aa, Homo sapiens
  UNSURE 45: Xaa=Arg or Ser
MTLDMDAVLSDFVRSTGAEPGLARDLLEGKNWDVNAALSDFEQLXQVHAGNLP

SEQ ID NO: 6039 - protein, 88 aa, Homo sapiens
  UNSURE 2: Xaa=Asp or Ile or Asn or Val
MXPRKRYGSKNTDQGVYLGLSKTQVLSPATAGSSSSDIAPLPPPVTLVPPPPDTMSCRDRTQEFLSACKSLQTRQNGIQTNKPALRAA

SEQ ID NO: 6040 - protein, 110 aa, Homo sapiens
  UNSURE 107: Xaa=Cys or Arg
MSTLCPPPSPAVAKTEIALSGKSPLLAATFAYWDNILGPRVRHIWAPKTEQVLLSDGEITFLANHTLNGEILRNAESGAIDVKFFVLSEKGVIIVSLIFDGNWNGDXSTY

SEQ ID NO: 6041 - protein, 107 aa, Homo sapiens
  UNSURE 64: Xaa=Phe or Leu
  UNSURE 72: Xaa=Ile or Lys or Met or Asn or Arg or Ser or Thr
  UNSURE 73: Xaa=Ala or Cys or Asp or Phe or Gly or Ser or Val or Tyr
  UNSURE 92: Xaa=His or Gln
  UNSURE 94: Xaa=Ala or Pro
  UNSURE 104: Xaa=Asp or Gly
MVNLGLSRVDDAVAAKHPGLGEYAACQSHAFMKGVFTFVTGTGMAFGLQMFIQRKLTGLLLYLXDNNNVHFXXLVLGHSGKGEWGPEGSLPXPXGVLLYLCVSXARD

SEQ ID NO: 6042 - protein, 128 aa, Homo sapiens
MSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQ

SEQ ID NO: 6043 - protein, 61 aa, Homo sapiens
MGETEGKKDEADYKRLQTFPLVRHSDMPEEMRVETMELCVTACEKFSNNNESAAKMIKETI

SEQ ID NO: 6044 - protein, 84 aa, Homo sapiens
MDLSELERDNTGRCRLSSPVPAVCRKEPCVLGVDEAGRGPVLGPMVYAICYCPLPRLADLEALKVADSKTLLESERERLFAKME

SEQ ID NO: 6045 - protein, 87 aa, Homo sapiens
  UNSURE 19: Xaa=Lys or Gln
  UNSURE 82: Xaa=Leu or Val
  UNSURE 83: Xaa=Pro or Thr
  UNSURE 85: Xaa=His or Leu or Pro or Gln or Arg
MVKLGCSFSGKPGKDPGDXDGAAMDSVPLISPLDISQLQPPLPDQVVIKTQTEYQLSSPDQQNFPDLEGQRLNCSQEEGRRXXTXTP

SEQ ID NO: 6046 - protein, 129 aa, Homo sapiens
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTL

SEQ ID NO: 6047 - protein, 107 aa, Homo sapiens
  UNSURE 90: Xaa=Pro or Thr
MQRRVKEGYRDGIDAGKAVTLQQGFNQGYKKGAEVILNYGRLRGTLSALLSWCHLHNNNSTLINKINNLLDAVGQCEEYVLKHLKSITPXSHVVDLLDSIEDMDLCH

SEQ ID NO: 6048 - protein, 69 aa, Homo sapiens
MELGELLYNKSEYIETASGNKVSRQSVLCGSQNIVLNGKTIVMNDCIIRGDLANVRVGRHCVVKSRSVI

SEQ ID NO: 6049 - protein, 123 aa, Homo sapiens
  UNSURE 116: Xaa=Asp or Gly
MAELDIGQHCQVEHCRQRDFLPFVCDDCSGIFCLEHRSRESHGCPEVTVINERLKTDQHTSYPCSFKDCAERELVAVICPYCEKNFCLRHRHQSDHECEKLEIPSSNGCTQKLVKXIIDSKTG

SEQ ID NO: 6050 - protein, 56 aa, Homo sapiens
  UNSURE 14: Xaa=Pro or Thr
  UNSURE 30: Xaa=Ala or Gly
  UNSURE 43: Xaa=Asp or Tyr
  UNSURE 55: Xaa=His or Tyr
MISQFFILSSKGDXLIYKDFRGDSGGRDVXELFYRKLTGLPGXESPVVMHHHGRXF

SEQ ID NO: 6051 - protein, 92 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTA

SEQ ID NO: 6052 - protein, 57 aa, Homo sapiens
MLWGFCGQAPPFPGHGTRTALMATARRGAFVSPCAVSVFSTTSLPCPLGYLLIYLLC

SEQ ID NO: 6053 - protein, 119 aa, Homo sapiens
  UNSURE 37: Xaa=Pro or Ser
  UNSURE 46: Xaa=Ile or Thr
  UNSURE 47: Xaa=Leu or Met or Val
  UNSURE 65: Xaa=Asp or Glu
  UNSURE 76: Xaa=Asp or Glu
  UNSURE 92: Xaa=Leu or Met or Ser or Thr
  UNSURE 93: Xaa= *  or Ala or Glu or Gly or Lys or Leu or Met or Pro or Gln or Arg or Ser or Thr or Val or Trp
  UNSURE 106: Xaa=Ile or Ser
  UNSURE 116: Xaa=Asp or His or Asn or Tyr
MLMAWCRGPVLLCLRQGLGTNSFLHGLGQEPFEGARXLCCRSSPRXXRDGEREHEAAQRKAPGAXSCPSLPLSISXIGTGCLSSLENLRLPXXREESSPRELEDSXGDQGRCGPTXQGS

SEQ ID NO: 6054 - protein, 138 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGFS

SEQ ID NO: 6055 - protein, 73 aa, Homo sapiens
METILEQQRRYHEEKERLMDVMAKEMLTKKSTLRDQINSDHRTRAMQDRYMEVSGNLRDLYDDKDGLRKEELN

SEQ ID NO: 6056 - protein, 178 aa, Homo sapiens
  UNSURE 175: Xaa=Lys or Asn
MMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVVKHKMKXLVW

SEQ ID NO: 6057 - protein, 57 aa, Homo sapiens
MEEAELVKGRLQAITDKRKIQEEISQKRLKIEEDKLKHQHLKKKALREKWLLDGISS

SEQ ID NO: 6058 - protein, 57 aa, Homo sapiens; identical to SEQ ID NO: 6057

SEQ ID NO: 6059 - protein, 60 aa, Homo sapiens
MSPKPRASGPPAKATEAGKRKSSSQPSPSDPKKKTTKVAKKGKAVRRGRRGKKGAATKMA

SEQ ID NO: 6060 - protein, 51 aa, Homo sapiens
  UNSURE 35: Xaa=His or Leu or Pro or Arg
MDFDERGPCSSNMYLPSCTYYVSGPDFSSLPSFLXQTPSSRPMTYSYSSNL

SEQ ID NO: 6061 - protein, 85 aa, Homo sapiens
  UNSURE 64: Xaa=Leu or Pro or Gln or Arg
  UNSURE 66: Xaa=Lys or Gln
  UNSURE 71: Xaa=Ser or Thr
MSPQAREDQLQRKAVVLEYFTRHKRKEKKKKAKGLSARQRRELRLFDIKPEQQRYSLFLPLHEXWXQYIRXCAVGSSRHAATDDS

SEQ ID NO: 6062 - protein, 96 aa, Homo sapiens
MEERAFVNPFPDYEAAAGALLASGAAEETGCVRPPATTDEPGLPFHQDGKIIHNFIRRIQTKIKDLLQQMEEGLKTADPHDCSAYTGWTGIAFCTC

SEQ ID NO: 6063 - protein, 147 aa, Homo sapiens
MAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQTEERCD

SEQ ID NO: 6064 - protein, 63 aa, Homo sapiens
MAQKHPGERGLYGAHHSGGASLRTLGPSVDPEIPSFSGLRDSAGTAPNGTRCLTEHSGPKHTQ

SEQ ID NO: 6065 - protein, 96 aa, Homo sapiens
MSFTLVAQAGVQWRDLGSPQPLPPGFKRFSCFSLPSSWDYRHVPLLPANLVFLVEMGFLHVGPAGLGLPTSGDLPASASQSAGIIGVSHRSQPFFM

SEQ ID NO: 6066 - protein, 86 aa, Homo sapiens
  UNSURE 71: Xaa=Cys or Gly or Arg or Ser
MEARDKQVLRSLRLELGAEVLVEGLVLQYLYQEGILTENHIQEINAQTTGLRKTMLLLDILPSRGPKAFDXIPRFPTGVSLGQGEA

SEQ ID NO: 6067 - protein, 146 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNE

SEQ ID NO: 6068 - protein, 56 aa, Homo sapiens
  UNSURE 43: Xaa= *  or Ser or Tyr
  UNSURE 51: Xaa=Asp or Glu
  UNSURE 54: Xaa=Arg or Thr
MMKENFPNFLSACDKKGTNYLADVFEKKDKNEDKKIDFSEFLXLLGDIATXYHXSR

SEQ ID NO: 6069 - protein, 117 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEM

SEQ ID NO: 6070 - protein, 110 aa, Homo sapiens
MADYSTVPPPSSGSAGGGGGGGGGGGVNDAFKDALQRARQIAAKIGGDAGTSLNSNDYGYGGQKRPLEDGDQPDAKKVAPQNDSFGTQLPPMHQQQRSVMTEEYKVPDGM

SEQ ID NO: 6071 - protein, 71 aa, Homo sapiens
MGCDGGTIPKRHELVKGPKKVEKVDKDAELVAQWNYCTLSQEILRRPIVACELGRLYNKDAVIEFLLDKSA

SEQ ID NO: 6072 - protein, 106 aa, Homo sapiens
  UNSURE 12: Xaa=Ala or Pro
  UNSURE 43: Xaa=Leu or Arg
  UNSURE 65: Xaa=His or Gln
  UNSURE 80: Xaa=Ala or Glu or Gly or Val
  UNSURE 95: Xaa=Phe or Leu
MDVHDLFRRLGXGAKFDTRRFSADAARFQIGKRKYDFDSSEVXQGLDFFGNKKSVPGVCGASQTXSEAPKGEKKEESLTXKEEGAEQEKKEDDDXRKLLPKKKVLL

SEQ ID NO: 6073 - protein, 58 aa, Homo sapiens
MTESASSTSGQEFDVFSVMDWKDGVGTLPGSDLKFRVNEFGALEVITDENEMENVKKA

SEQ ID NO: 6074 - protein, 93 aa, Homo sapiens
MAVQFDGGVVLGADSRTTTGSYIANRVTDKLTPIHDRIFCCRSGSAADTQAVADAVTYQLGFHSIELNEPPLVHTAASLFKEMCYRYREDLMA

SEQ ID NO: 6075 - protein, 92 aa, Homo sapiens
MAAPILKDVVAYVEVWSSNGTENYSKTFTTQLVDMGAKVSKTFNKQVTHVIFKDGYQSTWDKAQKRGVKLVSVLWVEKCRTAGAHIDESLFP

SEQ ID NO: 6076 - protein, 99 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHL

SEQ ID NO: 6077 - protein, 97 aa, Homo sapiens
MEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDY

SEQ ID NO: 6078 - protein, 142 aa, Homo sapiens
MAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFE

SEQ ID NO: 6079 - protein, 56 aa, Homo sapiens
  UNSURE 36: Xaa=Gly or Val
MFFLLHFIVLINVKDFALTQGSMITPSCQKGYFPVXILPSAYPELFTVMARMTVGT

SEQ ID NO: 6080 - protein, 98 aa, Homo sapiens
MFYFRGCGRWVAVSFTKQQFPLARLSSDSAAPRTPHFDVIVIGGGHAGTEAATAAARCGSRTLLLTHRVDTIGQMSCNPSFGGIGKGHLMREVDALDG

SEQ ID NO: 6081 - protein, 56 aa, Homo sapiens
MEFDLGAALEPTSQKPGVGAGHGGDPKLSPHKVQGRSEAGAGPGPKQGHHSSSDSS

SEQ ID NO: 6082 - protein, 94 aa, Homo sapiens
  UNSURE 38: Xaa=Asp or Glu
  UNSURE 58: Xaa=His or Asn
MMEGLDDGPDFLSEEDRGLKAINVDLQSDAALQVDISXALSERDKVKFTVHTKSSLPXFKQNEFSVVRQHEEFIWLHDSFVENEDYAGYIIPPA

SEQ ID NO: 6083 - protein, 66 aa, Homo sapiens
MEGSLEREAPAGALAAVLKHSSTLPPESTQVRGYDFNRGVNYRALLEAFGTTGFQATNFGRAVQQV

SEQ ID NO: 6084 - protein, 120 aa, Homo sapiens
  UNSURE 109: Xaa=Asn or Thr
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSXPTPFFPHLRWR

SEQ ID NO: 6085 - protein, 101 aa, Homo sapiens
  UNSURE 7: Xaa=Asp or Asn
  UNSURE 16: Xaa=Pro or Ser
  UNSURE 52: Xaa=Asn or Tyr
  UNSURE 76: Xaa=Gly or Val
MVKLGNXFAEKGTKQXLLEDGFDTIPLMTPLDVNQLQFPPPDKVVVKTKTEXEPDRKKGKARPPQIAEFTVSITEXVTERFKVSVLVLFALAFLTCVVFLA

SEQ ID NO: 6086 - protein, 118 aa, Homo sapiens
  UNSURE 79: Xaa=Ala or Asp or Gly or His or Leu or Pro or Arg or Val
MSNVNLSVSDFWRVMMRVCWLVRQDSRHQRIRLPHLEAVVIGRGPETKITDKKCSRQQVQLKAECNKGYVKVKQVGVNXTSIDSVVIGKDQEVKLQPGQVLHMVNELYPYIVEFEEEA

SEQ ID NO: 6087 - protein, 94 aa, Homo sapiens
  UNSURE 66: Xaa=Lys or Asn
  UNSURE 69: Xaa= *  or Leu or Ser
MRKVVLITGASSGIGLALCKRLLAEDDELHLCLACRNMSKAEAVCAALLASHPTAEVTIVQVDVSXLQXFFRASKELKQRMIKKWLYVIRVEDH

SEQ ID NO: 6088 - protein, 110 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTL

SEQ ID NO: 6089 - protein, 118 aa, Homo sapiens
  UNSURE 57: Xaa=Ile or Met
  UNSURE 58: Xaa=Asp or Asn
  UNSURE 75: Xaa=Leu or Arg
  UNSURE 109: Xaa=Glu or Lys
MSDRPTARRWGKCGPLCTRENIMVAFKGVWTQAFWKAVTAEFLAMLIFVLLSLGSTXXWGGTEKPLPVDMVLISXCFGLSIATMVQCFGHISGGHINPAVTVAMVCTRXISIAKSVFY

SEQ ID NO: 6090 - protein, 53 aa, Homo sapiens
MNVTPEVKSRGMKFAEEQLLKHGWTQGKGLGRKENGITQALRVTLKQDTHGVG

SEQ ID NO: 6091 - protein, 126 aa, Homo sapiens
MMLKGITRLISRIHKLDPGRFLHMGTQARQSIAAHLDNQVPVESPRAISRTNENDPAKHGDQHEGQHYNISPQDLETVFPHGLPPRFVMQVKTFSEACLMVRKPALELLHYLKNTSFAYPAIRYLL

SEQ ID NO: 6092 - protein, 90 aa, Homo sapiens
MAFPHLQQPSFLLASLKADSINKPFAQQCQDLVKVIEDFPAKELHTIFPWLVESIFGSLDGVLVGWNLRCLQGRVNPVEYSIVMEFLDPG

SEQ ID NO: 6093 - protein, 64 aa, Homo sapiens
MDWLMGKSKAKPNGKKPAAEERKAYLEPEHTKARITDFQFKELVVLPREIDLNEWLASNNDVFP

SEQ ID NO: 6094 - protein, 58 aa, Homo sapiens
MAASRKPPRVRVNHQDFQLRNLRIIEPNEVTHSGDTGVETDGRMPPKVTSELLRQLRQ

SEQ ID NO: 6095 - protein, 57 aa, Homo sapiens
  UNSURE 19: Xaa=Gly or Arg
  UNSURE 23: Xaa=Ala or Asp or Gly or Ile or Asn or Ser or Thr or Val
  UNSURE 52: Xaa=Asp or Gly
MKSQWCRPVAMDLGVYQLXHFSXSFLSSLLGTENASVRLDNSSSGASVVAIXNKIEQ

SEQ ID NO: 6096 - protein, 127 aa, Homo sapiens
  UNSURE 73: Xaa=Lys or Arg
MESMLNKLKSTVTKVTADVTSAVMGNPVTREFDVGRHIASGGNGLAWKIFNGTKKSTKQEVAVFVFDKKLIDXYQKFEKDQIIDSLKRGVQQLTRLRHPRLLTVQHPLEESRDCLAFCTEPVFASIA

SEQ ID NO: 6097 - protein, 59 aa, Homo sapiens
  UNSURE 49: Xaa=Ile or Met
  UNSURE 50: Xaa=any one of the twenty amino acids
MEPSSIEKIVEIDAHIGCAMSGLIADAKTLIDKARVETQNHWFTYNETXXVESVTKLCP

SEQ ID NO: 6098 - protein, 94 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSI

SEQ ID NO: 6099 - protein, 86 aa, Homo sapiens
  UNSURE 2: Xaa=Ala or Gly
  UNSURE 8: Xaa=Gly or Arg
MXSASSSXAGVALPFEKSQLTLKVVSAKPKVHNRQPRINSYVEVAVDGLPSETKKTGKRIGSSELLWNEIIILNVTAQSHLDLKVW

SEQ ID NO: 6100 - protein, 82 aa, Homo sapiens
MDFQERDPPFLPESAQSSKPSSAQQASELWEVVEEPRVRLGTEGVMPERQEGHLLKKRKWPLKGWHKRYFVLEDGILHYATT

SEQ ID NO: 6101 - protein, 92 aa, Homo sapiens
  UNSURE 71: Xaa=Ile or Asn or Ser or Thr
MANIHTFSACLALADLHGDGEYKLVVGDLGPGGQQPRLKVLKGPLVMTESPLPALPAAAATFLMEQHEPRXPALALASGPCVYVYKNLRPYF

SEQ ID NO: 6102 - protein, 105 aa, Homo sapiens
  UNSURE 75: Xaa=Leu or Met or Val
  UNSURE 87: Xaa=Phe or Leu
  UNSURE 88: Xaa=Asp or Gly
  UNSURE 92: Xaa=Gly or Arg
  UNSURE 98: Xaa=Asp or Gly
MSDIEEVVEEYEEEEQEEAAVEEQEEAAEEDAEAEAETEETRAEEDEEEEEAKEAEDGPMEESKPKPRSFMPNLXPPKIPDGERVDXXDIHXKRMEKXLNELQAL

SEQ ID NO: 6103 - protein, 108 aa, Homo sapiens
MATEHPEPPKAELQLPPPPPPGHYGAWAAQELQAKLAEIGAPIQGNREELVERLQSYTRQTGIVLNRPVLRGEDGDKAAPPPMSAQLPGIPMPPPPLGLPPLQPPPPP

SEQ ID NO: 6104 - protein, 63 aa, Homo sapiens
  UNSURE 30: Xaa=Leu or Pro or Gln or Arg
  UNSURE 33: Xaa= *  or Cys or Phe or Leu or Ser or Trp or Tyr
  UNSURE 48: Xaa=Ala or Pro or Ser or Thr
  UNSURE 58: Xaa=Lys or Asn
  UNSURE 63: Xaa=Ala or Asp or His or Asn or Pro or Ser or Thr or Tyr
MNAEPERKFGVVVVGVGRAGSVRMRDLRNXHPXSAFLNLRKGVDSASXSSARSHLAAXTLLSX

SEQ ID NO: 6105 - protein, 60 aa, Homo sapiens
  UNSURE 17: Xaa=Ile or Val
  UNSURE 48: Xaa=Ala or Gly
  UNSURE 53: Xaa=Lys or Asn or Arg or Ser
  UNSURE 54: Xaa=Ala or Pro or Ser or Thr
  UNSURE 56: Xaa=Ala or Gly
MRDLRNPHPSSAFLNLXGFVSRRELGSIDGVQQISLEDALSSQEVEVXISAVXXPXMRTT

SEQ ID NO: 6106 - protein, 126 aa, Homo sapiens
  UNSURE 105: Xaa=Ile or Val
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYXSLIYTNYEAGKDDYVKALPGQ

SEQ ID NO: 6107 - protein, 116 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQYGDTTHTL

SEQ ID NO: 6108 - protein, 62 aa, Homo sapiens
MPQAFLLGSIHEPAGALMEPQPCPGSLAESFLEEELRLNAELSQLQFSEPVGIIYNPVEYAG

SEQ ID NO: 6109 - protein, 109 aa, Homo sapiens
  UNSURE 105: Xaa=Leu or Pro
MMASMRVVKELEDLQKKPPPYLRNLSSDDANVLVWHALLLPDQPPYHLKAFNLRISFPPEYPFKPPMIKFTTKIYHPNVDENGQICLPIISSENWKPCTKTCQVXEALN

SEQ ID NO: 6110 - protein, 55 aa, Homo sapiens
MGEYAILIRMVRESLVNKGGLFKNGEEGRHAQGTERRTVWLEWNVRVGVWFKDDI

SEQ ID NO: 6111 - protein, 100 aa, Homo sapiens
MSDFVESEAEESEEEYNDEGEVVPRVTKKFVEEEDDDEEEEEENLDDQDEQGNLKGFINDDDDEDEGEEDEGSDSGDSEDDVGHKKRKRTSFDDRLEDDD

SEQ ID NO: 6112 - protein, 146 aa, Homo sapiens
MDALEDYVWPRATSELILLPVTGLECVGDRLLAGEGPDVLVYSLDFGGHLRMIKRVQNLLGHYLIHGFRVRPEPNGDLDLEAMVAVFGSKGLRVVKISWGQGHFWELWRSGLWNMSDWIWDARWLEGNIALALGHNSVVLYDPVVG

SEQ ID NO: 6113 - protein, 64 aa, Homo sapiens
  UNSURE 22: Xaa=Ala or Ser
  UNSURE 57: Xaa=Leu or Pro
MAAHLVKRCTCLLREAARQAPXMAPVGRLRLAWVAHKTLTSSATSPISHLPGSLMEXVEKERAS

SEQ ID NO: 6114 - protein, 58 aa, Homo sapiens
MEVAANCSLRVKRPLLDPRFEGYKLSLEPLPCYQLELDAGGKRRRPSYSVPFPFRLPP

SEQ ID NO: 6115 - protein, 95 aa, Homo sapiens
  UNSURE 91: Xaa=Leu or Pro or Gln or Arg
MDSFKVVLEGPAPWGFRLQGGKDFNVPLSISRLTPGGKAAQAGVAVGDWVLSIDGENAGSLTHIEAQNKIRACGERLSLGLSRAQPVQSKXQKAP

SEQ ID NO: 6116 - protein, 132 aa, Homo sapiens
MTAALAVVTTSGLEDGVPRSRGEGTGEVVLERGPGAAYHMFVVMEDLVEKLKLLRYEEEFLRKSNLKAPSRHYFALPTNPGEQFYMFCTLAAWLINKAGRPFEQPQEYDDPNATISNILSELRSFGRLQISS

SEQ ID NO: 6117 - protein, 92 aa, Homo sapiens
MESESESGAAADTPPLETLSFHGDEEIIEVVELDPGPPDPDDLAQEMEDVDFEEEEEEEGNEEGWVLEPQEGVVGSMEGPDDSEVTFALHSA

SEQ ID NO: 6118 - protein, 74 aa, Homo sapiens
  UNSURE 21: Xaa=Lys or Gln
MSYSVTLTGPGPWGFRLQGGXDFNMPLTLQKSKRPIPISTTAPPVQTPLPVIPHQKVVVNSPANADYQERFNPS

SEQ ID NO: 6119 - protein, 58 aa, Homo sapiens
MSYSVTLTGPGPWGFRLQGGKDFNMPLTISRITPGSKAAQSQLSQGDLVVAIDGVNTD

SEQ ID NO: 6120 - protein, 113 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSP

SEQ ID NO: 6121 - protein, 52 aa, Homo sapiens
  UNSURE 12: Xaa=Pro or Arg
  UNSURE 20: Xaa=Glu or Gln
  UNSURE 49: Xaa=His or Gln
MNKAPQSTGPPXAPSPGLPXPAFPPGQTAPVVFSTPQATQMNTPSQPRXHFY

SEQ ID NO: 6122 - protein, 52 aa, Homo sapiens
  UNSURE 49: Xaa=His or Gln
MNKAPQSTGPPPAPSPGLPQPAFPPGQTAPVVFSTPQATQMNTPSQPRXHFY

SEQ ID NO: 6123 - protein, 145 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYI

SEQ ID NO: 6124 - protein, 58 aa, Homo sapiens
MSKLGRAARGLRKPERGVSINQFCKEFNERTKDIKEGIPLPTKILVKPDRTFEIKIGQ

SEQ ID NO: 6125 - protein, 100 aa, Homo sapiens
MELSPRSPPEMLEESDCPSPLELKSAPSKKMWIKLRSLLRYMVKQLENGEINIEELKKNLEYTASLLEAVYIDETRQILDTEDELQELRSDAVPSEVRDW

SEQ ID NO: 6126 - protein, 62 aa, Homo sapiens
  UNSURE 62: Xaa=Ala or Asp
MGCCYSSENEDSDQDREERKLLLDPSSPPTKALNGAEPNYHSLPSARTDEQALLSSILAKTX

SEQ ID NO: 6127 - protein, 101 aa, Homo sapiens
MTQGKLSVANKAPGTEGQQQVHGEKKEAPAVPSAPPSYEEATSGEGMKAGAFPPAPTAVPLHPSWAYVDPSSSSSYYNGFPTGDHELFTTFSWDDQKVRRV

SEQ ID NO: 6128 - protein, 80 aa, Homo sapiens
  UNSURE 62: Xaa=His or Leu or Pro or Arg
MTTVVVHVDSKAELTTLLEQWEKEHGSGQDMVPILTRMSQLIEKETEEYRKGDPDPFDDRHXGRADPECMLGHLLRILFK

SEQ ID NO: 6129 - protein, 78 aa, Homo sapiens
  UNSURE 19: Xaa=Leu or Arg
  UNSURE 31: Xaa=Cys or Phe
  UNSURE 49: Xaa=Lys or Arg
  UNSURE 52: Xaa=Ala or Cys or Asp or Phe or Gly or His or Ile or Leu or Asn or Pro or Arg or Ser or Thr or Val or Tyr
  UNSURE 57: Xaa=Asp or Asn
  UNSURE 65: Xaa=Lys or Arg
  UNSURE 67: Xaa=Lys or Arg
  UNSURE 69: Xaa=Asp or Asn
  UNSURE 70: Xaa=Ala or Thr
MALPIIVKWGGQEYSVTTXSEDDTVLDLKEXLKTLTGVLPERQKLLGLXVKXKPAEXDVKLGALXLXPXXKIMMMGTR

SEQ ID NO: 6130 - protein, 67 aa, Homo sapiens
MVLADLGRKITSALRSLSNATIINEEVLNAMLKEVCTALLEADVNIKLVKQLRENVKSAIDLEEMAS

SEQ ID NO: 6131 - protein, 53 aa, Homo sapiens
MAAAALGQLFEGMKAFKGKDQQVRLFRPWLNMDRMLRSAMRLCLPSFDKLELL

SEQ ID NO: 6132 - protein, 219 aa, Homo sapiens
  UNSURE 22: Xaa=Glu or Gly
  UNSURE 31: Xaa=Glu or Gln
  UNSURE 36: Xaa=Glu or Lys
  UNSURE 41: Xaa=Lys or Asn
  UNSURE 42: Xaa=Glu or Lys or Met or Val
  UNSURE 78: Xaa= *  or Ala or Glu or Gly or Ile or Lys or Leu or Pro or Gln or Arg or Ser or Thr or Val
  UNSURE 105: Xaa=Pro or Thr
  UNSURE 107: Xaa=Asp or Tyr
  UNSURE 187: Xaa=Lys or Met
MAAAAAAAPSGGGGGGEEERLXEKSEDQDLXGLKDXPLKFXXVKKDKKEEKEGKHEPVQPSAHHSAEPAEAGKAETSXGSGSAPAVPEASASPKQRRSIIRDRGXMXDDPTLPEGWTRKLKQRKSGRSAGKYDVYLINPQGKAFRSKVELIAYFEKVGDTSLDPNDFDFTVTGRGSPSRREQKPPKXPKSPKAPGTGRGRGRPKGSGTTRPKAATSEGV

SEQ ID NO: 6133 - protein, 100 aa, Homo sapiens
MASDDFDIVIEAMLEAPYKKEEDEQQRKEVKKDYPSNTTSSTSNSGNETSGSSTIGETSNRSRDRDRYRRRNSRSRSPGRQCRHRSRSWDRRHGSESRSR

SEQ ID NO: 6134 - protein, 140 aa, Homo sapiens
  UNSURE 84: Xaa=Leu or Gln
  UNSURE 109: Xaa=Ile or Lys or Met or Asn or Arg or Ser or Thr
MFQVPDSEGGRAGSRAMKPPGGESSNLFGSPEEATPSSRPNRMASNIFGPTEEPQNIPKRTNPPGGKGSGIFDESTPVQTRQHXNPPGGKTSDIFGSPVTATSRLAHPXKPKDHVFLCEGEEPKSDLKAARSIPAGAEPG

SEQ ID NO: 6135 - protein, 136 aa, Homo sapiens
  UNSURE 128: Xaa=Leu or Pro
MGALTSRQHAGVEEVDIPSNSVYRYPPKSGSYFASHFIMGGEKFDSTHPEGYLFGENSDLNFLGNRPVVFPYAAPPPQEPVKTLRSLVNIRKDTLRLVKCAEEVKSPGEEASKAKVHYNVEFTLTQMXGVAITIYY

SEQ ID NO: 6136 - protein, 76 aa, Homo sapiens
  UNSURE 35: Xaa=Lys or Asn
MQVSSLNEVKIYSLSCGKSLPEWLSDRKKRALQKXDVDVRRRIELIQDFEMPTVCTTIKVSKDGQYILATGTYKPR

SEQ ID NO: 6137 - protein, 96 aa, Homo sapiens
MVHPRILYRDGQALGSWLRPLGQPCAKDLLTTDQPDHLPPSKSSKSSKLVTCPLMFPGNQERGPLHFIFPSRVAGSLPGKQASFSTAVVALTKQSG

SEQ ID NO: 6138 - protein, 109 aa, Homo sapiens
MAKFMTPVIQDNPSGWGPCAVPEQFRDMPYQPFSKGDRLGKVADWTGATYQDKRYTNKYSSQFGGGSQYAYFHEEDESSFQLVDTARTQKTAYQRNRMRFAQRNLRRDK

SEQ ID NO: 6139 - protein, 118 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLK

SEQ ID NO: 6140 - protein, 73 aa, Homo sapiens
MCSLGLFPPPPPRGQVTLYEHNNELVTGSSYESPPPDFRGQWINLPVLQLTKDPLKTPGRLDHGTRTAFIHHP

SEQ ID NO: 6141 - protein, 57 aa, Homo sapiens
MLSPERLALPDYEYLAQRHVLTYMEDAVCQLLENREDISQYGIARFFTEYFKVYARE

SEQ ID NO: 6142 - protein, 109 aa, Homo sapiens
  UNSURE 101: Xaa=Ile or Lys or Met or Asn or Arg or Ser or Thr
MACLSPSQLQKFQQDGFLVLEGFLSAEECVAMQQRIGEIVAEMDVPLHCRTEFSTQEEEQLRAQGSTDYFLSSGDKIRFFFEKGVFDEKGNFLVPPEKSIXKIGHALHA

SEQ ID NO: 6143 - protein, 76 aa, Homo sapiens
MMTIVTMAVRKRKTKRWLRRSKPERKEKKMPKPRLKATVTPSPVKGKGKVGRPTASKASKERLLLPKKKMRNRKAR

SEQ ID NO: 6144 - protein, 75 aa, Homo sapiens
  UNSURE 5: Xaa=Pro or Arg
MSELXGETGTSFPFSVSGSQKVCPFSHHELALQFPGSGTNSLPPQRQGPGRREQPCKGRGGSHLESQIWQYTMNQ

SEQ ID NO: 6145 - protein, 94 aa, Homo sapiens
  UNSURE 43: Xaa=Glu or Gln
MLYLIGLGLGDAKDITVKGLEVVRRCSRVYLEAYTSVLTVGKXALEEFYGRKLVVADREEVEQEADNILKDADISDVAFLVVGDPFGATTHSDL

SEQ ID NO: 6146 - protein, 94 aa, Homo sapiens; identical to SEQ ID NO: 6145
  UNSURE 43: Xaa=Glu or Gln

SEQ ID NO: 6147 - protein, 84 aa, Homo sapiens
  UNSURE 13: Xaa=His or Gln
  UNSURE 16: Xaa=Asn or Thr
  UNSURE 18: Xaa=Lys or Pro or Gln or Thr
  UNSURE 20: Xaa=Ile or Asn
  UNSURE 58: Xaa=Gly or Ser
  UNSURE 64: Xaa=Asp or Val
  UNSURE 66: Xaa= *  or Leu or Pro or Gln or Arg or Ser
MERMLPLLTLGAXNTXLXEXPQKASSSTSRRLLRQKFTRASSTSCAPSISPAMKLQLXMGKCHXCXRATQSAGQVHGGCQEAVW

SEQ ID NO: 6148 - protein, 67 aa, Homo sapiens
  UNSURE 59: Xaa=Phe or Ser
MDGRVQLIKALLALPIRPATRRWRNPIPFPETFDGDTDRLPEFIVQTGSYMFVDENTFXSETYFLPT

SEQ ID NO: 6149 - protein, 66 aa, Homo sapiens
  UNSURE 2: Xaa=Asp or Glu
  UNSURE 14: Xaa=Gly or Arg
MXGRVQLMKALLAXPLRPAARRWRNPIPFPETFDGDTDRLPEFIVQTSSYMFVDENTFSNDALKVT

SEQ ID NO: 6150 - protein, 124 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRV

SEQ ID NO: 6151 - protein, 59 aa, Homo sapiens
MNHKSKKRIREAKRSARPELKDSLDWTRHNYYESFSLSPAAVADNVERADALQLSVEEF

SEQ ID NO: 6152 - protein, 242 aa, Homo sapiens
  UNSURE 29: Xaa=Leu or Met or Val
  UNSURE 242: Xaa=Leu or Pro
MGRVIRGQRKGAGSVFRAHVKHRKGAARXRAVDFAERHGYIKGIVKDIIHDPGRGAPLAKVVFRDPYRFKKRTELFIAAEGIHTGQFVYCGKKAQLNIGNVLPVGTMPEGTIVCCLEEKPGDRGKLARASGNYATVISHNPETKKTRVKLPSGSKKVISSANRALVGVVAGGGRIDKPILKAGRAYHKYKAKRNCWPRVRGVAMNPVAASFWRWQPPAHRQALHHPQRCPCWPQSGSHCCPX

SEQ ID NO: 6153 - protein, 218 aa, Homo sapiens
  UNSURE 29: Xaa=Leu or Met or Val
  UNSURE 59: Xaa=Ala or Asp or Glu
  UNSURE 85: Xaa= *  or Glu or Lys or Gln
  UNSURE 94: Xaa=Asp or Glu
  UNSURE 218: Xaa=Leu or Pro
MGRVIRGQRKGAGSVFRAHVKHRKGAARXRAVDFAERHGYIKGIVKDIIHDPGRGAPLXKVVFRDPYRFKKRTELFIAAEGTMPXGTIVCCLEXKPGDRGKLARASGNYATVISHNPETKKTRVKLPSGSKKVISSANRALVGVVAGGGRIDKPILKAGRAYHKYKAKRNCWPRVRGVAMNPVAASFWRWQPPAHRQALHHPQRCPCWPQSGSHCCPX

SEQ ID NO: 6154 - protein, 88 aa, Homo sapiens
  UNSURE 68: Xaa=Ala or Thr
MESSPFNRRQWTSLSLRVTAKELSLVNKNKSSAIVEIFSKYQKAAEETNMEKKRSNTENLSQHFRKGXLTVLKKKWENQGWEQSLTQT

SEQ ID NO: 6155 - protein, 61 aa, Homo sapiens
MTGAPHRPLADHRASHCGLRHAGSHRHGHCIQSALSWTVPPQCTPTLQARQRTAAATSPPN

SEQ ID NO: 6156 - protein, 77 aa, Homo sapiens
  UNSURE 29: Xaa=Lys or Asn
MDLAGLLKSQFLCHLVFCYVFIASGLIIXTIQLFTLLLWPINKQLFRKINCRLSYCISSQLVMLLEWWSGTECTIFT

SEQ ID NO: 6157 - protein, 70 aa, Homo sapiens
MLKCAVHTRSGEHPSSIQKQLQCCCHHPPVCLFKVSCDIFSLVRSQELVSFLKRYVPGPGVVAHACNPST

SEQ ID NO: 6158 - protein, 88 aa, Homo sapiens
  UNSURE 61: Xaa=Glu or Gln
  UNSURE 62: Xaa=Asp or Val
MDDAHESPSDKGGETGESDETAAVPGDPGATDTDGIPEETDGDADVDLKEAAAEEGELESXXVSDLTTVEREDSSLLNPAAKKTENRY

SEQ ID NO: 6159 - protein, 73 aa, Homo sapiens
MEAQTTLTTNDIVISKLTQILSYLRQGTRNKKLKKKDKGKLEEKKPPEADMNIFEDIGDYVPSTTKTPRDKER

SEQ ID NO: 6160 - protein, 61 aa, Homo sapiens
  UNSURE 12: Xaa=Leu or Trp
  UNSURE 29: Xaa=Met or Arg
  UNSURE 30: Xaa= *  or Glu or Lys or Gln
MFRCGGLAAGAXKQKLVPLVRTVCVRSPXXRNRLPGNLFQRWHVPLELQMTRQMASSGASG

SEQ ID NO: 6161 - protein, 106 aa, Homo sapiens
MELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQ

SEQ ID NO: 6162 - protein, 113 aa, Homo sapiens
  UNSURE 68: Xaa=Leu or Pro or Gln or Arg
MKRGIRRDPFRKRKLGGRAKKVREPTAVNSFYREASLPSVWASLRRREMVRSGARPGQVRAEDLRSPXWGWRGTGGFSGQELVKLCSKKDKDNAATLKCWDRGAGNTNLPVVT

SEQ ID NO: 6163 - protein, 55 aa, Homo sapiens
  UNSURE 28: Xaa= *  or Leu or Ser
MGPQVCAPYSPPITYQRALQELLTNRLXMVLHSRINCTSVCAKSTRHWRNSRNNT

SEQ ID NO: 6164 - protein, 124 aa, Homo sapiens
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSERSLILTPT

SEQ ID NO: 6165 - protein, 59 aa, Homo sapiens
MAGPELLLDSNIRLWVVLPIVIITFFVGMIRHYVSILLQSDKKLTQEQVSDSQVLIRSR

SEQ ID NO: 6166 - protein, 52 aa, Homo sapiens
MCLGTLRPTNDSALMEQPSVWGKVLEVHSFRKPLTSLYHALSEKLRIRKEQD

SEQ ID NO: 6167 - protein, 135 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDS

SEQ ID NO: 6168 - protein, 95 aa, Homo sapiens
  UNSURE 23: Xaa=Ala or Asp or Gly or Val
MAFNFGAPSGTSGTAAATAAPAXGFGGFGTTSTTAGSAFSFSAPTNTGTTGLFGGTQNKGFGFGTGFGTTTGTSTGLGTGLGTGLGFGGFNTQQQ

SEQ ID NO: 6169 - protein, 89 aa, Homo sapiens
MAAPSGTVSDSESSNSSSDAEELERCREAAMPAWGLEQRPHVAGKPRAGAANSQLSTSQPSLRHKVNEHEQDGNELQTTPEFRAHVAKK

SEQ ID NO: 6170 - protein, 78 aa, Homo sapiens
MPQTPPFSAMFDSSGYNRNLYQSAEDSCGGLYYHDNNLLSGSLEALIQHLVPNVDYYPDRTYIFTFLLSSRLFMHPYE

SEQ ID NO: 6171 - protein, 100 aa, Homo sapiens
  UNSURE 64: Xaa=Asp or Tyr
MGAGTAGELPANSVSGFFKRMVKSEASNAATAYFRPARPLPSLVTVLGLGYFAWVVFWPQSIPXQNLGPLGPFTQYLVDHHHTLLCNGYWLAWLIHVGES

SEQ ID NO: 6172 - protein, 53 aa, Homo sapiens
MDCQECPEGYRVTYTPMAPGSYLISIKYGGPYHIGGSPFKAKVTGPRLVSNHS

SEQ ID NO: 6173 - protein, 85 aa, Homo sapiens
MVGQLAARRAAGVVLEMIREGKIAGRAVLIAGQPGTGKTAIAMGMAQALGPDTPFTAIAGSEIFSLEMSKTEALTQAFRRSIGVR

SEQ ID NO: 6174 - protein, 102 aa, Homo sapiens
  UNSURE 5: Xaa=His or Pro
  UNSURE 66: Xaa=Cys or Phe or Ser or Tyr
MEEPXVREEEEEEGEEDEERDEVGPEGALGKSPFQLTAEDVYDISYLLGRELMALGSDPRVTQLQXKVVRVLEMLEALVNEGSLALEELKMERDHLRKEVEG

SEQ ID NO: 6175 - protein, 117 aa, Homo sapiens
  UNSURE 35: Xaa=His or Leu or Pro or Arg
  UNSURE 40: Xaa=Asn or Tyr
  UNSURE 92: Xaa=Ala or Pro
MSVVPPNRSQTGWPRGVTQFGNKYIQQTKPLTLEXTINLXPLTNYTFGTKEPLYEKDSSVAARFQRMREEFDKIGMRRTVEGVLIVHEHRLXHVLLLQLGTTFFKLPGGELNPGEDE

SEQ ID NO: 6176 - protein, 61 aa, Homo sapiens
MTFKIFLLFAGLMVKVPVGLYFSCKLLLFQSLMLMSPEDSGFYATIVAVVGLHVVLAIFVF

SEQ ID NO: 6177 - protein, 63 aa, Homo sapiens
MSKTNKSKSGSRSSRSRSASRSRSRSFSKSRSRSRSLSRSRKRRLSSRSRSRSYSPAHNRERN

SEQ ID NO: 6178 - protein, 90 aa, Homo sapiens
  UNSURE 37: Xaa=His or Gln
  UNSURE 38: Xaa=Leu or Val
  UNSURE 43: Xaa=His or Asn
  UNSURE 47: Xaa=Arg or Thr
  UNSURE 49: Xaa=Cys or Gly
  UNSURE 54: Xaa=Ile or Val
  UNSURE 67: Xaa= *  or Tyr
  UNSURE 71: Xaa=Met or Val
  UNSURE 72: Xaa= *  or Glu
MAAHHRQNTAGRRKVQVSYVIRDEVEKYNRNGVNALXXDPALXRLFXAXRDSIXRIWSVNQHKQDPXIASXXHHTDWVNDIVLCCNGETL

SEQ ID NO: 6179 - protein, 57 aa, Homo sapiens
MFTRAQVRRILQRVPGKQRFGIYRFLPFFFVLGGTMEWIMIKVRVGQETFYDVYRRK

SEQ ID NO: 6180 - protein, 75 aa, Homo sapiens
  UNSURE 69: Xaa=Gly or Arg
MSWESGAGPGLGSQGMDLVWSAWYGKCVKGKGSLPLSAHGIVVAWLSRAEWDQVTVYLFCDDHKLQRYXLTASRC

SEQ ID NO: 6181 - protein, 57 aa, Homo sapiens
MELELDAGDQDLLAFLLEESGDLGTAPDEAVRAPLDWALPLSEVPSDWEVDDLLCSL

SEQ ID NO: 6182 - protein, 123 aa, Homo sapiens
  UNSURE 99: Xaa=Glu or Lys
MAPPSVFAEVPQAQPVLVFKLTADFREDPDPRKVNLGVGAYRTDDCHPWVLPVVKKVEQKIANDNSLNHEYLPILGLAEFRSCASRLALGDDSPALKEXRVGGVQSLGGTGALRIGADFLARW

SEQ ID NO: 6183 - protein, 92 aa, Homo sapiens
MSRYLRPPNTSLFVRNVADDTRSEDLRREFGRYGPIVDVYVPLDFYTRRPRGFAYVQFEDVRDAEDALHNLDRKWICGRQIEIQFAQGDRKT

SEQ ID NO: 6184 - protein, 119 aa, Homo sapiens
MASIFSKLLTGRNASLLFATMGTSVLTTGYLLNRQKVCAEVREQPRLFPPSADYPDLRKHNNCMAECLTPAIYAKLRNKVTPNGYTLDQCIQTGVDNPGHPFIKTVGMVAGDEESYEVF

SEQ ID NO: 6185 - protein, 137 aa, Homo sapiens
  UNSURE 83: Xaa=Cys or Phe
  UNSURE 84: Xaa=Asp or Gly or Asn or Ser
  UNSURE 103: Xaa=Arg or Ser or Thr
  UNSURE 124: Xaa=Asp or Gly
  UNSURE 130: Xaa=Ser or Thr
  UNSURE 131: Xaa=Ala or Pro
MAPKFPDSVEELRAAGNESFRNGQYAEASALYGRALRVLQAQGSSDPEEESVLYSNRAACHLKDGNCRDCIKDCTSALALVPXXIKPLLRRASAYEALEKYPXAYVDYKTVLQIDDNVTSAVEXINRMTXXLMDSLG

SEQ ID NO: 6186 - protein, 125 aa, Homo sapiens
MALLRRPTVSSDLENIDTGVNSKVKSHVTIRRTVLEEIGNRVTTRAAQVAKKAQNTKVPVQPTKTTNVNKQLKPTASVKPVQMEKLAPKGPSPTPEDVSMKEENLCQAFSDALLCKIEDIDNEDW

SEQ ID NO: 6187 - protein, 82 aa, Homo sapiens
MAAPVDLELKKAFTELQAKVIDTQQKVKLADIQIEQLNRTKKHAHLTDTEIMTLVDETNMYEGVGRMFILQSKEAIHSQPNT

SEQ ID NO: 6188 - protein, 57 aa, Homo sapiens
  UNSURE 42: Xaa=Ile or Lys or Met or Asn or Arg or Ser or Thr
MAQGLIEVERKFLPGPGTEERLQELGGTLEYRVTFRDTYYDXPELSLMQADHWLRRR

SEQ ID NO: 6189 - protein, 83 aa, Homo sapiens
  UNSURE 70: Xaa=any one of the twenty amino acids
MWRAKLRRGTCEPAVKVEDPLCNFHSPNFLRISEVEMRGSEDAAAGTVLQRLIQEQLRYGTPTENMNLLXIQHQAQGVQASHP

SEQ ID NO: 6190 - protein, 101 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDG

SEQ ID NO: 6191 - protein, 76 aa, Homo sapiens
MGRSGKLPSGVSAKLKRWKKGHSSDSNPAICRHRQAARSRFFSRPSGRSDLTVDAVKLHNELQSGSLRLGKSEPRR

SEQ ID NO: 6192 - protein, 62 aa, Homo sapiens
MSLICSISNEVPEHPCVSPVSNHVYERRLIEKYIAENGTDPINNQPLSEEQLIDIKVAHPIR

SEQ ID NO: 6193 - protein, 85 aa, Homo sapiens
  UNSURE 74: Xaa= *  or Leu or Ser or Trp
MSGHRSTRKRCGDSHPESPVGFGHMSTTGCVLNKLFQLPTPPLSRHQLKRLEEHRYQSAGRSLLEPLMQGYWEXLVREFPPGLPK

SEQ ID NO: 6194 - protein, 134 aa, Homo sapiens
MATPMHRLIARRQAFDTELQPVKTFWILIQPSIVISEANKQHVRCQKCLEFGHWTYECTGKRKYLHRPSRTAELKKALKEKENRLLLQQSIGETNVERKAKKKRSKSVTSSSSSSSDSSASDSSSESEETSTSS

SEQ ID NO: 6195 - protein, 79 aa, Homo sapiens
  UNSURE 2: Xaa=His or Gln
  UNSURE 3: Xaa=Lys or Met
  UNSURE 5: Xaa=Gly or Arg
MXXAXLLGLCARAWNSVRMASSGMTRRDPLANKVALVTASTDGIGFAIARRLAQDGAHVVVSSRKQQNVDQAVATLQGE

SEQ ID NO: 6196 - protein, 58 aa, Homo sapiens
  UNSURE 51: Xaa=Asp or Gly or Asn or Ser
MSSEDREAQEDELLALASIYDGDEFRKAESVQGGETRIYLDLPQNFKIFVXAICSMQA

SEQ ID NO: 6197 - protein, 77 aa, Homo sapiens
MSSEDREAQEDELLALASIYDGDEFRKAESVQGGETRIYLDLPQNFKIFVSGNSNECLQNSGFEYTICFLPPLVLNF

SEQ ID NO: 6198 - protein, 54 aa, Homo sapiens
MSSYQKELEKYRDIDEDEILRTLSPEELEQLDCELQEMDPENMLLPAGLRQRDQ

SEQ ID NO: 6199 - protein, 74 aa, Homo sapiens
  UNSURE 73: Xaa=Asp or His
MGRGAGREYSPAATTAENGGGKKKQKEKELDELKKEVAMDDHKLSLDELGRKYQVDLSKGLTNQRAQDVLARXG

SEQ ID NO: 6200 - protein, 58 aa, Homo sapiens
MCHTGITSGNFVFKHLEIKQFLTHKPVLTHRVMGIEAKHTHNYKYSLEKCNILRKSRS

SEQ ID NO: 6201 - protein, 113 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKP

SEQ ID NO: 6202 - protein, 81 aa, Homo sapiens
  UNSURE 3: Xaa=Phe or Leu
  UNSURE 4: Xaa=Gly or Arg
MFXXPAMLAKFRVARLYGKIITADPKKELENLATSLEHYKFIVDYCEKHPEAAQEIEVELELSKEMVSLLPTKMERFRTKT

SEQ ID NO: 6203 - protein, 62 aa, Homo sapiens
MSRVAKYRRQVSEDPDIDSLLETLSPEEMEELEKELDVVDPDGSVPVGLRQRNQTEKQSTGV

SEQ ID NO: 6204 - protein, 76 aa, Homo sapiens
  UNSURE 28: Xaa=Cys or Arg
  UNSURE 36: Xaa=Glu or Lys
  UNSURE 76: Xaa=Asp or Glu
MIGPMRPEQFSDEVEPATPEEGEPATQXQDPAAAQXGEDEGASAGQGPKPEAHSQEQGHPQTGCECEDGPDGQEMX

SEQ ID NO: 6205 - protein, 62 aa, Homo sapiens
MSSKMVISEPGLNWDISPKNGLKTFFSRENYKDHSMAPSLKELRVLSNRESRGVMWTCWLNT

SEQ ID NO: 6206 - protein, 57 aa, Homo sapiens
MRFLTLGRNVRRRNMSTQELTQLNFTVAIDFTASNGNPLQPTSLHYMSPYQLSAYAM

SEQ ID NO: 6207 - protein, 96 aa, Homo sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEAG

SEQ ID NO: 6208 - protein, 110 aa, Homo sapiens
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQG

SEQ ID NO: 6209 - protein, 110 aa, Homo sapiens; identical to SEQ ID NO: 6208

SEQ ID NO: 6210 - protein, 136 aa, Homo sapiens
  UNSURE 16: Xaa=Asp or Gly
  UNSURE 27: Xaa=Glu or Gln
  UNSURE 87: Xaa=Ala or Asp or Glu or Gly or Val
  UNSURE 88: Xaa=Ala or Pro or Ser or Thr
MAPLGGAPRLVLLFSXKRKSGKDFVTXALQSRLGADVCAVLRLSGPLKEQYAQEHGLNFQRLLDTSTYKEAFRKDMIRWGEEKRQAXXGFFCRKIVEGISQPIWLVSDTRRVSDIQWFREAYGAVTQTVRVVALER

SEQ ID NO: 6211 - protein, 103 aa, Homo sapiens
  UNSURE 90: Xaa=Leu or Val
MDVTKPDLSAALKDIRAQYEKLAAKNMQNAEEWFKSRFTVLTESAAKNTDAVRAAKDEVSESRRLLKAKTLEIEACRGMNEALEKQLQEXEDKQNADISAMQD

SEQ ID NO: 6212 - protein, 65 aa, Homo sapiens
MEDEERQKKLEAGKAKLAQFRQRKAQSDGQSPSKKQKKKRKTSSSKHDVSAHHDLNIDQSQCNEM

SEQ ID NO: 6213 - protein, 88 aa, Homo sapiens
  UNSURE 51: Xaa=Asp or Tyr
  UNSURE 69: Xaa= *  or Tyr
MAAAVAMETDDAGNRLRFQLELEFVQCLANPNYLNFLAQRGYFKDKAFVNXLKYLLYWEDPEYAKYLKXPQCLHMLELLQYEHFRKEL

SEQ ID NO: 6214 - protein, 95 aa, Homo sapiens
  UNSURE 20: Xaa=Glu or Gln
MPGQGGASGGDRAGARAAPXTEWQSGQRWELALGRFWDYLRWVQTLSEQVQEELLSSQVTQELRALMDETMKELKAYKSELEEQLTRWRRRRGHG

SEQ ID NO: 6215 - protein, 77 aa, Homo sapiens
  UNSURE 75: Xaa=Asp or Asn
MADFDTYDDRAYSSFGGGRGSRGSAGGHGSRSQKELPTEPPYTAYVGNLPFNTVQGDIDAIFKDLSIRSVRLVRXKD

SEQ ID NO: 6216 - protein, 98 aa, Homo sapiens
  UNSURE 30: Xaa=His or Gln
  UNSURE 53: Xaa=Pro or Arg or Ser or Thr
  UNSURE 87: Xaa=Ile or Met
  UNSURE 90: Xaa=Asn or Thr
MVQEHPLPIGAPGLRLVLPKSHRLHHGPAXDDQDLTRMIHILDTEHPWDLHSXPSEHHEAITCLEWDQSGSRLLSADADGQIKCWSXATXWLIAGRAQ

SEQ ID NO: 6217 - protein, 117 aa, Homo sapiens
  UNSURE 76: Xaa=Glu or Lys
  UNSURE 103: Xaa=Asp or Glu
MAAPGLRLGAGRLFEMPAVLERLSRYNSTSQAFAEVLRLPKQQLRKLLYPLQEVERFLAPYGRQDLHLRIFDPSPXDIARADNIFTATERNRIDYVSSAVRIXHAPDLPRPEVCFIG

SEQ ID NO: 6218 - protein, 114 aa, Homo sapiens
  UNSURE 100: Xaa=Ala or Val
  UNSURE 101: Xaa=Gly or Leu or Met or Arg or Val or Trp
MEKEATEKLRKLLASQSSGLRGLWDCLPADLVGERSAQSKAAESLEELRACISTLVDRHREAQQVLARLQEENQQLRGSLSPCREPGTSLKAPASPQVAXXEQDLGKLEEELRA

SEQ ID NO: 6219 - protein, 64 aa, Homo sapiens
  UNSURE 22: Xaa=Asn or Thr
MAEDGLPKIYSHPPTESSKTPXAATIFFGADNAIPKSETTITSEGDHVTSVNEYMLESDFSTTT

SEQ ID NO: 6220 - protein, 57 aa, Homo sapiens
  UNSURE 25: Xaa=Ala or Thr
MTAFGLGIPTFLVMQPSGSQPRFPXLTQNGVALVRTPLTSVYLRVRPILPAGLCLGV

SEQ ID NO: 6221 - protein, 71 aa, Homo sapiens
MTANRLAESLLALSQQEELADLPKDYLLSESEDEGDNDGERKHQKLLEAISSLDGKNRRKLAERSEASLKV

SEQ ID NO: 6222 - protein, 52 aa, Homo sapiens
MMLGSLAPDPGSRRHSGQAALRPRRYPTLWDRCRKRWLRPIFTQLLAAVWLT

SEQ ID NO: 6223 - protein, 63 aa, Homo sapiens
MLIFEQYRGLRDQDTSLPISLIGIPTFFQMPKIHIRNIIQICVILYIYIQNSKWFLKIIAIFQ

SEQ ID NO: 6224 - protein, 103 aa, Homo sapiens
  UNSURE 45: Xaa=Leu or Met or Val
MQQGQKRGEMKPVAAGAAAPPGEGISAAPTVEPSSGEAEGGEANXVDVSGGLETESSNGKDTLEGAGDTSEVMDTQAGSVDEENGRQLGEVELQCGICTNGSR

SEQ ID NO: 6225 - protein, 87 aa, Homo sapiens
MGKKGKKEKKGRGAEKTAAKMEKKVSKRSRKEEEDLEALIAHFQTLDAKRTQTVELPCPPPSPRLNASLSVHPEKDELILFGVNIST

SEQ ID NO: 6226 - protein, 93 aa, Homo sapiens
  UNSURE 3: Xaa=Ala or Pro
  UNSURE 4: Xaa=Pro or Thr
  UNSURE 6: Xaa=Asp or Glu
  UNSURE 7: Xaa= *  or Leu or Ser or Trp
  UNSURE 80: Xaa=Gly or Arg
  UNSURE 85: Xaa=Gly or Ser
MRXXSXXTLDYPPFFAWFEYILSHVAKYFDQEMLNVHNLNYSSSRTLLFQRFSVIFMDVLFVYAVRECCKCIDGKKVGKXTYRKXQNLFCRYY

SEQ ID NO: 6227 - protein, 138 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYG

SEQ ID NO: 6228 - protein, 109 aa, Homo sapiens
MSKRHRLDLGEDYPSGKKRAGTDGKDRDRDRDREDRSKDRDRERDRGDREREREKEKEKELRASTNAMLISAGLPPLKASHSAHSTHSAHSTHSTHSAHSTHAGHAGHT

SEQ ID NO: 6229 - protein, 69 aa, Homo sapiens
  UNSURE 55: Xaa=Glu or Gly or Gln or Arg
MATTAAPAGGARNGAGPEWGGFEENIQGGGSAVIDMENMDDTSGSSFEDMGELHXRLREEEVDADAADA

SEQ ID NO: 6230 - protein, 87 aa, Homo sapiens
  UNSURE 80: Xaa=Asp or Glu
MADDLGDEWWENQPTGAGSSPEASDGEGEGDTEVMQQETVPVPVPSEKTKQPKECFLIQPKERKENTTKTRKRRKKKITXVLAKSEP

SEQ ID NO: 6231 - protein, 74 aa, Homo sapiens
  UNSURE 29: Xaa=Phe or Leu
  UNSURE 66: Xaa= *  or Tyr
  UNSURE 72: Xaa=Ala or Asp or Gly or Val
MGSQAAAEWRNWASWEVSSSLSGCSMGCXKDDRIVFWTWMFSTYFMEKWAPRQDDMLFYVRRKLAXSGSESXAD

SEQ ID NO: 6232 - protein, 109 aa, Homo sapiens
MPGLSCRFYQHKFPEVEDVVMVNVRSIAEMGAYVSLLEYNNIEGMILLSELSRRRIRSINKLIRIGRNECVVVIRVDKEKGYIDLSKRRVSPEEAIKCEDKFTKSKTVY

SEQ ID NO: 6233 - protein, 53 aa, Homo sapiens
  UNSURE 3: Xaa=Ile or Lys or Arg or Thr
MLXHFKWLKSGFKDLDSLFYLKYLAFSWHQVCIHVYCMKRYIYYILLNVYSKS

SEQ ID NO: 6234 - protein, 79 aa, Homo sapiens
MQPVRTVVPVTKHRGYLGVMPAYSAAEDALTTKLVTFYEDRGITSVVPSHQATVLLFEPSNGTLLAVMDGNVITAKRTA

SEQ ID NO: 6235 - protein, 88 aa, Homo sapiens
MKKLTTDGKLIARALRSSAVVELDLEGTRIRRKKPLGERPKDEDERTVYVELLPKNVNHSWIERVFGKCGNVVYISIPHYKSTGDPKG

SEQ ID NO: 6236 - protein, 56 aa, Homo sapiens
MNRHLCVWLFRHPSLNGYLQCHIQLHSHQFRQIHLDTRLQVFRQNRNCILHLLSKN

SEQ ID NO: 6237 - protein, 115 aa, Homo sapiens
  UNSURE 79: Xaa=Ala or Ser
  UNSURE 94: Xaa=Phe or Val
  UNSURE 100: Xaa= *  or Glu or Lys or Gln
MFVPCGESAPDLAGFTLLMPAVSVGNVGQLAMDLIISTLNMSKIGYFYTDCLVPMVGNNPYATTEGNSTELSINAEVYXLPSRKLVALQLRSIXIKYKSXPFCEKLLSWVKAVAV

SEQ ID NO: 6238 - protein, 90 aa, Homo sapiens
MRNNFGKVLERGVKLAELQQRSDQLLDMSSTFNKTTQNLAQKKCWENIRYRICVGLVVVGVLLIILIVLLVVFLPQSSDSSSAHGPRMQA

SEQ ID NO: 6239 - protein, 79 aa, Homo sapiens
  UNSURE 9: Xaa=Leu or Pro
  UNSURE 12: Xaa=Glu or Gly
MQCYSLSFXCEXIVWRGPSKTSYYPKKATYMNFISGFFQIEGKFQDEAFILFSDQSVGKRKEFVTIFISNILKQKTKNP

SEQ ID NO: 6240 - protein, 68 aa, Homo sapiens
  UNSURE 68: Xaa=Glu or Gly
MADRQAAAPNFWCSFIPALRHEADRKDRQCCFVTGIFLALSIHLRMCGESHAMGALGQAQVFTVVEGX

SEQ ID NO: 6241 - protein, 57 aa, Homo sapiens
MFFQVFFLLQLQDNCPHLPNSGQEDFDKDGIGDACDDDDDNDGVTDEKDNCQLLFNP

SEQ ID NO: 6242 - protein, 68 aa, Homo sapiens
  UNSURE 56: Xaa=Arg or Ser
  UNSURE 57: Xaa=Arg or Trp
MITSAAGIISLLDEDEPQLKEFALHKLNAVVNDFWAEISESVDKIEVLYEDEGFRXXQFAALVASKVF

SEQ ID NO: 6243 - protein, 85 aa, Homo sapiens
  UNSURE 72: Xaa= *  or Glu or Lys or Gln
MLYFSLFWAARPLQRCGQLVRMAIRAQHSNAAQTQTGEANRGWTGQESLSDSDPEMWELLQREKDRQCRGLXLIASENFCSRAAL

SEQ ID NO: 6244 - protein, 95 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRR

SEQ ID NO: 6245 - protein, 63 aa, Homo sapiens
MSSSEEVSWISWFCGLRGNEFFCEVDEDYIQDKFNLTGLNEQVPHYRQALDMILDLEPDEELE

SEQ ID NO: 6246 - protein, 60 aa, Homo sapiens
MNSVGEACTDMKREYDQCFNRWFAEKFLKGDSSGDPCTDLFKRYQQCVQKAIKEKEIPIE

SEQ ID NO: 6247 - protein, 116 aa, Homo sapiens
  UNSURE 94: Xaa=Phe or Ile
  UNSURE 97: Xaa=Ala or Asp or Glu
MSLRSGGRRRADPGADGEASRDDGATSSVSALKRLERSQWTDKMDLRFGFERLKEPGEKTGWLINMHPTEILDEDKRLGSAVDYYFIQDDGSRXKVXLAYKTVFLQLRPERVVSEK

SEQ ID NO: 6248 - protein, 128 aa, Homo sapiens
  UNSURE 26: Xaa=Asn or Thr
  UNSURE 70: Xaa=Cys or Ser
  UNSURE 75: Xaa= *  or Ala or Glu or Gly or Ile or Lys or Leu or Pro or Gln or Arg or Ser or Thr or Val
  UNSURE 97: Xaa=Lys or Asn
  UNSURE 98: Xaa=Ile or Leu or Val
MAEQSDEAVKYYTLEEIQKHNHSKSXWLILHHKVYDLTKFLEEHPGGEEVLREQAGGDATENLMSGTLQXQGNVXTFIIGELHPVSTFWGPFLICIXXSDDLTLVCKLACIHILKGVKQKQLLILGHQ

SEQ ID NO: 6249 - protein, 116 aa, Homo sapiens
  UNSURE 66: Xaa=Ala or Leu or Pro or Val
  UNSURE 68: Xaa=Asp or His
  UNSURE 70: Xaa=Lys or Thr
MAEQSDEAVKYYTLEEIQKHNHSKSTWLILHHKVYDLTKFLEEHPGGEEVLREQAGGDATENFEDXGXSXDAREMSKTFIIGELHPDDRPKLNKPPETLITTIDSSSSWWTNWVIP

SEQ ID NO: 6250 - protein, 74 aa, Homo sapiens
MSWMFKRDPVWKYLQTVQYGVHGNFPRLSYPTFFPRFEFQDVIPPDDFLTSDEEVDSVLFGSLRGHVVGLRYYT

SEQ ID NO: 6251 - protein, 92 aa, Homo sapiens
  UNSURE 24: Xaa=Ile or Val
  UNSURE 28: Xaa= *  or Cys or Trp
  UNSURE 52: Xaa= *  or Ser
  UNSURE 64: Xaa=Ser or Thr
  UNSURE 76: Xaa=Ala or Glu or Gly or Val
  UNSURE 86: Xaa=Lys or Thr
MSVSEIFVELQGFLAAEQDIREEXKKSXTEFRTNSSRDFNSTARGPSGCWVXGHSKEVFESSRXFWYSKNTSNIFXRPNFLLNSIXDFMSTG

SEQ ID NO: 6252 - protein, 141 aa, Homo sapiens
  UNSURE 109: Xaa=Ala or Val
MSIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKXRFLEQQNKMLETKWSLCSSRRRLEATWTTCSR

SEQ ID NO: 6253 - protein, 101 aa, Homo sapiens
  UNSURE 16: Xaa=Ala or Val
  UNSURE 75: Xaa=Lys or Asn
MLSRAVCGTSRQLAPXLGYLGSRQKHSLPDLPYDYGALEPHINAQIMQLHHSKHHAAYVNNLNVTEEKYQEALAXGDVTAQIALQPALKFNGGGHINHSIF

SEQ ID NO: 6254 - protein, 110 aa, Homo sapiens
  UNSURE 22: Xaa=Ile or Asn or Ser or Thr
  UNSURE 65: Xaa=Ala or Asp or Glu or Gly or Val
  UNSURE 66: Xaa=Phe or Val
  UNSURE 92: Xaa=Ala or Asp or Glu or Gly or Val
MLDFFTIFSKGGLVLWCFQGVXDSCTGPVNALIRSVLLQERGGNNSFTHEALTLKYKLDNQFELXXVVGFQKILTLTYVDKLIDDVHRLFRXKYRTEIQQQSALSLLNGT

SEQ ID NO: 6255 - protein, 91 aa, Homo sapiens
MVNHFIAEFKRKHKKDISENKRAVRRLRTACERAKRTLSSSTQASIEIDSLYEGIDFYTSITRARFEELNADLFRGTLDPVEKALRDAKLD

SEQ ID NO: 6256 - protein, 83 aa, Homo sapiens
MAEAEGESLESWLNKATNPSNRQEDWEYIIGFCDQINKELEGPQIAVRLLAHKIQSPQEWEALQALTVLEACMKNCGRRFHNE

SEQ ID NO: 6257 - protein, 84 aa, Homo sapiens
  UNSURE 34: Xaa=Ala or Pro
MAEGSGEVVAVSATGLPTASTMGQAGPRRRPATXVAQLHKILETRLDNDKEMLEALKALSTFFVENSLRTRRNLRGDIERKSLA

SEQ ID NO: 6258 - protein, 109 aa, Homo sapiens
MGKQNSKLRPEMLQDLRENTEFSELELQEWYKGFLKDCPTGILNVDEFKKIYANFFPYGDASKFAEHVFRTFDTNSDGTIDFREFIIALSVTSRGPAWSRSSCGPSACM

SEQ ID NO: 6259 - protein, 136 aa, Homo sapiens
MSGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKD

SEQ ID NO: 6260 - protein, 79 aa, Homo sapiens
MAKTYDYLFKLLLIGDSGVGKTCLLFRFSEDAFNTTFISTIGIDFKIRTIELDGKKIKLQIWDTAGQERFRTITTAYYR

SEQ ID NO: 6261 - protein, 136 aa, Homo sapiens
  UNSURE 126: Xaa=Cys or Gly or Arg or Ser
  UNSURE 131: Xaa=Ala or Cys or Asp or Phe or Gly or His or Ile or Leu or Asn or Pro or Arg or Ser or Thr or Val or Tyr
  UNSURE 132: Xaa=Leu or Val
  UNSURE 134: Xaa=His or Gln
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDXFFSSXXWXPC

SEQ ID NO: 6262 - protein, 121 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSKGGGDRAMGVAGIMTVE

SEQ ID NO: 6263 - protein, 59 aa, Homo sapiens
MILLQHAVLPPPKQPSPSPPMSVATRSTGTLQLPPQKPFGQEASLPLAGEEELSKGGEQ

SEQ ID NO: 6264 - protein, 142 aa, Homo sapiens
  UNSURE 101: Xaa=Asn or Thr
  UNSURE 110: Xaa=Ala or Glu
  UNSURE 125: Xaa= *  or Cys
  UNSURE 131: Xaa=Ala or Glu or Lys or Thr
  UNSURE 133: Xaa=Asn or Thr
  UNSURE 135: Xaa=Phe or Ile
MNSFNYTTPDYGHYDDKDTLDLNTPVDKTSNTLRVPDILALVIFAVVFLVGVLGNALVVWVTAFEAKRTINAIWFLNLAVATSSPAWRCPSCSRPLYSITXGPLAGPPAXSCPPSSCSTCTPASXSWPPSXPXAXCWCLNPS

SEQ ID NO: 6265 - protein, 115 aa, Homo sapiens
  UNSURE 20: Xaa=Ala or Asp or Glu or Gly or Val
  UNSURE 91: Xaa=Asp or Glu
MATRNSPMPLGTAQGDPGEXGTRPGPDASLRDTGAATQLKMKPRKVHKIKAVIIDLGSQYCKCGYAGEPRPTYFISSTVGKRCPEAADAGXTRKWTLVGHELLNTEAASQAGEPA

SEQ ID NO: 6266 - protein, 61 aa, Homo sapiens
  UNSURE 29: Xaa= *  or Asp or Glu or Tyr
  UNSURE 32: Xaa=Ala or Glu
MDPGGAREHCLSPGQPERTKQDLGGGGWXRAXMVSNPVHGLPFLPGTSFKDSTKTAFHRSQ

SEQ ID NO: 6267 - protein, 71 aa, Homo sapiens
MVLGPEQKMSDDSVSGDHGESASLGNINPAYSNPSLSQSPGDSEEYFATYFNEKISIPEEEYSCFSFRKLW

SEQ ID NO: 6268 - protein, 66 aa, Homo sapiens
MQQKAFEESRYPWQESFENVAVCLPLRCPRCGDHTRFRSLSSLRAHLEFSHSYEERTLLTKCSLFP

SEQ ID NO: 6269 - protein, 82 aa, Homo sapiens
  UNSURE 12: Xaa=Glu or Gly
MDPLRAQQLAAXLEVEMMADMYNRMTSACHRKCVPPHYKEAELSKGESVCLDRCVSKYLDIHERMGKKLTELSMQDEELMKR

SEQ ID NO: 6270 - protein, 96 aa, Homo sapiens
MAEDKSKRDSIEMSMKGCQTNNGFVHNEDILEQTPDPGSSTDNLKHSTRGILGSQEPDFKGVQPYAGMPKEVLFQFSGQARYRIPLEILFWLAVAS

SEQ ID NO: 6271 - protein, 158 aa, Homo sapiens
  UNSURE 64: Xaa=Asp or Gly or Asn or Ser
  UNSURE 134: Xaa=Leu or Met
  UNSURE 148: Xaa=Ser or Thr
MAAPSWRGARLVQSVLRVWQVGPHVARERVIPFSSLLGFQRRCVSCVAGSAFSGPRLASASRSXGQGSALDHFLGFSQPDSSVTPCVPAVSMNRDEQDVLLVHHPDMPENSRVLRVVLLGAPNAGKSTLSNQLXGRKVFPVSRNVHTXRCQALGVITE

SEQ ID NO: 6272 - protein, 117 aa, Homo sapiens
  UNSURE 95: Xaa=His or Gln
MSCCWERGLAQEPGQQQATPGALLQAGPPRCSSLQAPIMLLSGHEGEVYCCKFHPNGSTLASAGFDRLILLWNVYGDCDNYATLKGHSGAVMELXYNTDGSMLFSASTDKTVAVWDS

SEQ ID NO: 6273 - protein, 92 aa, Homo sapiens
MAFFTGLWGPFTCVSRVLSHHCFSTTGSLSAIQKMTRVRVVDNSALGNSPYHRAPRCIHVYKKNGVGKVGDQILLAIKGQKKKALIVGHCMP

SEQ ID NO: 6274 - protein, 54 aa, Homo sapiens
MNSEQRINRIMGFHRPGSGAEEESQTKSKQQDSDKLNSLSVPSVSKRVVLGDSV

SEQ ID NO: 6275 - protein, 100 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFK

SEQ ID NO: 6276 - protein, 59 aa, Homo sapiens
  UNSURE 52: Xaa=His or Gln
MKIWTSEHVFDHPWETVTTAAMQKYPNPMNPSVVGVDVLDRHIDPSGKLHSXRLLSTEW

SEQ ID NO: 6277 - protein, 77 aa, Homo sapiens
  UNSURE 66: Xaa=Cys or Gly
MGDTHTGLALVYAKEQLFAEASGARPGVPKVLVWVTDGGSSDPVGPPMQELKDLGVTVFIVSTGRXNFLELSAAASA

SEQ ID NO: 6278 - protein, 127 aa, Homo sapiens
  UNSURE 40: Xaa=Leu or Met
  UNSURE 109: Xaa=His or Tyr
  UNSURE 110: Xaa=Asp or Tyr
MEGNRDEAEKCVEIAREALNAGNREKAQRFLQKAEKLYPXPSARALLEIIMKNGSTAGNSPHCRKPSGSGDQSKPNCTKDSTSGSGEGGKGYTKDQVDGVLSINKCKNXXEVLGVTKDAGDEDLKKA

SEQ ID NO: 6279 - protein, 59 aa, Homo sapiens
MATVVLGGDTMGPERIFPNQTEELGHQGPSEGTGDWSSEEPEEEQEETGSGPAGYSYQP

SEQ ID NO: 6280 - protein, 75 aa, Homo sapiens
MAGPQPLALQLEQLLNPRPSEADPEADPEEATAARVIDRFDEGEDGEGDFLVVGSIRKLASASLLDTDKRYCGKT

SEQ ID NO: 6281 - protein, 90 aa, Homo sapiens
  UNSURE 70: Xaa=Gly or Leu or Met or Arg or Val or Trp
MAEPVSPLKHFVLAKKAITAIFDQLLEFVTEGSHFVEATYKNPELDRIATEDDLVEMQGYKDKLSIIGEXLSRRHMKVAFFGRTSSGKSS

SEQ ID NO: 6282 - protein, 64 aa, Homo sapiens
  UNSURE 6: Xaa=Phe or Val
MLVHDXDDERTLEEEEMMEGETNFSSEIEDLAREGDMPIHELLSLYGYGSTVRLPEEDEEEEEE

SEQ ID NO: 6283 - protein, 124 aa, Homo sapiens
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDM

SEQ ID NO: 6284 - protein, 119 aa, Homo sapiens
  UNSURE 103: Xaa=Ile or Ser
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLXDSPGHVDFSSEVTAAL

SEQ ID NO: 6285 - protein, 98 aa, Homo sapiens
  UNSURE 41: Xaa=Arg or Thr
  UNSURE 76: Xaa=Ser or Thr
  UNSURE 94: Xaa=Asp or His
MHHCKRYRSPEPDPYLSYRWKRRRSYSREHEGRLRYPSRRXPPPRRSRSRSHDRLPYQRRYRERRDSDTYRCEERXHPLERTTMDLHVLVIVGXRGRG

SEQ ID NO: 6286 - protein, 98 aa, Homo sapiens
  UNSURE 76: Xaa=Ala or Pro
MHHCKRYRSPEPDPYLSYRWKRRRSYSREHEGRLRYPSRRSLPHEDLGPEAMTACPTRGGTGSAVTAIHTGVKSGXILWRGLLWTFTFSSSSAIAGEG

SEQ ID NO: 6287 - protein, 57 aa, Homo sapiens
MTLEELVACDNAAQKMQTVTAAVEELLVAAQRQDRLTVGVYESAKLMNVDPDSVVLC

SEQ ID NO: 6288 - protein, 147 aa, Homo sapiens
MLADLGLIGTIGEDDEVPVEPESDSGDEEEEGPIVLGRRQKALGKNRSADFNPDFVFTEKEGTYDGSWALADVMSQLKKKRAATTLDEKIEKFRKKRKTEDKEAKSGKLEKEKEAKEGSEPKEQEDLQENDEEGSEDEASETDYSSA

SEQ ID NO: 6289 - protein, 54 aa, Homo sapiens
MADRLTQLQDAVNSLADQFCNAIGVLQQCGPPASFNNIQTAINKDQPANPTEEY

SEQ ID NO: 6290 - protein, 61 aa, Homo sapiens
MAGEGDQQDAAHNMGNHLPLLPAESEEEDEMEVEDQDSKEAKKPNIINFDTSLPTSHTYLG

SEQ ID NO: 6291 - protein, 98 aa, Homo sapiens
  UNSURE 54: Xaa=Ala or Asp or Glu or Gly or Val
  UNSURE 75: Xaa= *  or Cys or Trp or Tyr
  UNSURE 80: Xaa=Asp or Glu
  UNSURE 98: Xaa=Lys or Asn
MDIPYHFALPYNQGTLPIRVYCRERTAKQPPSLNLQLIICNRFSLNPRHRMGNXFPHQVLRGLQEVTPGQGRLQXSLKRXMWTAWLGGDWWMSLELQX

SEQ ID NO: 6292 - protein, 70 aa, Homo sapiens
  UNSURE 25: Xaa=Ala or Pro
MKVSALTWPQLEVQGKEKQSSSQRXLDGVLLSPRLECNGTISAHCNLHLLGSSDSPASASQVAGVTGARH

SEQ ID NO: 6293 - protein, 74 aa, Homo sapiens
MFFLNIAMFIVVMVQICGRNGKRSNRTLREEVLRNLRSVVSLTFLLGMTWGFAFFAWGPLNIPFMYLFSIFNSL

SEQ ID NO: 6294 - protein, 135 aa, Homo sapiens
  UNSURE 68: Xaa=Leu or Pro or Gln or Arg
  UNSURE 100: Xaa=Phe or Leu
  UNSURE 101: Xaa=Cys or Gly or Arg or Ser
MAEAEFKDHSTAMDTEPNPGTSSVSTTTSSTTTTTITTSSSRMQQPQISVYSGSDRHAVQVIQQALHXPPSSAAQYLQQMYAAQQQHLMLHTAALQQQHXXSSQLQSLAAVQASLSSGRPSTSPTGSVTQQSSMS

SEQ ID NO: 6295 - protein, 56 aa, Homo sapiens
  UNSURE 17: Xaa=Ala or Gly
  UNSURE 43: Xaa=Lys or Gln
  UNSURE 45: Xaa= *  or Phe or Leu or Tyr
MSEETVPEAASPPPPQXRPYFDRFSEDDPEYMRLRNRAADLRXDXNLMEQKKRVTM

SEQ ID NO: 6296 - protein, 57 aa, Homo sapiens
MPLCPLAHAMQPQSVLHSGYFHPLLRAWQTATTTLNASNLIYPIFVTDVPDDIQPIT

SEQ ID NO: 6297 - protein, 110 aa, Homo sapiens
  UNSURE 2: Xaa=Pro or Arg
  UNSURE 49: Xaa=Leu or Pro
  UNSURE 51: Xaa=Gly or Arg
  UNSURE 61: Xaa=Asp or Glu or His or Gln
  UNSURE 74: Xaa=Gly or Arg
  UNSURE 76: Xaa=Gly or Leu or Arg or Val
  UNSURE 79: Xaa=Ala or Thr
MXMREARAVSPNTVVPTVVLETRPRGLAEQEPSVAVLGCRGSEAPASPXHXVEGNVSGCQXSQRADHDDETPGXDXEAXRDPSLRPARTVLVGSLSWLRKQLQPTHCKYE

SEQ ID NO: 6298 - protein, 57 aa, Homo sapiens
MTKEEKLQLRKEKKQQKKKRKEEKGAEPETGSAVSAAQCQVGPTRELPESGIQLGTP

SEQ ID NO: 6299 - protein, 118 aa, Homo sapiens
MGLAGVCALRRSAGYILVGGAGGQSAAAAARRCSEGEWASGGVRSFSRAAAAMAPIKVRLLADPTGAFGKETDLLLDDSLVSIFGNRRLKRFSMVVQDGIVKALNVEPDGTGLTCSLA

SEQ ID NO: 6300 - protein, 100 aa, Homo sapiens
  UNSURE 99: Xaa=Lys or Arg
MEPALEGTGKEGKKASSRKRTLAEPPAKGLLQPVKLSRAELYKEPTNEELNRLRETEILFHSSLLRLQVEELLKEVRLSEKKKDRIDAFLREVNQRVVXV

SEQ ID NO: 6301 - protein, 62 aa, Homo sapiens
  UNSURE 61: Xaa=Gly or Arg
MAELTALESLIEMGFPRGRAEKALALTGNQGIEAAMDWLMEHEDDPDVDEPLETPLGHILXR

SEQ ID NO: 6302 - protein, 109 aa, Homo sapiens
  UNSURE 72: Xaa=Ala or Pro or Ser or Thr
  UNSURE 73: Xaa=Cys or Asp or Gly or Tyr
  UNSURE 92: Xaa=Phe or Leu
  UNSURE 93: Xaa=Asp or Asn
MKERRAPQPVVARCKLVLVGDVQCGKTAMLQVLAKDCYPETYVPTVFENYTACLETEEQRVELSLWDTSGSXXYDNVRPLCYSDSDAVLLCXXISRPETVDSALKKWRT

SEQ ID NO: 6303 - protein, 73 aa, Homo sapiens
MAALLAAAAVRARILQVSSKVKSSPTWYSASSFSSSVPTVKLFIGGKFVESKSDKWIDIHNPATNEVIGRVPQ

SEQ ID NO: 6304 - protein, 68 aa, Homo sapiens
MEDLDQSPLVSSSDSPPRPQPAFKYQFVREPEDEEEEEEEEEEDEDEDLEELEVLERKPAAGLSAAPV

SEQ ID NO: 6305 - protein, 134 aa, Homo sapiens
  UNSURE 91: Xaa=Ala or Glu or Pro or Gln
  UNSURE 113: Xaa=Cys or Gly or Arg or Ser
  UNSURE 123: Xaa=Ser or Thr
  UNSURE 126: Xaa=Leu or Met or Val
MASCAEPSEPSAPLPAGVPPLEDFEVLDGVEDAEGEEEEEEEEEEEDDLSELPPLEDMGQPPAEEAEQPGALAREFLAAMEPEPAPAPAPXEWLDILGNGLLRKKTLVPGPPXSSAGQGQVVXVHXQTSLENAH

SEQ ID NO: 6306 - protein, 129 aa, Homo sapiens
  UNSURE 106: Xaa=Lys or Asn
  UNSURE 107: Xaa=Leu or Val
MVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVXXLRSLPQRFKMDVHITPGTHASE

SEQ ID NO: 6307 - protein, 57 aa, Homo sapiens
MSTPARRRLMRDFKRLQEDPPAGVSGAPSENNIMVWNAVIFGPEGTPFEDGTFKLTI

SEQ ID NO: 6308 - protein, 111 aa, Homo sapiens
  UNSURE 88: Xaa=Ala or Asp or Glu
  UNSURE 109: Xaa=Leu or Trp
MSRQVVRSSKFRHVFGQPAKADQCYEDVRVSQTTWDSGFCAVNPKFVALICEASGGGAFLVLPLGKTGRVDKNAPTVCGHTAPVLDIXWCPHNDNVIASGSEDCTVMVXEI

SEQ ID NO: 6309 - protein, 59 aa, Homo sapiens
MDVFKKGFSIAKEGVVGAVEKTKQGVTEAAEKTKEGVMYVGAKTKENVVQSVTSVAEKT

SEQ ID NO: 6310 - protein, 108 aa, Homo sapiens
  UNSURE 84: Xaa=Gly or Arg or Trp
MDPSDFPSPFDPLTLPEKPLAGDLPVDMEFGEDLLESQTAPTRGWAPPGPSPSSGALDLLDTPAGLEKDPGVLDGATELLGLGXLLYKAPSPPEVDHGPEGTWHGMQE

SEQ ID NO: 6311 - protein, 86 aa, Homo sapiens
MTEWMNEAVLLDWALSRAALRFSARMCAEPLSFWCWQDEQLRALVRQFGQQDWKFLASHFPNRTDQQCQYRWLRVLNPDLVKGPWT

SEQ ID NO: 6312 - protein, 101 aa, Homo sapiens
  UNSURE 6: Xaa=Leu or Val
MAASLXGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLH

SEQ ID NO: 6313 - protein, 99 aa, Homo sapiens
MYDADEDMQYDEDDDEITPDLWQEACWIVISSYFDEKGLVRQQLDSFDEFIQMSVQRIVEDAPPIDLQAEAQHASGEVEEPPRYLLKFEQIYLSKPTHW

SEQ ID NO: 6314 - protein, 57 aa, Homo sapiens
  UNSURE 21: Xaa=Leu or Met
  UNSURE 36: Xaa=Asn or Ser
  UNSURE 43: Xaa=Ile or Met
MDFLRNLFSQTLSLGSQKERXLDELTLEGVARYMQXERCRRVXCLVGAGISTSAGNP

SEQ ID NO: 6315 - protein, 105 aa, Homo sapiens
  UNSURE 32: Xaa=Asp or Glu or Val
  UNSURE 35: Xaa=Ala or Glu or Gly or Val
  UNSURE 40: Xaa=Pro or Gln
  UNSURE 43: Xaa=Ala or Glu
MTLVLSMNRFCEPIVSEGAAEIAGYQTLWEAXSYXGPSPXGPXQAPLQGDRGAGPPLAGSHYRGISNPITTSKITYFKRKYVEEEDFHPPLSSCSHKTISIFEDE

SEQ ID NO: 6316 - protein, 90 aa, Homo sapiens
  UNSURE 2: Xaa=Ala or Gly
  UNSURE 3: Xaa=Glu or Gly or Lys or Arg
  UNSURE 4: Xaa=Ala or Asp or Asn or Thr
  UNSURE 77: Xaa=Asp or Glu
  UNSURE 78: Xaa=Asp or His or Asn or Tyr
MXXXAAGVGRFKTNYAVERKIEPFYKGGKAQLDQTGQHLFCVCGTRVNILEVASGAVLRSLEQEDQEDITAFDLSPXXEVLVTASRALLL

SEQ ID NO: 6317 - protein, 150 aa, Homo sapiens
  UNSURE 38: Xaa=Leu or Pro
MELRAKEEERLNKLRLESEGSPETLTNLRKGYLFMYNXVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCI

SEQ ID NO: 6318 - protein, 91 aa, Homo sapiens
MDPVGLQLGNKNLWSCLVRLLTKDPEWLNAKMKFFLPNTDLDSRNETLDPEQRVILQLNKLHVQGSDTWQSFIHCVCMQLEVPLDLEVLLL

SEQ ID NO: 6319 - protein, 79 aa, Homo sapiens
  UNSURE 37: Xaa=Phe or Leu
MAAQALALLREVARLEAPLEELRALHSVLQAVPLNEXRQQAAECASARSSPCLTRTIGKRLLCVYPFWRDCSKLWNRFT

SEQ ID NO: 6320 - protein, 130 aa, Homo sapiens
  UNSURE 88: Xaa= *  or Gly
  UNSURE 105: Xaa=Ala or Asp or Glu or Gly or Ile or Lys or Asn or Arg or Ser or Thr or Val
  UNSURE 109: Xaa=His or Pro
MGQIEWAMWANEQALASGLILITGGIVATAGRFTQWYFGAYSIVAGVFVCLLEYPRGKRKKGSTMERWGQKYMTAVVKLFGPFTRNYXCSGRPASPALGARRLLXGHHXWDRLPGHCERHLPTGGCAWRA

SEQ ID NO: 6321 - protein, 101 aa, Homo sapiens
MAVCIAVIAKENYPLYIRSTPTENELKFHYMVHTSLDVVDEKISAMGKALVDQRELYLGLLYPTEDYKVYLSGQGVCQGGPTVARCTLGSDNLKPFRRKRG

SEQ ID NO: 6322 - protein, 61 aa, Homo sapiens
MEELQDDYEDMMEENLEQEALGGVKPAVLTRSGDPSQPLLPQHSSLETQLFCEQGDGGTEG

SEQ ID NO: 6323 - protein, 83 aa, Homo sapiens
MAASTDMAGLEESFRKFAIHGDPKASGQEMNGKNWAKLCKDCKVADGKSVTGTDVDIVFSKVKGKSARVINYEEFKKALEELA

SEQ ID NO: 6324 - protein, 51 aa, Homo sapiens
  UNSURE 5: Xaa=Glu or Gln
  UNSURE 41: Xaa=Asp or Glu
  UNSURE 42: Xaa=Asp or Asn
MLRGXHPPARCRDAPPTPLPLQLDGWIHEKMLMARDGTREXXHKLHKRWLR

SEQ ID NO: 6325 - protein, 60 aa, Homo sapiens
  UNSURE 37: Xaa=Asp or His or Asn or Tyr
MSCTIEKALADAKALVERLRDHDDAAESLIEQTTALXKRVEAMKQYQEEIQELNEVARHR

SEQ ID NO: 6326 - protein, 79 aa, Homo sapiens
MSYNYVVTAQKPTAVNGCVTGHFTSAEDLNLLIAKNTRLEIYVVTAEGLRPVKEVGMYGKIAVMELFRPKGESKDLLFI

SEQ ID NO: 6327 - protein, 108 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQF

SEQ ID NO: 6328 - protein, 71 aa, Homo sapiens
  UNSURE 57: Xaa=Pro or Arg
MMEKNTSEGPACSPEETASESAKVPTAEPPGEVAVSESTREEQVPKPQALPHRPLQXPQPLSLHPQVKMSP

SEQ ID NO: 6329 - protein, 108 aa, Homo sapiens
  UNSURE 72: Xaa= *  or Leu
MGEAEKFHYIYSCDLDINVQLKIGSLEGKREQKSYKAVLEDPMLKFSGLYQETCSDLYVTCQVFAEGKPLAXPVRTSYKAFSTRWNWNEWLKLPVKYPDLPRNAQVAL

SEQ ID NO: 6330 - protein, 83 aa, Homo sapiens
MASRKAGTRGKVAATKQAQRGSSNVFSMFEQAQIQEFKEAFSCIDQNRDGIICKADLRETYSQLGKVSVPEEELDAMLQEGKG

SEQ ID NO: 6331 - protein, 113 aa, Homo sapiens
  UNSURE 24: Xaa=Ala or Ser
  UNSURE 82: Xaa=Ala or Pro
MIPICPVVSFTYVPSRLGEDAKMXTGNYFGFTHSGAAAAAAAAQYSQQPASGVAYSHPTTVASYTVHQAPVAAHTVTAAYAXAAATVAVARPAPVAVAAAATAAAYGGYPLHT

SEQ ID NO: 6332 - protein, 56 aa, Homo sapiens
MFQIPEFEPSEQEDSSSAERGLGPSPAGTGPQAPASIIARPQASCGTPVTSRSSQP

SEQ ID NO: 6333 - protein, 63 aa, Homo sapiens
  UNSURE 50: Xaa=Asp or Glu
MQLTERERQPVLPSLSLGISSHQGPAFRTSNNPSLLPCHSLPERKEKERXRFWNLNLPKEETY

SEQ ID NO: 6334 - protein, 157 aa, Homo sapiens
  UNSURE 84: Xaa=Asp or Glu
MERRLIKKEMKKLLGDYIGIRLRENEFDPKGRRQLTFLDDMAHYDLAISVALQWLDPSEDLTWLEWEELKIPLHGRPIYPNRRXREAIILSSYAGILMNSIPIEEVFKIYGADSSADSGTIKVPRVSSLRLSLHPFAMLTAPKAAAYARKQGVKSRK

SEQ ID NO: 6335 - protein, 60 aa, Homo sapiens
MASTPMGNEGEKKSSWPSQAAPSLRGGPASLSRSEEYLSQISAELMEEALCTACCHLNPV

SEQ ID NO: 6336 - protein, 109 aa, Homo sapiens
  UNSURE 94: Xaa=Ile or Val
  UNSURE 97: Xaa=Ile or Lys or Met or Asn or Arg or Ser or Thr
  UNSURE 98: Xaa=Asp or Tyr
MVVGYPLVVVMGVLPLEGLMDHQLVEGPMDTPILGCSPLELQEDHMAVQLPGAPMVSHLQVPTVPSSLGFMDRVAPLPMWILRPTPGSSRWTQXTVXXISMKELKQALV

SEQ ID NO: 6337 - protein, 92 aa, Homo sapiens
MDRSLPVFSIQDSPFGDAPLGRSHYWPSQSQTWCPKTLSPSRSQRSRLPQAPKALATGPNSPELFEESWPSSSGTPSLPSTTEGQMWASPAP

SEQ ID NO: 6338 - protein, 134 aa, Homo sapiens
  UNSURE 86: Xaa=Pro or Ser
  UNSURE 88: Xaa=Cys or Arg
  UNSURE 91: Xaa=Asn or Ser or Thr or Tyr
MEMFQRAQALRRRAEDYYRCKITPSARKPLCNRVRMAAVEHRHSSGLPYWPYLTAETLKNRMGHQPPPPTQQHSIIDNSLSLKTPXEXLLXPLPPSADDNLKTPPECLLTPLPPSALPSADDNLKTPAECLLYP

SEQ ID NO: 6339 - protein, 92 aa, Homo sapiens
  UNSURE 89: Xaa= *  or Lys
MPVVRKIFRRRRGDSESEEDEQDSEEVRLKLEETREVQNLRKRPNGVSAVALLVGEKVQEETTLVDDPFQMKTGGMVDMKKLKERGKDXISE

SEQ ID NO: 6340 - protein, 128 aa, Homo sapiens
MDTDLYDEFGNYIGPELDSDEDDDELGRETKDLDEMDDDDDDDDVGDHDDDHPGMEVVLHEDKKYYPTAEEVYGPEVETIVQEEDTQPLTEPIIKPVKTKKFTLMEQTLPVTVYEMDFLADLMDNSEL

SEQ ID NO: 6341 - protein, 58 aa, Homo sapiens
MAASCVLLHTGQKMPLIGLGTWKSEPGQVKAAVKYALSVGYRHIDCAAIYGNEPEIGE

SEQ ID NO: 6342 - protein, 58 aa, Homo sapiens; identical to SEQ ID NO: 6341

SEQ ID NO: 6343 - protein, 84 aa, Homo sapiens
  UNSURE 49: Xaa=Ala or Glu
  UNSURE 67: Xaa=Lys or Met or Arg or Thr
MKQLPVLEPGDKPRKATWYTLTVPGDSPCARVGHSCSYLPPVGNAKRGXVFIVGGANPNRSFSDVHXVGSGHSDLVTARDTWKS

SEQ ID NO: 6344 - protein, 57 aa, Homo sapiens
MKAGATSMWASCCGLLNEVMGTGAVRGQQSAFAGATGPFRFTPNPEFSTYPPAATEG

SEQ ID NO: 6345 - protein, 63 aa, Homo sapiens
MMITGLWTPWTGPWLSWLPEEGQGPPMSPVSAFWNCPSLKEALERAEQLCYECVCVCVLFLFF

SEQ ID NO: 6346 - protein, 59 aa, Homo sapiens
MWTLRGPSAFSSLRTIVLRWCSQQGSDSVCGGVWPLRLCLGGVVVMSGVCDPDCAGLCV

SEQ ID NO: 6347 - protein, 56 aa, Homo sapiens
  UNSURE 6: Xaa=Phe or Val
  UNSURE 8: Xaa=Asp or Gly
  UNSURE 42: Xaa=Asp or Gly
MAGILXEXIFDVKDIDPEGKKFDRVSRLHCESESFKMDLILXVNIQIYPVDLGDKF

SEQ ID NO: 6348 - protein, 121 aa, Homo sapiens
MVHQVLYRALVSTKWLAESIRTGKLGPGLRVLDASWYSPGTREARKEYLERHVPGASFFDIEECRDTASPYEMMLPSEAGFAEYVGRLGISNHTHVVVYDGEHWAASMLPGSGGCSVCLAT

SEQ ID NO: 6349 - protein, 108 aa, Homo sapiens
  UNSURE 66: Xaa=Ala or Pro or Ser or Thr
MSRFKFIDIGINLTDPMFRGIYRGVQKHQDDLQDVIGRAVEIGVKKFMITGGNLQDSKDALHLAQXNGMFFSTVGCHPTRCGEFEKNNPDLYLKELLNLAENNKGKVV

SEQ ID NO: 6350 - protein, 65 aa, Homo sapiens
MKGGFTGGDEYQKHFLPRDYLATYYSFDGSPSPEAEMLKFNLECLHKTFGPGGLQGDTLIDIGSG

SEQ ID NO: 6351 - protein, 81 aa, Homo sapiens
MLLPVWRHGQFPAPRSSFLPSLRRSHNFQEHGLKAPSPQRPSEILCVFLRFLRPFLFWGALRSPCLSPPLPLSQTCLLPSR

SEQ ID NO: 6352 - protein, 67 aa, Homo sapiens
MAAAATLAMAVKPIRTYSGEGDTVRTHRGAGGDVEGGGGKKSDREQEEGRAGTQRAVEASAGSSKSG

SEQ ID NO: 6353 - protein, 64 aa, Homo sapiens
MARFSRGFHWSQPGPPGNPPLIGQSHQEGWSRAQVFLRIWVIYKKPLAECRVGRTKDKSIFFQK

SEQ ID NO: 6354 - protein, 92 aa, Homo sapiens
  UNSURE 26: Xaa=Glu or Val
  UNSURE 28: Xaa=Gly or Trp
  UNSURE 62: Xaa=Ala or Asp or Glu or Gly or His or Leu or Pro or Gln or Arg or Val
MPSKKKKYNARFPPARIKKIMQTDEXIXKVAAAVPVIISRALELFLESLLKKACQVTQSRNXRTMTTSHLKQCIELEQQFDFLKDLVASVPD

SEQ ID NO: 6355 - protein, 68 aa, Homo sapiens
MMDVSGVGFPSKVPWKKMSAEELENQYCPSRWVVRLGAEEALRTYSQIGIEGTSVTSLWPHWVSLSMW

SEQ ID NO: 6356 - protein, 95 aa, Homo sapiens
MNPFCEIAVEEAVRLKEKKLVKEVIAVSCGPAQCQETIRTALAMGADRGIHVEVPPAEAERLGPLQVARVLAKLAEKEKVDLVLLGKQAIDDDCN

SEQ ID NO: 6357 - protein, 85 aa, Homo sapiens
  UNSURE 73: Xaa=Asp or Glu
MGSRASTLLRDEELEEIKKETGFSHSQITRLYSRFTSLDKGENGTLSREDFQRIPELAINPLGDRIINAFFPXGEDQVNFRGFMR

SEQ ID NO: 6358 - protein, 55 aa, Homo sapiens
MLRGREDGELEEGELEDDGAEETQDTSGGPERSRKEKGEKHHSDSDEEKSHRRRS

SEQ ID NO: 6359 - protein, 94 aa, Homo sapiens
MAPFPEEVDVFTAPHWRMKQLVGLYCDKLSKTNFSNNNDFRALLQSLYATFKEFKMHEQIVNEYIIGLLQQRSQTIYNVHSDKNSPRCLASLKR

SEQ ID NO: 6360 - protein, 55 aa, Homo sapiens
  UNSURE 8: Xaa=Leu or Pro
  UNSURE 11: Xaa=Glu or Lys
MTRTSSGXGLXEAGPKESSEEGKEGKTPSKEKKKKKKKGKEEEEKAAKKKSKHKK

SEQ ID NO: 6361 - protein, 82 aa, Homo sapiens [sequence omitted]

SEQ ID NO: 6362 - protein, 96 aa, Homo sapiens
  UNSURE 74: Xaa=His or Leu or Pro or Gln or Arg
MSSKQEIMSDQRFRRVAKDPRFWEMPEKDRKVKIDKRFRAMFHDKKFKLNYAVDKRGRPISHSTTEDLKRFYDXSDSDSNLSGEDSKALSQKKIKK

SEQ ID NO: 6363 - protein, 57 aa, Homo sapiens
  UNSURE 48: Xaa=Pro or Ser
MLLRVCVGRGSLGTLQRWRWADGLAAWWLMVLLPLPFFFEFILIDFFXWFLDKPPSG

SEQ ID NO: 6364 - protein, 85 aa, Homo sapiens
  UNSURE 79: Xaa=Ile or Lys or Arg or Thr
  UNSURE 80: Xaa=Ala or Asp or Glu or Gly or Val
MKMWTNTPHQPQVPKGGRRGRHPVKRRSRSGVKGLKTTRKAKRPLRGSSSQKAGETNTPAGKPKKARGPILRGRYHRLXXKMKKE

SEQ ID NO: 6365 - protein, 52 aa, Homo sapiens
  UNSURE 50: Xaa=Phe or Ile or Leu or Val
MSCTIEKILTDAKTLLERLREHDAAAESLVDQSAALHRRVAAMREAGTAXPD

SEQ ID NO: 6366 - protein, 102 aa, Homo sapiens
  UNSURE 13: Xaa=Ala or Glu
  UNSURE 22: Xaa=Ala or Pro or Ser or Thr
  UNSURE 88: Xaa=Cys or Ser
  UNSURE 98: Xaa=Gly or Val
MASGPHSTATAAXAASSAAPSXGGSSSGTTTTTTTTTGGILIGDRLYSEVSLTIDHSLIPERGSRPPHPCRMGSTCPVRRTYASWAAXSSRPPAFSSXCRRW

SEQ ID NO: 6367 - protein, 70 aa, Homo sapiens
  UNSURE 15: Xaa=Leu or Pro
  UNSURE 23: Xaa=Ser or Thr
MKPKGISELQHLNDXTQRFTQKXGHNSEEPPRRRQQCPCYPCHTQRLPLCLLVLTVTIKGRPLVCFLNEP

SEQ ID NO: 6368 - protein, 70 aa, Homo sapiens
MASLMPSLLHSRCPEAPGRASFMEIQNCNRTGPCTWKGPAFGNVLLSPSAGLIIFKEALDLHFDWVLQII

SEQ ID NO: 6369 - protein, 109 aa, Homo sapiens
MSRFPAVAGRAPRRQEEGERSRDLQEERLSAVCIADREEKGCTSQEGGTTPTFPIQKQRKKIIQAVRDNSFLIVTGNTGSGKTTQLPKYLYEAGFSQHGMIGVTQPRKV

SEQ ID NO: 6370 - protein, 105 aa, Homo sapiens
  UNSURE 2: Xaa=His or Arg
  UNSURE 84: Xaa=Ser or Thr
MXLGAQRPASVWSGGGAERGITLYKGPAKSRDGERTVYCNVHKHEPLVLFCESCDTLTCRDCQLNAHKDHQYQFLEDAVRNQRXPGLTGEAPWGQHATLQKSTRK

SEQ ID NO: 6371 - protein, 67 aa, Homo sapiens
  UNSURE 65: Xaa=Ile or Lys or Met or Asn
  UNSURE 66: Xaa=Glu or Gln
MEEMSGESVVSSAVPAAATRTTSFKGTSPSSKYVKLNVGGALYYTTMQTLTKQDTMLKAMFSGRXXV

SEQ ID NO: 6372 - protein, 92 aa, Homo sapiens
  UNSURE 5: Xaa=Asp or Gly
  UNSURE 79: Xaa=Asp or Gly
MSDSXEQNYGERESRSASRSGSAHGSGKSARHTPARSRSKEDSRRSRSKSRSRSESRSRSRRSSRSIIPGHGLAPAPIXDHVAGLTVEIIVD

SEQ ID NO: 6373 - protein, 136 aa, Homo sapiens
  UNSURE 2: Xaa=Leu or Trp
MXPYTVNFKVSARTLTGALNAHNKAAVDWGWQGLIAYGCHSLVVVIDSITAQTLQVLEKHKADVVKVKWARENYHHNIGSPYCLRLASADVNGKIIVWDVAAGVAQCEIQEHAKPIQDVQWLWNQDASRDLLLAIH

SEQ ID NO: 6374 - protein, 133 aa, Homo sapiens
MNAGSDPVVIVSAARTIIGSFNGALAAVPVQDLGSTVIKEVLKRATVAPEDVSEVIFGHVLAAGCGQNPVRQASVGAGIPYSVPAWSCQMICGSGLKAVCLAVQSIGIGDSSIVVAGGMENMSKAPHLAYLRT

SEQ ID NO: 6375 - protein, 85 aa, Homo sapiens
MPPVGGKKAKKGILERLNAGEIVIGDGGFVFALEKRGYVKAGPWTPEAAVEHPEAVRQLHREFLRAGSNVMQTFTFYASEDKLEN

SEQ ID NO: 6376 - protein, 100 aa, Homo sapiens
  UNSURE 75: Xaa=Glu or Gly
MATELEYESVLCVKPDVSVYRIPPRASNRGYRASDWKLDQPDWTGRLRITSKGKTAYIKLEDKVSGELFAQAPVXQYPGIAVETVTDSSRYFVIRIQDGT

SEQ ID NO: 6377 - protein, 139 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQHPPDGTGDSDSQHTHNPDTNPSATWWRAL

SEQ ID NO: 6378 - protein, 53 aa, Homo sapiens
  UNSURE 3: Xaa=Ser or Thr
  UNSURE 18: Xaa=Ile or Thr
MTXRQATKDPLLRGVSPXPSKIPVRSQKRTPFPTVTSCAVDQENQDPRRWVQK

SEQ ID NO: 6379 - protein, 72 aa, Homo sapiens
MAVPGCNKDSVRAGCKKCGYPGHLTFECRNFLRVDPKRDIVLDVSSTSSEDSDEENEELNKLQALQEKRINE

SEQ ID NO: 6380 - protein, 82 aa, Homo sapiens
  UNSURE 44: Xaa=Gly or Arg
MAFSGRARPCIIPENEEIPRAALNTVHEANGTEDERAVSKLQRXHSDVKVYKEFCDFYAKFNMANALASATCERCKGGFAPA

SEQ ID NO: 6381 - protein, 119 aa, Homo sapiens
  UNSURE 57: Xaa=Ile or Lys or Arg or Thr
MALLAEHLLKPLPADKQIETGPFLEAVSHLPPFFDCLGSPVFTPIKADISGNITKIXAVYDTNPAKFRTLQNILEVEKEMYGAEWPKVGATLALMWLKRGLRFIQVFLQSICDGERDEN

SEQ ID NO: 6382 - protein, 75 aa, Homo sapiens
MLTPAFDLSQDPDFLTIAIRVPYARVSEFDVYFEGSDFKFYAKPYFLRLTLPGRIVENGSEQGSYDADKGIFTIR

SEQ ID NO: 6383 - protein, 91 aa, Homo sapiens
MSKPHSEAGTAFIQTQQLHAAMADTFLEHMCRLDIDSPPITARNTGIICTIGPASRSVETLKEMIKSGMNVARLNFSHGTHEYHAETIKNV

SEQ ID NO: 6384 - protein, 100 aa, Homo sapiens
MLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVN

SEQ ID NO: 6385 - protein, 67 aa, Homo sapiens
MQKKLRSNWKIQSLKDEITSEKLNGVKLWITAGPREKFTAAEFEILKKYLDTGGDVFVMLGEGGESR

SEQ ID NO: 6386 - protein, 62 aa, Homo sapiens
MSALTRLASFARVGGRLFRSGCARTAGDGGVRHAGGGVHIEPRYRQFPQLTRSQVFQSEFFS

SEQ ID NO: 6387 - protein, 228 aa, Homo sapiens
  UNSURE 174: Xaa=Ala or Ser
MQSGSSMSTIGSMMSIYSEAGDFGNIFVTGRIAFSLKYEQQTQSLVVHVKECHQLAYADEAKKRSNPYVKTYLLPDKSRQGKRKTSIKRDTVNPLYDETLRYEIPESLLAQRTLQFSVWHHGRFGRNTFLGEAEIQMDSWKLDKKLDHCLPLHGKISAESPTGLPSHKGELVVXLKYIPASKTPVGGDRKKSKGGEGGELQVWIKEAKNLTAAKAGGTSDSFVKGYSF

SEQ ID NO: 6388 - protein, 117 aa, Homo sapiens
MAALTLRGVRELLKRVDFATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAT

SEQ ID NO: 6389 - protein, 55 aa, Homo sapiens
  UNSURE 25: Xaa=Ile or Met
  UNSURE 26: Xaa=Ala or Glu or Gly or Val
MPVAVGPYGQSQPSCFDRVKMGFVXXLRRGHGGRGALRHLFLSQDRNAGSRADGR

SEQ ID NO: 6390 - protein, 64 aa, Homo sapiens
  UNSURE 5: Xaa=Glu or Gly
  UNSURE 43: Xaa=Gly or Arg or Trp
MELYXIGGGQDVRLYPEVPEVLKRLQSLGVPGAAASRTSEIEXANQLLELFDLFRYFVHREIYP

SEQ ID NO: 6391 - protein, 107 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTP

SEQ ID NO: 6392 - protein, 116 aa, Homo sapiens
  UNSURE 77: Xaa=Asp or His
MGAPTLPPAWQPFLKDHRISTFKNWPFLEGCACTPERMAEAGFIHCPTENEPDLAQCFFCFKELEGWEPDDDPIEEXKKHSSGCAFLSVKKQFEELTLGEFLKLDRERAKNKIAKE

SEQ ID NO: 6393 - protein, 77 aa, Homo sapiens
  UNSURE 66: Xaa=His or Leu or Pro or Arg
  UNSURE 72: Xaa=Gly or Val
MEDLDALLSDLETTTSHMPRSGAPKERPAEPLTPPPSYGHQPQTGSGESSGASGDKDHLYSTVCKXRSPKPXAPAAP

SEQ ID NO: 6394 - protein, 62 aa, Homo sapiens
MSEGVDLIDIYADEEFNQDPEFNNTDQIDLYDDVLTATSQPSDDRSSSTEPPPPVRQEPSPK

SEQ ID NO: 6395 - protein, 77 aa, Homo sapiens
MWNATLELSNRQRLEQFGGLRSRWENVGKFGIRKVLKGSEDRKMWGSLELPRDLLNGFDQNADSDMGNEVQTKVVSD

SEQ ID NO: 6396 - protein, 57 aa, Homo sapiens
MCGYGICEYSTDEVYKGYFQEGLRHGFGVLESGPQPPSPSGTRATGRGARGAAMALR

SEQ ID NO: 6397 - protein, 51 aa, Homo sapiens
  UNSURE 25: Xaa=His or Gln
  UNSURE 32: Xaa=Glu or Gln
MPENVAPRSGATAGAAGGRGKGAYXDRDKPAXIRFSNISAAKAVADAIRTS

SEQ ID NO: 6398 - protein, 86 aa, Homo sapiens
  UNSURE 2: Xaa=Lys or Thr
  UNSURE 32: Xaa=Leu or Met or Val
  UNSURE 45: Xaa= *  or Glu or Gly
  UNSURE 57: Xaa=Gly or Leu or Met or Arg or Val or Trp
  UNSURE 82: Xaa=His or Gln
  UNSURE 83: Xaa=Leu or Val
MXAAGAALVFVFSSGQRRILDGSLGFAAGVMXAASYWSLLAPSSXEWPRPLGASVPXPSSLWLVGFTLGAAFVYLADLLMPXXGCS

SEQ ID NO: 6399 - protein, 103 aa, Homo sapiens
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNN

SEQ ID NO: 6400 - protein, 59 aa, Homo sapiens
  UNSURE 6: Xaa=Ser or Thr
MISRRXGGGRERVEDLFEYEGCKVGRGTYGHVYKARRKDGFQEGFVYGPQALEVADFSA

SEQ ID NO: 6401 - protein, 52 aa, Homo sapiens
  UNSURE 22: Xaa=Lys or Gln
MRSRLRRGGRDGLDTRMTGAPXRTSRHSQEPFQTLRRRDWSQKHLKNLPVSF

SEQ ID NO: 6402 - protein, 53 aa, Homo sapiens
MCRTPYISSSESRDSALPPSLPLCPLPVPPLGAGRREGGEVRGLSEGPHLLTQ

SEQ ID NO: 6403 - protein, 127 aa, Homo sapiens
  UNSURE 36: Xaa=any one of the twenty amino acids
MMRRTLENRNAQTKQLQTAVSNVEKHFGELCQIFAXYVRKTARLRDKADLLVNEINAYAATETPHLKLGLMNFADEFAKLQDYRQAEVERLEAKVVEPLKTYGTIVKMKRDDLKATLTARNREAKQL

SEQ ID NO: 6404 - protein, 60 aa, Homo sapiens
MTPVRMQHSLAGQTYAVPLIQPDLRREEAVQQMADALQYLQKVSGDIFSRISQRVEQSRS

SEQ ID NO: 6405 - protein, 58 aa, Homo sapiens
MCTDRWPERYTAVIEVTSGGPWGDWAWPEMCPDGFFASGFSLKVEPPQGIPGDDTALN

SEQ ID NO: 6406 - protein, 150 aa, Homo sapiens
  UNSURE 23: Xaa=Lys or Asn
  UNSURE 41: Xaa= *  or Cys or Arg or Ser or Thr or Trp
  UNSURE 59: Xaa=Arg or Ser
  UNSURE 60: Xaa=Asp or His or Asn or Tyr
  UNSURE 127: Xaa= *  or Ala or Asp or Glu or His or Lys or Asn or Pro or Gln or Ser or Thr or Tyr
MSDPDSSIIDFYPEDFAIDLNGXKYAWQGVALLPFVDERRXRAALEEVYPDLTPEETRXXSLGGDVLFVGKHHPLHDFILELYQTGSTEPVEVPPELCHGIQGKFSLDEEAILPDQIVCSPVPMLRXLTQNTVVSINFKDPQFAEDYIFK

SEQ ID NO: 6407 - protein, 120 aa, Homo sapiens
  UNSURE 67: Xaa=Arg or Ser
  UNSURE 70: Xaa=Lys or Asn or Thr
  UNSURE 94: Xaa= *  or Ala or Glu or Gly or Lys or Leu or Met or Pro or Gln or Arg or Ser or Thr or Val or Trp
MMFGGYETIEAYEDDLYRDESSSELSVDSEVEFQLYSQIHYAQDLDDVIREEEHEEKNSGNSESSSXKPXQKKLIVLSDSEVIQLSDGSEVITXSDEDSIYRCKGKNVRVQAQENAHGLS

SEQ ID NO: 6408 - protein, 63 aa, Homo sapiens
  UNSURE 4: Xaa=Ala or Phe or Ile or Leu or Pro or Ser or Thr or Val
MWSXGSARATRCRASRSSTVSRWNRLKGPIGARDEEKGEGTPREEGKAGVQSVGEKESLEAAK

SEQ ID NO: 6409 - protein, 69 aa, Homo sapiens
  UNSURE 55: Xaa= *  or Tyr
MAPPSGMIRVTAGRGSFEWRPAGGDPNRRAGRRPFSREGPIWRKSSRLVKLGGRXTGLTATMTKYNTPS

SEQ ID NO: 6410 - protein, 132 aa, Homo sapiens
  UNSURE 58: Xaa=Lys or Thr
  UNSURE 132: Xaa=His or Gln
MAASMCDVFSFCVGVAGRARVSVEVRFVSSAKGKGAVCHTAHPEGGDHLRRTAPGGCXFLWNALYRYRACDHCLRALEKAEENAQRLTGKPGQVLPHPELCTVRKDLHQNCPHCQVMYCSAECRLAATEQYX

SEQ ID NO: 6411 - protein, 52 aa, Homo sapiens
MAACRYCCSCLRLRPLSDGPFLLPRRDRALTQLQVRALWSSAGSRAVAVDLG

SEQ ID NO: 6412 - protein, 72 aa, Homo sapiens
  UNSURE 15: Xaa=Ile or Met or Thr
  UNSURE 52: Xaa=Asp or Glu or Gly
  UNSURE 53: Xaa=Ala or Asp or Gly or Ile or Asn or Ser or Thr or Val
MTNLQIKEEKVKADXNGIIKTSTTAEKTDEEEKEDRAAQSLLNKLIRSNLVXXTNQGGSPATGSKLPSVLGE

SEQ ID NO: 6413 - protein, 65 aa, Homo sapiens
MTSDKLHKMLSFGFSDKVTMNGHVPVGLYGNGFKSGSMRLGKDAIVFTKNGESMSVGLLSQTYLE

SEQ ID NO: 6414 - protein, 65 aa, Homo sapiens
  UNSURE 41: Xaa=Met or Thr
MEWNQLEWKGMEWNGKEWNEVNSSGMEWNGMDWNGLQWNEXEWNGMESIIPSGMEGNLMEGKEGN

SEQ ID NO: 6415 - protein, 97 aa, Homo sapiens
MKDIDIGKEYIIPSPGYRSVRERTSTSGTHRDREDSKFRRTRPLECQDALETAARAEGLSLDASMHSQLRILDEEHPKGKYHHGLSALKPIRTTSKH

SEQ ID NO: 6416 - protein, 55 aa, Homo sapiens
  UNSURE 43: Xaa=Leu or Pro
  UNSURE 44: Xaa= *  or Cys or Phe or Leu or Ser or Tyr
MVCPGLRGFRMWDSCFTLGPSQANRAELVPLSCKSKQLREVSXXASTITQFVFNN

SEQ ID NO: 6417 - protein, 72 aa, Homo sapiens
  UNSURE 53: Xaa=Cys or Phe
  UNSURE 60: Xaa=Asp or Glu
MAETNNECSIKVLCRFRPLNQAEILRGDKFIPIFQGDDSVVIGGKPYVFDRVXPPNTTQXQVYHACAMQIVK

SEQ ID NO: 6418 - protein, 69 aa, Homo sapiens [sequence omitted]

SEQ ID NO: 6419 - protein, 102 aa, Homo sapiens
MAEPTSDFETPIGWHASPELTPTLGPLSDTAPPRDRWMFWAMLPPPPPPLTSSLPAAGSKPSSESQPPMEAQSLPGAPPPSTPRFFPGRNPPSTPSLPLILS

SEQ ID NO: 6420 - protein, 51 aa, Homo sapiens
  UNSURE 5: Xaa= *  or Tyr
  UNSURE 11: Xaa=Ile or Lys or Met or Asn or Arg or Ser or Thr
MQSLXSRRKIXEYCLQDIDDKLSESAEDDGEDDTNDEDDDEDSNPKKILRP

SEQ ID NO: 6421 - protein, 79 aa, Homo sapiens
MLALEAAQLDGPHFSCLYPDGVFYDLDSCKHSSYPDSEGAPDSLWDWTVAPPVPATPYEAFDPAAAAFSHPQAAQLCYE

SEQ ID NO: 6422 - protein, 88 aa, Homo sapiens
  UNSURE 32: Xaa=Phe or Ile or Leu or Val
  UNSURE 56: Xaa=His or Leu or Pro or Arg
  UNSURE 62: Xaa=Leu or Val
  UNSURE 84: Xaa=Phe or Ile or Leu or Val
MLRGMYLTRNGNLQRRQTMKEAKDMKNKLGIXRRRNESPGAPPAGKADKMMKSFKXTSEEAXKWGESLEKLLVHKYGLAVFQAXLRTE

SEQ ID NO: 6423 - protein, 95 aa, Homo sapiens
  UNSURE 54: Xaa=Ala or Ser
  UNSURE 75: Xaa= *  or Glu or Lys or Gln
  UNSURE 95: Xaa=Cys or Gly or Arg or Ser
MTAAVTTWPLCGLSPAGRRCCVGRTAAPGRITWKENLLYAPSLRFIHGLIKQFXENIYEAFLVGKPSDCTLASAXCNEYSEEEELVKGVLMAGLX

SEQ ID NO: 6424 - protein, 51 aa, Homo sapiens
MDVFMKGLSKAKEGVVAAAEKTKQGVAEAAGKTKEGVLYVGSKTKEGVVHG

SEQ ID NO: 6425 - protein, 79 aa, Homo sapiens
  UNSURE 10: Xaa= *  or Gly or Arg
MPGEQMDPTXSQLDSDFSQQDTPCLIIEDSQPESQVLEDDSGSHFSMLSRHLPNLQTHKENPVLDVVSNPEQTAGEERG

SEQ ID NO: 6426 - protein, 87 aa, Homo sapiens
  UNSURE 75: Xaa=His or Gln
  UNSURE 76: Xaa=Ala or Pro or Ser or Thr
MAGMKTASGDYIDSSWELRVFVGEEDPEAESVTLRVTGESHIGGVLLKIVEQINRKQDWSDHAIWWEQKRQWLLXXHWTLDKYGILA

SEQ ID NO: 6427 - protein, 51 aa, Homo sapiens
MDNYADLSDTELTTLLRRYNIPHGPVVGSTRRLYEKKIFEYETQRRRLSPP

SEQ ID NO: 6428 - protein, 74 aa, Homo sapiens
  UNSURE 3: Xaa=Gln or Arg
  UNSURE 29: Xaa= *  or Cys or Phe or Ile or Lys or Leu or Met or Asn or Arg or Ser or Thr or Trp or Tyr
  UNSURE 58: Xaa=Gly or Arg
MAXPGVSVRSLVSSYETRVVGMAPGLPRXRGCASSPCSPRGASPIRGTSGPPPHRAWXGPGRPSTRRGMDKTLR

SEQ ID NO: 6429 - protein, 105 aa, Homo sapiens
MSLLRSLRVFLVARTGSYPAGSLLRQSPQPRHTFYAGPRLSASASSKELLMKLRRKTGYSFVNCKKALETCGGDLKQAEIWLHKEAQKEGWSKAAKLQGRKTKEG

SEQ ID NO: 6430 - protein, 120 aa, Homo sapiens
MAAERKTKLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYDT

SEQ ID NO: 6431 - protein, 54 aa, Homo sapiens
MCSVKSRLWKLLSPARLARRAHRSKWLESYLLHLEEMGVSEEMQARALVLQLWA

SEQ ID NO: 6432 - protein, 125 aa, Homo sapiens
MANPGGGAVCNGKLHNHKKQSNGSQSRNCTKNGIVKEAQQNGKPHFYDKLIVESFEEAPLHVMVFTYMGYGIGTLFGYLRDFLRNWGIEKCNAAVERKEQKDFVPLYQDFENFYTRNLYMRIRDN

SEQ ID NO: 6433 - protein, 105 aa, Homo sapiens
MPAERPAGSGGSEAPAMVEQLDTAVITPAMLEEEEQLEAAGLERERKMLEKARMSWDRESTEIRYRRLQHLLEKSNIYSKFLLTKMEQQQLEEQKKKEKLERKKE

SEQ ID NO: 6434 - protein, 102 aa, Homo sapiens
MRSPSPLRVHVGSRAPGRHRHLGRCRCRHRLVSPSPAMAEDLSAATSYTEDDFYCPVCQEVLKTPVRTTACQHVNRSETSTSDNTETYQENTSSSGHPTFKC

SEQ ID NO: 6435 - protein, 89 aa, Homo sapiens
MTSRLRALGGRINNIRTSELPKEKTRSEVICSIHFLDGVVQTFKVTKQDTGQVLLDMVHNHLGVTEKEYFGLQHDDDSVDSPRWLEASK

SEQ ID NO: 6436 - protein, 116 aa, Homo sapiens
  UNSURE 72: Xaa=Ala or Thr
  UNSURE 82: Xaa=Leu or Met or Val
  UNSURE 94: Xaa=Asn or Ser
  UNSURE 96: Xaa=Ile or Asn or Ser or Thr
MLLLDCNPEVDGLKHLLETGASVNAPPDPCKQSPVHLAAGSGLACFLLWQLQTGADLNQQDVLGEAPLHKAXKVGSLECLSXLVASDAQIDLCXKXGQTAEDLAWSCGFPDCAKFL

SEQ ID NO: 6437 - protein, 75 aa, Homo sapiens
  UNSURE 10: Xaa=Gly or Arg
  UNSURE 57: Xaa=Pro or Arg
MAAAGQPQAXAWRSTVDEFLASGFDSESESESENSPQAETREAREAARSPDKPGGSXRPAGVKAVPLSTKTSSLG

SEQ ID NO: 6438 - protein, 53 aa, Homo sapiens
MVIRVFIASSSGFVAIKKKQQDVVRFLEANKIEFEEVDITMSEEQRQWMYKNV

SEQ ID NO: 6439 - protein, 83 aa, Homo sapiens
  UNSURE 2: Xaa=Phe or Tyr
  UNSURE 11: Xaa=Asp or Asn
  UNSURE 35: Xaa=Asn or Thr
  UNSURE 69: Xaa=Lys or Asn
  UNSURE 82: Xaa=Ala or Thr
MXAKAFRVKSXTAIKGSDRRKLRADVTTAFPTLGXDQVSELVPGKEELNIVKLYAHKGDAVTVYVSGGXPILFELEKNLYPXV

SEQ ID NO: 6440 - protein, 92 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIA

SEQ ID NO: 6441 - protein, 65 aa, Homo sapiens [sequence omitted]

SEQ ID NO: 6442 - protein, 68 aa, Homo sapiens
MVSILSSFESRLMKLENSIIPVHKQTENLQRLQENVEKTLSCLDHVISYYHVASDTEKIIREGPQVGW

SEQ ID NO: 6443 - protein, 56 aa, Homo sapiens [sequence omitted]

SEQ ID NO: 6444 - protein, 56 aa, Homo sapiens
MSNKQKLIFLRQDLILMPKLECSGAIIAYCSLDLPGSGDPPTSASQVAGNRCIPHT

SEQ ID NO: 6445 - protein, 91 aa, Homo sapiens
  UNSURE 25: Xaa=Cys or Gly
  UNSURE 55: Xaa=Ala or Gly or Pro or Arg
MTSFRLALIQLQISSIKSDNVTRAXSFIREAATQGAKIVSLPECFNSPYGAKYFXEYAEKIPGESTQKLSEVAKECSIYLIGGSIPEEDAG

SEQ ID NO: 6446 - protein, 77 aa, Homo sapiens
MLNLAFITFELSCLPSTLFTNFFVCLFFGFLFVCLFVFEMEFHSGLGNRARLCLKQTNKQTKGLYIQVKIRSVTESW

SEQ ID NO: 6447 - protein, 99 aa, Homo sapiens
MSGPTDETAGDLPVKDTGLNLFGMGGLQETSTTRTMKSRQAVSRVSREELEDRFLRLHDENILLKQHARKQEDKIKRMATKLIRLVNDKKRYERVGGGP

SEQ ID NO: 6448 - protein, 118 aa, Homo sapiens
MTSELDIFVGNTTLIDEDVYRLWLDGYSVTDAVALRVRSGILEQTGATAAVLQSDTMDHYRTFHMLERLLHAPPKLLHQLIFQIPPSRQALLIERYYAFDEAFVREVLGKKLSKGTKK

SEQ ID NO: 6449 - protein, 52 aa, Homo sapiens
MASIWVGHRGTVRDYPDFSPSVDAEAIQKAIRGIGTDEKMLISILTERSNAQ

SEQ ID NO: 6450 - protein, 61 aa, Homo sapiens
MHDEGVLIHSGKGNTEVIHTGTLQRHESHHIRDFCFQEIEKDIHNFEFQWQEEERNGHEAP

SEQ ID NO: 6451 - protein, 63 aa, Homo sapiens
  UNSURE 6: Xaa=Ser or Thr
  UNSURE 13: Xaa=Phe or Leu
  UNSURE 19: Xaa=Ala or Pro
  UNSURE 25: Xaa=Asp or His
  UNSURE 34: Xaa=Asp or Glu
  UNSURE 35: Xaa=Glu or Gln
  UNSURE 40: Xaa=Met or Arg
MSNRSXFSRLTWXRKQRKXVVSTSXKKMPNGILXXQEQQXVMLLSRSPSGPKKYFPIPVEHLE

SEQ ID NO: 6452 - protein, 106 aa, Homo sapiens
  UNSURE 4: Xaa=Arg or Ser
  UNSURE 10: Xaa=Arg or Ser
MASXGGELGXLFDHHVQRAVCDTRAKYREGRRPRAVKVYTINLESQYLLIQGVPAVGVMKELVERFALYGAIEQYNALDEYPAEDFTEVYLIKFMNLQSARTAKRK

SEQ ID NO: 6453 - protein, 52 aa, Homo sapiens
  UNSURE 20: Xaa=Arg or Ser
  UNSURE 21: Xaa=Asp or Val
MATANFGKIQIGIYVEIKRXXGRIHQAMVTSLNEDNESVTVEWIENGDTKGK

SEQ ID NO: 6454 - protein, 106 aa, Homo sapiens
MTPTERPHGSDICTSWPRPIFGSLHHVPDLSCRGWHTILIVEKVLNSKTIRSNSSGLSIGTDLSVFQSSSPGGGGGGGGGEEEDSQQESETPDPSGGFRGTMEADR

SEQ ID NO: 6455 - protein, 82 aa, Homo sapiens
MDRTCEERPAEDGSDEEDPDSMEAPTRIRNTPEDIVLEAPASGLAFHPARDLLAAGDVDGDVFVFSYSCQEGETKELWSSGN

SEQ ID NO: 6456 - protein, 51 aa, Homo sapiens
METAGQEVRRVSQCRRSWCPALPTFYPPLLPCVHPSSLPTTVGARLNIATS

SEQ ID NO: 6457 - protein, 73 aa, Homo sapiens
  UNSURE 5: Xaa=Leu or Val
  UNSURE 6: Xaa=Glu or Val
  UNSURE 24: Xaa=Leu or Val
MAAAXXAAAAPGSREPQDRPECGXDTRVPDTTDTRRGGSFALKPSSAPYALGPLPQRIRSVRPPARSGPAMSR

SEQ ID NO: 6458 - protein, 63 aa, Homo sapiens [sequence omitted]

SEQ ID NO: 6459 - protein, 59 aa, Homo sapiens
  UNSURE 2: Xaa=Leu or Arg
  UNSURE 59: Xaa=Glu or Gln
MXCRNQLSPVNIHPSYAPSSPSSSNSGSYKGSDCSPIMRRSGRYMSCGENHGVRPPNPX

SEQ ID NO: 6460 - protein, 60 aa, Homo sapiens
MIRHSFLIQEDSSAHCNLCLLGSNDSPASTSQAAGITGTRHHARPIIIILETESRYVVQA

SEQ ID NO: 6461 - protein, 84 aa, Homo sapiens
MEETMSASTGGCILRLVASLQEHFPFVEKLTKRLKRHPEETGGFQEAPLAYDAIWALALALNKTSGGGGRSGVRLEDFNYNNQT

SEQ ID NO: 6462 - protein, 74 aa, Homo sapiens [sequence omitted]

SEQ ID NO: 6463 - protein, 90 aa, Homo sapiens [sequence omitted]

SEQ ID NO: 6464 - protein, 88 aa, Homo sapiens
  UNSURE 34: Xaa=Arg or Trp
MELWAPQRLPQTRGKVSAPSKDPDRGFRRDGHHXPVPHSWHNGERFHQWQDNRGSPQPQQEPRADHQQQPHYASRPGDWHQPVSGVDY

SEQ ID NO: 6465 - protein, 88 aa, Homo sapiens
MSEREERRFVEIPRESVRLMAESTGLELSDEVAALLAEDVCYRLREATQNSSQFMKHTKRRKLTVEDFNRALRWSSVEAVCGYGSQED

SEQ ID NO: 6466 - protein, 97 aa, Homo sapiens
MERLLGGQLGLEDFIFAHVKGIEKEVNVYKSEDSLGLTITDNGVGYAFIKRIKDGGVIDSVKTICVGDHIESINGENIVGWRHYDVAKKLKELKKED

SEQ ID NO: 6467 - protein, 85 aa, Homo sapiens
  UNSURE 57: Xaa=Phe or Tyr
MESLSVAQAAVQCAILACCNLRLPGSSKSASASQVAGITGICHHAQLIFVFLVEMGXHCVGQGGLKLLTSGDTPALASQSAAITG

SEQ ID NO: 6468 - protein, 56 aa, Homo sapiens [sequence omitted]

SEQ ID NO: 6469 - protein, 58 aa, Homo sapiens
MSSGNYQQSEALSKPTFSEEQASALVESVFGLKVSKVRPLPSYDDQNFHVYVSKTKDR

SEQ ID NO: 6470 - protein, 61 aa, Homo sapiens
MKQLRFRDLSHFAPRPTARDLNPALYLPRSHFFLFHQLYLFLCHRSWQPRSDCWSCPLFHP

SEQ ID NO: 6471 - protein, 53 aa, Homo sapiens
MMPLQEFVSVWVRDPRIQKEDFWHSYIDYEICIHTNSMCFTMKTSCVRRRYRE

SEQ ID NO: 6472 - protein, 109 aa, Homo sapiens
  UNSURE 5: Xaa=Asp or His or Tyr
MGSPXIEVDVLGMPLDSCHFRTKPIHRNTLNPMWNEQFLFRVHFEDLVFLRFAVVENNSSAVTAQRIIPLKALKRGYRHLQLRNLHNEVLEISSLFINSRRMEENSSGN

SEQ ID NO: 6473 - protein, 100 aa, Homo sapiens
  UNSURE 11: Xaa=Phe or Val
  UNSURE 14: Xaa=Met or Val
  UNSURE 16: Xaa=Asp or Glu
  UNSURE 25: Xaa=Phe or Tyr
  UNSURE 31: Xaa=Lys or Asn
  UNSURE 34: Xaa=Leu or Arg
  UNSURE 36: Xaa=Ala or Gly
  UNSURE 66: Xaa=Ile or Lys or Met or Asn
MLRFPTCFPSXRVXGXKQLPQEIIXLVWSPXRDXIXLANTAGEVLLHRLASFHRVWSFPPNENTGXEVTCLAWRPDGKLLAFALADTKKIVLCDVEKPES

SEQ ID NO: 6474 - protein, 70 aa, Homo sapiens
  UNSURE 68: Xaa=Cys or Gly or Arg or Ser
MELEPMYSNVNPGDSNPIYSQIWSIQHTKENSANCPMMHQEHEELTVLYSELKKTHPDDSAGEASSRXRA

SEQ ID NO: 6475 - protein, 52 aa, Homo sapiens
  UNSURE 30: Xaa=Cys or Pro or Arg or Ser
MKAEIKMFFETSENKHTTYQNLWDTFKAVXRGKFIAVNAHKRKQERSKIDTL

SEQ ID NO: 6476 - protein, 90 aa, Homo sapiens
MKQEMEKRLQEMEILYKKEKEEADLLLEQQRLDADSDSGDDSDKRSCEESWKLITSLREKLPPSKLQTIVKKCGLPSSGKKREPIKMYQI

SEQ ID NO: 6477 - protein, 59 aa, Homo sapiens
MQQPFNYPYPQIYWVDSSASSPWAPPGTVLPCPTSVPRRPGQRRPPPPPPPPPLPPPPP

SEQ ID NO: 6478 - protein, 54 aa, Homo sapiens
  UNSURE 5: Xaa=Lys or Arg
  UNSURE 53: Xaa=Pro or Arg
MWPKXGLLGLGLPLLPPNHPSVAQGTLVSSHSGSGSEGRVALRSDVHSPKTTXQ

SEQ ID NO: 6479 - protein, 59 aa, Homo sapiens
  UNSURE 2: Xaa=Ser or Tyr
  UNSURE 11: Xaa=Ser or Tyr
  UNSURE 20: Xaa=Phe or Tyr
  UNSURE 29: Xaa=Ser or Tyr
  UNSURE 47: Xaa=Ser or Tyr
  UNSURE 52: Xaa=Asp or Glu
  UNSURE 57: Xaa=Ala or Gly or Val
MXPPPEESPMXPPPEASRLXPPFEESPLXPPPEESPLSPPPEASRLXPPPEXSPMSXPP

SEQ ID NO: 6480 - protein, 74 aa, Homo sapiens
  UNSURE 32: Xaa=Lys or Met or Arg
MLKQWGSREYPHLQTNCLCFPGSKPKPKPAGXTASRQSSQSAVQRKLENVFGGGQCRLDCLHLGKGFYNTVTRT

SEQ ID NO: 6481 - protein, 63 aa, Homo sapiens
MPNDQEEESFAEGHSEASLASALVEGEIAEEAAEKATSRGSNSGMDSNIDLTIVEDEEEESVA

SEQ ID NO: 6482 - protein, 85 aa, Homo sapiens
MRNIAPNISRAEIISLCKRYPGFMRVALSEPQPERRFFRRGWVTFDRSVNIKEICWNLQNIRLRECELSPGVNRDLTRRVRNING

SEQ ID NO: 6483 - protein, 69 aa, Homo sapiens
  UNSURE 11: Xaa=His or Gln
  UNSURE 60: Xaa=Glu or Gln
  UNSURE 64: Xaa=Lys or Asn or Thr
MQPDRASPSRXAFKKEPGTLVYIEKPRSAAGLSSLVDLGPPLMEKQVFAYSTATIPKDRXTSEXMMKTT

SEQ ID NO: 6484 - protein, 55 aa, Homo sapiens
MFPRRPLDTCFSTLQRVGPQQEFRSAHFTVNLLRVLTDHSFSFCLMKRACWPLGV

SEQ ID NO: 6485 - protein, 107 aa, Homo sapiens
  UNSURE 22: Xaa=Arg or Thr
MNFKLTGKGITFFSSESKKYEXPKDDREEEFNTWVNNMYVFFVNTLFHAYKREEAIKEKIRADRLRSTAQAQQRKMEDDELEARLNIFILREEEAKRHDYEVDITVL

SEQ ID NO: 6486 - protein, 132 aa, Homo sapiens
MALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWF

SEQ ID NO: 6487 - protein, 52 aa, Homo sapiens
MQPQASAIPSPGKFRSPAAPSPLALRQPVKAFSNHGSGSPGSQEITQLTQTT

SEQ ID NO: 6488 - protein, 67 aa, Homo sapiens
  UNSURE 43: Xaa=Ala or Gly or Pro or Arg
MLTPSTGRDRYVRTLPSYLVRGIVNWSVSIKRYEIVIFDLLIXLIVVSPWEIFLKSIKILYASRAPQ

SEQ ID NO: 6489 - protein, 65 aa, Homo sapiens
  UNSURE 6: Xaa=Arg or Trp
MFFAPXCGHCQRLQPTWNDLGDKYNSMEDAKVYVAKVDCTAHSDVCSAQGVRGYPTLKLFKPGQK

SEQ ID NO: 6490 - protein, 56 aa, Homo sapiens
  UNSURE 46: Xaa=Asn or Ser or Thr
MEFCSFCPGYSAMVPNSPHCNGANLASLQPLPPGFKRFSCLGLPNXWDYRHAPPHP

SEQ ID NO: 6491 - protein, 56 aa, Homo sapiens [sequence omitted]

SEQ ID NO: 6492 - protein, 59 aa, Homo sapiens
MQKLEMEQVWRASTSLKPPTADLFTGRGLGVLPNGYNPPRNLCWDVLCVDQPVVEDPRS

SEQ ID NO: 6493 - protein, 61 aa, Homo sapiens
MQKNGNHNSLLDHSAVKLELRIKKLTQNRTTTWKLNLFLNDYWVNNEMKGKIKKFFETNDN

SEQ ID NO: 6494 - protein, 56 aa, Homo sapiens
MQLLEIPWYQPKLSMNQKSTLRNVLKFKVYRKHHTLCLRMQKNHKERKLAWHGGSC

SEQ ID NO: 6495 - protein, 61 aa, Homo sapiens
  UNSURE 17: Xaa=Pro or Thr
MVEKQESENSCNKEEEXVFTRQDSNRSEKEATPVVHETEPESGSQPRPAVLSGYFKQFQKS

SEQ ID NO: 6496 - protein, 80 aa, Homo sapiens [sequence omitted]

SEQ ID NO: 6497 - protein, 76 aa, Homo sapiens
  UNSURE 25: Xaa=Glu or Gly
  UNSURE 52: Xaa=Ile or Val
MEWKEWNQHEWNDMDWNGMEWNQPXYRGMEWNAMDWNGVGWNGMEWNGINSXGMEWNGMEWNGINPNRMEWNGMER

SEQ ID NO: 6498 - protein, 61 aa, Homo sapiens
MADLSSFEETSADDFAMEMGLACVVCRQMMVASGNQLVECQECHNLYHRDCHKPQVTDKEA

SEQ ID NO: 6499 - protein, 55 aa, Homo sapiens
MALRDSSPLKKKHLSQDFIHSTELFKLDMGKLKFRERGIKNYFQISGMSNWVDKG

SEQ ID NO: 6500 - protein, 76 aa, Homo sapiens
MGRGPPSARDLCPRGLTPPCATSSSREEAPSDKLVSEVEELNMSITALWEKLLEGEQSLCNLEDIHMSLEKDVTAI

SEQ ID NO: 6501 - protein, 52 aa, Homo sapiens
  UNSURE 32: Xaa=Glu or Gly or Val
  UNSURE 40: Xaa=Lys or Thr
MARGGVSARVLLQAARGTWWNRPGGTSGSGEXVALGTNQXVSSDRLAPGGRG

SEQ ID NO: 6502 - protein, 60 aa, Homo sapiens
MYLVCTTCTWCVFSEMFVHGLNITQLVLSQLDYFFHSNLTNLVLYFLVHLLFSLSLFMPL

SEQ ID NO: 6503 - protein, 57 aa, Homo sapiens
  UNSURE 2: Xaa=Lys or Arg
  UNSURE 27: Xaa=Glu or Lys
  UNSURE 28: Xaa=Ala or Asp
  UNSURE 31: Xaa=Asp or Val
  UNSURE 34: Xaa=Ala or Asp
  UNSURE 36: Xaa=Asp or Val
  UNSURE 38: Xaa=Asp or Val
  UNSURE 39: Xaa=Glu or Lys
  UNSURE 41: Xaa=Asp or Val
  UNSURE 44: Xaa=Ala or Asp
  UNSURE 48: Xaa=Asp or Val
  UNSURE 50: Xaa=Ala or Glu or Gly or Val
MXDKQDEEQRLKEEEEDKKRKEEEEAXXKEXDEXKXEXXEXEEXKEEXEXEDVPARP

SEQ ID NO: 6504 - protein, 69 aa, Homo sapiens
MQRNGMEWNGVEWNGMECKGMESTRVEWHGMECNGMEWNGINSSRKEWNGMERNGMKSTRVEWNGMDWN

SEQ ID NO: 6505 - protein, 51 aa, Homo sapiens
  UNSURE 29: Xaa=Glu or Gln
  UNSURE 39: Xaa=Asp or Glu
  UNSURE 47: Xaa= *  or Leu or Ser or Trp
MSASAVYVLDLKGKVLICRNYRGDVDMSXVEHFMPILMXKEEEGMLXPIPA

SEQ ID NO: 6506 - protein, 76 aa, Homo sapiens
MEWKEWNQHEWNDMDWNGMEWNQPEYRGMEWNAMDWNGVGWNGMEWNGINSIGMEWNGMEWNGINPNRMEWNGMER

SEQ ID NO: 6507 - protein, 141 aa, Homo sapiens
  UNSURE 102: Xaa=Lys or Gln
  UNSURE 125: Xaa=Asp or Glu
  UNSURE 127: Xaa=Ala or Glu
MDETVAEFIKRTILKIPMNELTTILKAWDFLSENQLQTVNFRQRKESVVQHLIHLCEEKRASISDAALLDIIYMQFHQHQKVWDVFQMSKGPGEDVDLFDMXQFKNSFKKILQRALKNVTVSFRXTXENAVWIRIAWGTQY

SEQ ID NO: 6508 - protein, 65 aa, Homo sapiens
MGEEVIPLRVLSKSEWMDLKKEYLALQKASMASLKKTISQIKSESEMETDSGVPQNTGMKNEKTA

SEQ ID NO: 6509 - protein, 61 aa, Homo sapiens
MSGHSPTRGAMQVAMNGKARKEAVQTAAKELLKFVNRSPSPFHAVAECRHRLLQAGFSELK

SEQ ID NO: 6510 - protein, 91 aa, Homo sapiens
MASGQFVNKLQEEVICPICLDILQKPVTIDCGHNFCLKCITQIGETSCGFFKCPLCKTSVRKNAIRFNSLLRNLVEKIQALQASEVQSKRK

SEQ ID NO: 6511 - protein, 60 aa, Homo sapiens
MQWGMWDEEVGKGTGAERCRSIETARRDGERPETQGQRETKDRREEERERQRDRLTDWEE

SEQ ID NO: 6512 - protein, 55 aa, Homo sapiens
MSGEENPASKPTPVQDVQGDGRWMSLHHRFVADSKDKEPEVVFIGDSLVQLMHQC

SEQ ID NO: 6513 - protein, 69 aa, Homo sapiens
MELGEAASILDVWNPFSFVLEWPTILTGKQWSAVKGQLSAAPVVSALPLCVIQVVHIVFLLTSRNKSVS

SEQ ID NO: 6514 - protein, 108 aa, Homo sapiens
  UNSURE 23: Xaa=Cys or Phe
MVLASLELLREQWIRAKYERQEXIYPEKQEPYSAGYREGFLWKRGRDNGQFLSRKFVLTEREGALKYFNRNDAKEPKAVMKIEHLNATFQPAKIGHPHGLQVTYLKDN

SEQ ID NO: 6515 - protein, 63 aa, Homo sapiens [sequence omitted]

SEQ ID NO: 6516 - protein, 57 aa, Homo sapiens
  UNSURE 3: Xaa=Ala or Asp or His or Pro
  UNSURE 39: Xaa=Pro or Ser
  UNSURE 43: Xaa=Phe or Leu or Ser
  UNSURE 44: Xaa=Lys or Thr
MVXAGCFCLTSLHSHFRFCLDMTNVDLELLGPSGQKGCXGMKXXRWKKRKRGRRLGS

SEQ ID NO: 6517 - protein, 73 aa, Homo sapiens
  UNSURE 37: Xaa=Arg or Ser
  UNSURE 44: Xaa=Ile or Val
MSGHGKGGKGLGKGGAKRHRKVLRDNIQGITKPAIRXLARRGGXKRISGLIYEETRGVLKVFLENVIRDAVTT

SEQ ID NO: 6518 - protein, 73 aa, Homo sapiens
  UNSURE 32: Xaa=Leu or Arg
MCYLPDPVVSSLEHRQSRFSIVVLFCFLRQGXILSPRLGCWSAVVQPLPPVFKRFSCLSHLSSGDTGVHTTPG

SEQ ID NO: 6519 - protein, 70 aa, Homo sapiens [sequence omitted]

SEQ ID NO: 6520 - protein, 70 aa, Homo sapiens
MAVSGFTLGTCILLLHISYVANYPNGKVTQSCHGMIPEHGHSPQSVPVHDIYVSQMTFRPGDQIEGTVLG

SEQ ID NO: 6521 - protein, 56 aa, Homo sapiens
  UNSURE 24: Xaa=Asp or Glu or Gly
  UNSURE 26: Xaa=Glu or Gln
  UNSURE 30: Xaa=Asp or Glu
  UNSURE 51: Xaa=Ala or Glu
  UNSURE 55: Xaa=Ala or Pro or Ser or Thr
MMMHSLQRGTFKTQNTRSRLQLRXSXAKLXGLREDEEPPLREEAAAAAAAXAAAXP

SEQ ID NO: 6522 - protein, 78 aa, Homo sapiens
  UNSURE 74: Xaa=Glu or Gly or Gln or Arg
MDFLRLYLPGLHQALRGALDSLGTFVSYLLGDAVPTVEREAQAAEELGVVAVGKTGKIVEEEAQEDLEGLRGSXNEGG

SEQ ID NO: 6523 - protein, 82 aa, Homo sapiens
MIDPDFADKPKLPENYTDETWQKLKEAVEAIQNSTSIKYNLEELYQAVENLCSYKISANLYKQLRQICEDHIKAQIHQFRED

SEQ ID NO: 6524 - protein, 62 aa, Homo sapiens
MEHFLLEVAAAPLRLIAAKNEKSRSELGRFLAKQVRREGRGKAPERLGRPTSKLPALPRRYP

SEQ ID NO: 6525 - protein, 59 aa, Homo sapiens
METLLQNHQLRDHNIRPGESAIVKKKAELIKGNYKCNVCSRTFFSENGLREHMQTHLGP

SEQ ID NO: 6526 - protein, 59 aa, Homo sapiens
MREDLFKQYIEKIAKNLDSEKEKELERQARIEASLREREREVQKARSEQTKEIDRERER

SEQ ID NO: 6527 - protein, 57 aa, Homo sapiens
MAAGFGRCCRVLRSISRFHWRSQHTKANRQREPGLGFSFEFTEQQKEFQATARKFAR

SEQ ID NO: 6528 - protein, 74 aa, Homo sapiens
  UNSURE 12: Xaa=Asp or Glu
  UNSURE 13: Xaa=Ala or Pro
MALQPSWNVRIXXSSLSFNMWKEIPIPFYLSVYFFDVMNPSEILKGEKPQCGSAGPTCTGSSGTKATSPSTTTT

SEQ ID NO: 6529 - protein, 112 aa, Homo sapiens
MQWPRGTGIGGAGRPTRVWEQPRQWMGLSPVDVATALPLQVAPSAVPMDLRLDHQFSLPVAEPALREQQLQQELLALKQKQQIQRQILIAEFQRQHEQLSRQHEAQSTSTSS

SEQ ID NO: 6530 - protein, 116 aa, Homo sapiens
MELATRYQIPKEVADIFNAPSDDEEFVGFRDDVPMETLSSEESCDSFDSLESGKQDVRFHSKYFTEELRRIFIEDTDSETEDFAGFTQSDLNGKTNPEVMVVESDLSDDGKASLVS

SEQ ID NO: 6531 - protein, 72 aa, Homo sapiens
  UNSURE 55: Xaa=Glu or Gly
MPLEMEPKMSKLAFGCQRSSTSDDDSGCALEEYAWVPPGLRPEQIQLYFACLPEXKVPYVNSPGEKHRIKQL

SEQ ID NO: 6532 - protein, 60 aa, Homo sapiens
  UNSURE 49: Xaa=Ile or Lys
MGKDFMSKTPKAMATKDKIDKWDLIKLKSFCTAKETTIRVNRQPTKWEXIFATYSSDKGP

SEQ ID NO: 6533 - protein, 80 aa, Homo sapiens
MHKTGDETELHSSEKGLKVEENIQKQSQQTKLSSDDKTERKSKHRNERKLSVLGKDGKPVSEYIIKTDENVRKENNKKER

SEQ ID NO: 6534 - protein, 92 aa, Homo sapiens
MEAKSQAEEGASGKAEKKTSGETKNQVNGTRANKSDNPRGKNSKAEKSSGEQQQNGDFKDGKNKTDKKDHSNIGNDSKKTDGTKQRSHGSPA

SEQ ID NO: 6535 - protein, 61 aa, Homo sapiens
  UNSURE 15: Xaa=Glu or Lys
  UNSURE 53: Xaa=Ala or Gly
  UNSURE 61: Xaa=Leu or Ser
MAEQRTESTPITAVXQPEKVAATRQEIFQEQLAAVPEFRGLGPLFKSSPEPVXLTESETEX

SEQ ID NO: 6536 - protein, 52 aa, Homo sapiens
  UNSURE 44: Xaa=His or Lys or Asn or Gln
  UNSURE 45: Xaa=Ala or Glu
MKKKRKEKKRKKEGKKERKKERKKERKKERRKEGRKEGRKEGRXXGRKERKR

SEQ ID NO: 6537 - protein, 51 aa, Homo sapiens
  UNSURE 29: Xaa=Pro or Thr
  UNSURE 31: Xaa= *  or Tyr
  UNSURE 36: Xaa=Lys or Asn
  UNSURE 38: Xaa=His or Gln
  UNSURE 46: Xaa=His or Asn
MEVAVSQDCAMPLQPGGQEGDFTSKDRQXGXYVFHXFXFYSLPPPXTHTHT

SEQ ID NO: 6538 - protein, 51 aa, Homo sapiens
MMTGSNLHISIQALNINELNVPIIKHTVVSWIRNQDPLACCLQETSHMQRH

SEQ ID NO: 6539 - protein, 91 aa, Homo sapiens
  UNSURE 39: Xaa=Lys or Arg
  UNSURE 91: Xaa=His or Gln
MEVGSEEEKWEKLDAEFDHFVVDMKPFVLKLPHRTERQXCALWIRKLCEPSGTGAGIMGRKNRNLYAKLLLHMLKRGALEGPFTHRPEPGX

SEQ ID NO: 6540 - protein, 51 aa, Homo sapiens
  UNSURE 18: Xaa=Phe or Tyr
  UNSURE 37: Xaa=Pro or Gln
MDSPWDELALAFSRTSMXPFFDIAHYLVSVMAVKRQXGAAALAWKNPISSW

SEQ ID NO: 6541 - protein, 54 aa, Homo sapiens
MIIHCDFNLHFHDDSDVDQFFTYLLVISMSSFEKCLFRSFAHCIIRLLLLLFCF

SEQ ID NO: 6542 - protein, 51 aa, Homo sapiens
MEWNGINSITFEWNGMELKRIEWNGMEWNGTEWNGMEWNGMEWNGTERNGV

SEQ ID NO: 6543 - protein, 51 aa, Homo sapiens
MVVVMDLVVEVVDMVAEGSKNSRKGLNENPTCLNEECLSYHLKYEGFWPGT

SEQ ID NO: 6544 - protein, 67 aa, Homo sapiens
  UNSURE 5: Xaa=Leu or Met or Val
MLARXVSISCIPLLSSPSSGPSSPADVALSARCLGTYSTLLTGLRPHQPCLELAPPPVITPARLQMS

SEQ ID NO: 6545 - protein, 51 aa, Homo sapiens
MFVILCGHKIPYEKFVFKRLRNWQPFPKWLYILHFHGQWLRVPVLPHPCQH

SEQ ID NO: 6546 - protein, 51 aa, Homo sapiens
MERMESTRVEGHGLECNGMESTRVQGNGMGMECNGMESSVMEWKGMEWNGM

SEQ ID NO: 6547 - protein, 80 aa, Homo sapiens
MDFNEDGFLQGFKGQLIHTYNKNSSVCENCGYFQQLEGKTNVILLGDSIGDLTMADGVPGVQNILKIGFLNDKVEERRET

SEQ ID NO: 6548 - protein, 52 aa, Homo sapiens
  UNSURE 3: Xaa=Lys or Asn
  UNSURE 49: Xaa=Gly or Trp
MTXSLHYDLPIGVFQRLQAAMQAALPLGPYDPVYPMVFEVSVADRDAVXSLW

SEQ ID NO: 6549 - protein, 104 aa, Homo sapiens
  UNSURE 58: Xaa=Ala or Pro or Ser or Thr
  UNSURE 60: Xaa=Ser or Thr
MSPLEPGDPSQAPPNSEEGLREPPGTSRPSLTSGTTPSEMYLPVRFSSESTRSYRRGXRXLKMVPQPGSLCPEGTCRLASLKEMAQGLGVSQQVLCTFARLAPC

SEQ ID NO: 6550 - protein, 85 aa, Homo sapiens
MAWSQLAATSASQVQVILLPQPQLIFFAFLVEMGFHHVSQAGLELLASSDLPVSASQDARLNRCEPPCPAGRGLESHPKYVSPGA

SEQ ID NO: 6551 - protein, 54 aa, Homo sapiens
MSGLITIVVLLGIAFVVYKLFLSDGQYSPPPYSEYPPFSHRYQRFTNSAGPPPP

SEQ ID NO: 6552 - protein, 51 aa, Homo sapiens
MNSHKAITLLKKINMASASEAPAVPPRLNPILPPVPRSNHHPSFLLICPLP

SEQ ID NO: 6553 - protein, 73 aa, Homo sapiens
  UNSURE 63: Xaa=Gly or Val
MGRHHPPLPVSANTMKISQAWSCVLVAPATWEAEVGDGLSLEGRGCNEPGLYHCTPSWETETXLVSNKTKQNH

SEQ ID NO: 6554 - protein, 105 aa, Homo sapiens
  UNSURE 15: Xaa=Ala or Glu or Gly or Val
MEWNGTERNGTERSXMEWNGIVWNGMEWYGIEWNGKNWNGMESNGMEWNGMESTRVQGNVMERNAMEWNHPEWNGMEWNGMQWNGINPSAMEWSGMEWNVNGTTR

SEQ ID NO: 6555 - protein, 53 aa, Homo sapiens
  UNSURE 43: Xaa=Gln or Arg
MSGLFKTAREALTELDAPAPIQMVPTTKERNGSGGDQCGLEMXIITRYGENRH

SEQ ID NO: 6556 - protein, 74 aa, Homo sapiens
  UNSURE 4: Xaa=Asn or Thr
  UNSURE 40: Xaa= *  or Arg
MEWXGKEWNGMEWKGMPSNRMELKGMESTRVEWNAMEWNXMEWNAMIRNRMEWNEMEWNGMEWNGIVPSGIGGR

SEQ ID NO: 6557 - protein, 77 aa, Homo sapiens
MDIYNIFHGHFVLSMSTPNFQHPKDSHVFPESHLQEWLCPDPLPQDPPSHLVGASPREICTQLSCSHMAQMVVNHPL

SEQ ID NO: 6558 - protein, 53 aa, Homo sapiens
  UNSURE 40: Xaa=Cys or Tyr
MEWNGINVSTGECNGTKCNAMESSGMEWNAMEMEWNQPEXNGMEWNGMEWNGP

SEQ ID NO: 6559 - protein, 70 aa, Homo sapiens
MTAGNVPWQATVTPVEKHCVMSVQLPSQKHRACTRWSFGYISLSPSVPVCSLVSVPIGKESFGVPSLPRC

SEQ ID NO: 6560 - protein, 84 aa, Homo sapiens
MIQLLQTSWEDRFRICLSLGRLLHHLAHSPLGSVTLLDFRPRQFVLVDGELKVTDLDDARVEETPCAGSTDCILEFPARNFTLP

SEQ ID NO: 6561 - protein, 70 aa, Homo sapiens
  UNSURE 10: Xaa=Cys or Phe or Ser
MDGWIEVWEXYFLFILFYFISFLFEMESHSVTQAGVQWHNLSSLQAPPPGFTPFSRLSLPSSWDYRRPPP

SEQ ID NO: 6562 - protein, 75 aa, Homo sapiens
  UNSURE 4: Xaa=His or Asn or Tyr
  UNSURE 10: Xaa=Ala or Glu or Val
  UNSURE 12: Xaa=His or Asn or Tyr
MEWXGTTRMXWXVMESKGVEWNQPECSGMEWNGMEWNGLQWNGINPNTMEWNGMEWNAFKPNGMERNGINTSGME

SEQ ID NO: 6563 - protein, 72 aa, Homo sapiens
MTVLSPFYIISTFLKDQLTIKFILIYFWNLSFLFFFPFLSYPFLSFPFFLFFLETWSFSVTQAGMKWCNHRS

SEQ ID NO: 6564 - protein, 59 aa, Homo sapiens [sequence omitted]

SEQ ID NO: 6565 - protein, 64 aa, Homo sapiens
  UNSURE 50: Xaa= *  or Glu or Lys
  UNSURE 63: Xaa= *  or Glu or Gly or Lys or Arg
MEWNGMESTRLQGNGMEWNAMEWIQLEWNGKNGINTSAMDWRGMEWNATXRNGMEWNGMEWNXT

SEQ ID NO: 6566 - protein, 57 aa, Homo sapiens
  UNSURE 32: Xaa=Ser or Thr
MQEISRAWWRAPVVSAAWEAEAGEWREPGRRXCSERRSCHCTPAWVTEPDSISKKKK

SEQ ID NO: 6567 - protein, 60 aa, Homo sapiens
  UNSURE 44: Xaa=Ala or Asp or His or Asn or Pro or Thr
MEWNGTEWSGMEWNQPECRGMEWNGMQCNGIIRNGMGWNGMEWXGMEWNGINASAGEWNG

SEQ ID NO: 6568 - protein, 61 aa, Homo sapiens
  UNSURE 13: Xaa=Ser or Trp
  UNSURE 35: Xaa=Gly or Arg
  UNSURE 38: Xaa=Leu or Trp
  UNSURE 42: Xaa=Ala or Glu or Pro or Gln
  UNSURE 43: Xaa=Leu or Trp
  UNSURE 47: Xaa=Ala or Asp or Glu
  UNSURE 56: Xaa=Arg or Thr
  UNSURE 61: Xaa=Lys or Gln
MEWNGTEWSGMEXNQPECRGMEWNGMQCNGIIRNXMGXNGMXXNGMXMEWNQRECXGMEWX

SEQ ID NO: 6569 - protein, 52 aa, Homo sapiens [sequence omitted]

SEQ ID NO: 6570 - protein, 68 aa, Homo sapiens
  UNSURE 22: Xaa=Ala or Cys or Asp or Phe or Gly or His or Ile or Leu or Asn or Pro or Arg or Ser or Thr or Val or Tyr
  UNSURE 27: Xaa=Glu or Val
  UNSURE 45: Xaa=Leu or Met
  UNSURE 50: Xaa= *  or Phe or Leu or Tyr
  UNSURE 51: Xaa=Phe or Ile or Leu
  UNSURE 55: Xaa= *  or Phe or Ile or Lys or Leu or Met or Asn or Tyr
  UNSURE 56: Xaa=Phe or Leu
MRELAPELFESQPDLLHQLVTXMNPNXLMEHGVPVSLLVSSFSCXFVCLXXSFFXXFETGSCSVAQAG

SEQ ID NO: 6571 - protein, 54 aa, Homo sapiens
MSHCKEFFLTSFSFFLFERESCSVAQDGVQWRDLGSLQPLPPRFKRFSCLSLPS

SEQ ID NO: 6572 - protein, 88 aa, Homo sapiens
MDLTAYAELLKESGNQVLKNGNFSLAIRKYDEAIQILLQLYQWGVPPRDLAVLLCNKSNAFFSLGKWNEAFVAAKECLQWDPTYVKGC

SEQ ID NO: 6573 - protein, 53 aa, Homo sapiens
  UNSURE 46: Xaa=Arg or Ser
  UNSURE 47: Xaa=His or Asn
MEWKEWNQHEWKGMDWNAMEWNQPEYRGMEWNGMQWNGIIRNGMEXXGHGMEW

SEQ ID NO: 6574 - protein, 54 aa, Homo sapiens
MPVIPAFWEAEVGGSPEVRSLRPAWPTWRNPVFTRNAKVGWALWRMPVIPAARE

SEQ ID NO: 6575 - protein, 52 aa, Homo sapiens
MIEDVFSLALTSVDNSCQNYYYKVCQMMIFLIPSSFLHLLTVSYCKEELGRA

SEQ ID NO: 6576 - protein, 59 aa, Homo sapiens
MELNGTERNGMEWNGINPSEVEWNGMEFNGMESSGMEWNGMKWNGMEWNQPECNGMERN

SEQ ID NO: 6577 - protein, 53 aa, Homo sapiens
  UNSURE 45: Xaa=Asp or Glu
MWACWGMLGCFPLFVPWVPVLGKHFSDVSIYVAGHPADCLHLCAXSLWTNYSA

SEQ ID NO: 6578 - protein, 79 aa, Homo sapiens
MCRTSAPAALRHGRSPCRWPCTAPMALLCTMRFSMPWSANAPPGSAASEAAAAAWVPAAACLGLMARPECCQSSACSAL

SEQ ID NO: 6579 - protein, 68 aa, Homo sapiens
  UNSURE 5: Xaa=Ile or Met
  UNSURE 14: Xaa=Ile or Asn
  UNSURE 16: Xaa=Cys or Phe
  UNSURE 17: Xaa=Cys or Phe
  UNSURE 20: Xaa=Phe or Leu
  UNSURE 44: Xaa=Leu or Pro or Gln or Arg
MRSHXYTISYIYYXSXXISXYYYTLSFRVHVHNVQVCYICIHVXCCCVAPINSHLALGISPNAIPPPS

SEQ ID NO: 6580 - protein, 57 aa, Homo sapiens
MESSNGMEWNNPWTRMQSSSNGIEWNHRMDSNGIIIEQNRMESSSDGNERSHHLMEL

SEQ ID NO: 6581 - protein, 53 aa, Homo sapiens [sequence omitted]

SEQ ID NO: 6582 - protein, 75 aa, Homo sapiens
  UNSURE 25: Xaa=Phe or Tyr
  UNSURE 36: Xaa=Lys or Arg
  UNSURE 61: Xaa=Ala or Asp
  UNSURE 73: Xaa=His or Lys or Asn or Gln
MNAKYIFYIQRCASKLYVFFFIFYXFLRWSLTLSPXLEYSGAISAHCKLRLPGSLHSPASXSRVAGTTGMRHXAR

SEQ ID NO: 6583 - protein, 61 aa, Homo sapiens
MLFQEPQPMLASGPLHLFTLLTKMVAEMLHPHIFPSFRPWLRHHMLRQDFSESLLFFFFFF

SEQ ID NO: 6584 - protein, 83 aa, Homo sapiens
  UNSURE 69: Xaa= *  or Leu or Ser
MDISATDLVLRKVINFSDCTVCLDKRNASGKIEFYQDPLLYKCSFRTRLHFTYENLNSKMPSVIKIHTXVESLKLSITDQQLP

SEQ ID NO: 6585 - protein, 61 aa, Homo sapiens
  UNSURE 4: Xaa= *  or Glu or Lys or Gln
  UNSURE 49: Xaa=Ala or Glu or Gly or Val
MQWXWNGMEWNGMELTRIKWNGMEWNGMEWNGMESTRVQGNGMEWNAMXMESSGMEWNGME

SEQ ID NO: 6586 - protein, 52 aa, Homo sapiens
MEWNGMECNGMESTRVQSNGIEWNGMQWNGFNLNGMERMESTRVEWHGLEWN

SEQ ID NO: 6587 - protein, 61 aa, Homo sapiens
  UNSURE 25: Xaa=Asp or Glu
MISGGEVEGRCPGQTGPLCPHTSLXPFAKLVKLRGTGFPVAPLPYSKSPSDFMSLLISTVH

SEQ ID NO: 6588 - protein, 71 aa, Homo sapiens [sequence omitted]

SEQ ID NO: 6589 - protein, 66 aa, Homo sapiens
MPETETHERETELFSPPSDVRGMTKLDRTAFKKTVNIPVLKVRKEIVSKLMRSLKRAALQRPGIRP

SEQ ID NO: 6590 - protein, 70 aa, Homo sapiens
  UNSURE 36: Xaa=His or Gln
  UNSURE 41: Xaa=Cys or Gly or Arg or Ser
  UNSURE 42: Xaa=Asn or Ser or Thr or Tyr
  UNSURE 44: Xaa=Phe or Leu
MDYQPVQLTLSFNSLSFQSFLHIGCNAPNSGSFCLXLDDCXXPXVSIWMIVVTSLMDIECPFFLLLSPPQ

SEQ ID NO: 6591 - protein, 55 aa, Homo sapiens [sequence omitted]

SEQ ID NO: 6592 - protein, 65 aa, Homo sapiens
  UNSURE 14: Xaa=Asp or Val
  UNSURE 15: Xaa=Phe or Leu
  UNSURE 17: Xaa=Asn or Ser
  UNSURE 18: Xaa= *  or Leu
MNQPFYYNMTLFLXXGXXLCLTLIYYYLSYIYVLHGKSLSLFLIHLRLILIKFCLSYKLTYSWAL

SEQ ID NO: 6593 - protein, 53 aa, Homo sapiens
  UNSURE 36: Xaa=Leu or Trp
  UNSURE 52: Xaa= *  or Leu
MAYKFTLPPEQYVSLHFFQIISLSICYFYNFLIFFXFFFNTAYKYKYFFLFXK

SEQ ID NO: 6594 - protein, 80 aa, Homo sapiens
  UNSURE 13: Xaa=Phe or Leu
  UNSURE 67: Xaa=Ile or Lys or Arg or Thr
MCLLLNFLKICPXEIPLMFNLFYLLSYRNGDYAHCTMAQANVGWGLENWRKACLCVVPQVLLALQSXANVPLLLVFFLET

SEQ ID NO: 6595 - protein, 61 aa, Homo sapiens
MEGRVQWLTPVIPALWESKAGGSRGQEFGNSLTSVVKPCLYWKCRNWLGVVARAWSQLLER

SEQ ID NO: 6596 - protein, 56 aa, Homo sapiens
  UNSURE 50: Xaa=Ile or Lys or Met or Asn
  UNSURE 51: Xaa=Phe or Ile or Leu or Val
MESRSVTQAGVQWRAISAHCNLCLPGSGDSPASASRVAGITGVCHRAQLXXVFLVE

SEQ ID NO: 6597 - protein, 53 aa, Homo sapiens
  UNSURE 2: Xaa= *  or Gly
  UNSURE 6: Xaa=Glu or Lys
  UNSURE 14: Xaa=Ala or Asp or Gly or Val
  UNSURE 17: Xaa=Phe or Leu or Val
  UNSURE 27: Xaa=Pro or Gln or Arg
  UNSURE 42: Xaa= *  or Ala or Glu or Gly or Leu or Pro or Gln or Arg or Ser or Val
  UNSURE 47: Xaa=Ala or Pro
MXKVRXKRVLEKAXSVXLDGPQADRSXGLWLQLARVTEMFFXTGTWXHQLLPP

SEQ ID NO: 6598 - protein, 56 aa, Homo sapiens
MYSILSFLNYMHIIYRSCIYIDKCILTYFLFFNAVVKVLVLKFNFHLFVVSIEIQF

SEQ ID NO: 6599 - protein, 51 aa, Homo sapiens
  UNSURE 9: Xaa=Asp or Glu
  UNSURE 10: Xaa=Lys or Met
  UNSURE 11: Xaa=Lys or Asn or Thr
  UNSURE 13: Xaa= *  or Leu
  UNSURE 21: Xaa= *  or His or Lys or Asn or Gln or Tyr
MLLNAFYLXXXVXAFFFFYYXTLSSGIHVKNMQVYYIGIHCHGGLLHPSTC

SEQ ID NO: 6600 - protein, 90 aa, Homo sapiens [sequence omitted]

SEQ ID NO: 6601 - protein, 110 aa, Homo sapiens
  UNSURE 99: Xaa=Cys or Phe or Ser or Tyr
MDQNEHSHWGPHAKGQCASRSELRIILVGKTGTGKSAAGNSILRKQAFESKLGSQTLTKICSKSQGSWGNREIVIIDTPDMFSWKDHCEALYKEVQRCXLLSAPGPHVLL

SEQ ID NO: 6602 - protein, 70 aa, Homo sapiens
  UNSURE 44: Xaa=His or Asn
  UNSURE 47: Xaa=Asp or Glu
  UNSURE 51: Xaa=His or Asn
  UNSURE 53: Xaa=His or Asn
MEWNGMEWNGMEWNAMEWNLPEWNGMEWNGMECNGFNSIAMEWXRMXMEWXGXGVELNRIEWNGMEWKGT

SEQ ID NO: 6603 - protein, 99 aa, Homo sapiens
  UNSURE 26: Xaa=Arg or Ser
  UNSURE 27: Xaa= *  or Glu or Lys or Leu or Met or Val
  UNSURE 63: Xaa= *  or Glu or Lys or Gln
  UNSURE 72: Xaa=Phe or Leu
  UNSURE 73: Xaa= *  or Glu or Lys or Gln
  UNSURE 78: Xaa= *  or Cys or Trp or Tyr
  UNSURE 80: Xaa=Ile or Asn or Ser
MAVWSWLPRRQVPGSPLPQCEELRKXXERRTPPAISVIPAAAFYTAYFLHKQKMNENKDTDSXKSEEYEDDXXKDLEXLXNENEKSDASIIEMACEKEG

SEQ ID NO: 6604 - protein, 57 aa, Homo sapiens
  UNSURE 52: Xaa=His or Gln
MNPHVHHPVSIIKNTLSSLHYLLHSYFPPPLDYFKANQRPHLSSENPFSTSXFLCPT

SEQ ID NO: 6605 - protein, 57 aa, Homo sapiens
  UNSURE 30: Xaa=Asp or Glu
  UNSURE 37: Xaa=Glu or Gly
  UNSURE 38: Xaa=Pro or Thr
  UNSURE 41: Xaa=Glu or Lys
MESSNGMEWNNPWTRMQSSSNGIEWNHRMXSNGIIIXXESXWNHHRMENERSHHLME

SEQ ID NO: 6606 - protein, 65 aa, Homo sapiens
  UNSURE 16: Xaa=Glu or Lys
MAEEASGNLQSWRKVXGKADTFFTRHQEREKDQEKLPFIKLSDLMRIYSLSQEQHRGNRSHDPAT

SEQ ID NO: 6607 - protein, 56 aa, Homo sapiens
MSQEGVELEKSVRRLREKFHGKVSSKKAGALMRKFGSDHTGVGRSIVYGVKQKDGH

SEQ ID NO: 6608 - protein, 59 aa, Homo sapiens
  UNSURE 42: Xaa= *  or Trp
MGMRKVQSRGYPEYTPVDVARVSEPHTGQRGADMGASSTPQXPSPAPRLGWTHTNPLPT

SEQ ID NO: 6609 - protein, 60 aa, Homo sapiens
  UNSURE 40: Xaa= *  or Leu or Ser
MFSYLFICLFIYFEMEARSIARLECSGALGSLQPSRLPGXNDSSASASRVAGNIGAHHHA

SEQ ID NO: 6610 - protein, 83 aa, Homo sapiens
  UNSURE 75: Xaa=Ala or Gly
MTRMMTLTSLACLVGEGEEGKKEREESSKARRKGGQPPKKPSLKTSIPLLSLLEMLVPRTVPQVLGPPESCQSQXLRAFLWLP

SEQ ID NO: 6611 - protein, 64 aa, Homo sapiens
MGSHSVTQADMQLHDLGSLQPLLPRFKQFSRLSLPRSWDIGVHHHTWLIFVFLVEMGFHHIAPA

SEQ ID NO: 6612 - protein, 60 aa, Homo sapiens
  UNSURE 37: Xaa=Lys or Arg
MEWKGLEWSGMEWNGMEWNQLDWNGMEWNGMEIKPNXMEWNGMERNGNGMEWNGMEWNGK

SEQ ID NO: 6613 - protein, 78 aa, Homo sapiens
MPPCPAKLFNFKILDSFVITFSLKHKQGPSWWLTPVIPALWKAEAGGSPEVKSSRPAWPTWRNPISTKNTKIRHGGMR

SEQ ID NO: 6614 - protein, 60 aa, Homo sapiens
  UNSURE 41: Xaa=Lys or Met
MEWNGTEWSGMEWNQPECRGMEWNGMQCNGIIRNGMGWNGXEWNGMEWNGINASAGEWNG

SEQ ID NO: 6615 - protein, 61 aa, Homo sapiens
MFLSSFFFIILFYYYYTLSFRVHVHNVQVSYICIQCHAGVLHPLPRHLALGISPNAIPPPT

SEQ ID NO: 6616 - protein, 74 aa, Homo sapiens [sequence omitted]

SEQ ID NO: 6617 - protein, 55 aa, Homo sapiens
  UNSURE 9: Xaa= *  or Pro or Arg or Ser or Thr
  UNSURE 23: Xaa=Ala or Asp or Glu or Gly or Val
MALCSLDLXGSGDALTLASQSTXFTDVSYCARPQIDFSNEEYLSIFWDSVPHIFT

SEQ ID NO: 6618 - protein, 53 aa, Homo sapiens
MDRYGKTSNGMELTRMEWTGMERTRMEWTGMEWIERNGLERNGLEWKGNEWNG

SEQ ID NO: 6619 - protein, 71 aa, Homo sapiens
  UNSURE 24: Xaa= *  or Glu
  UNSURE 30: Xaa=Phe or Ser
  UNSURE 36: Xaa=Ala or Val
  UNSURE 38: Xaa=Leu or Gln
  UNSURE 49: Xaa=Leu or Arg
  UNSURE 65: Xaa=Asp or His
MYREVARLLQKTPACLSFFSFFFXFIIFFXFYRDGXLXCLPGWPRTPGXKHSSHLSLPKCWDYRXEPPYPT

SEQ ID NO: 6620 - protein, 74 aa, Homo sapiens
MEWNAMEWNLPEWNGMEWNGMECNGFNCIAMEWNRMEWNGMEWNGMELNRIECNGMEWNGKERNGTERCGMEWE

SEQ ID NO: 6621 - protein, 54 aa, Homo sapiens [sequence omitted]

SEQ ID NO: 6622 - protein, 53 aa, Homo sapiens; identical to SEQ ID NO: 6618

SEQ ID NO: 6623 - protein, 61 aa, Homo sapiens
  UNSURE 10: Xaa=Ile or Leu
  UNSURE 26: Xaa=Ala or Glu or Val
  UNSURE 28: Xaa= *  or Ser or Tyr
  UNSURE 30: Xaa=Phe or Leu
  UNSURE 31: Xaa=Ile or Leu
  UNSURE 33: Xaa=Lys or Gln
  UNSURE 34: Xaa=Cys or Phe or Ile or Ser
  UNSURE 46: Xaa=Lys or Pro or Gln or Thr
  UNSURE 50: Xaa=Glu or Val
  UNSURE 55: Xaa= *  or Lys
MLVHCHPSAXCQDVHSILPTSLWIPXFXAXXRXXSDLYLSNVSLSXDFEXALALXPQFSVE

SEQ ID NO: 6624 - protein, 54 aa, Homo sapiens; identical to SEQ ID NO: 6571

SEQ ID NO: 6625 - protein, 56 aa, Homo sapiens
  UNSURE 12: Xaa=Phe or Tyr
  UNSURE 22: Xaa=Ala or Glu
  UNSURE 24: Xaa=Leu or Pro or Arg
  UNSURE 52: Xaa=Leu or Gln
MEPRTRAEARCXQAGEIGASPXAXCCSESGDERKNLEEKSDINVTVLIGSKXVSEG

SEQ ID NO: 6626 - protein, 83 aa, Homo sapiens
MAVPAALILRESPSMKKAVSLINAIDTGRFPRLLTRILQKLHLKAESSFSEEEEEKLQAAFSLEKQDLHLVLETISFILEQAV

SEQ ID NO: 6627 - protein, 77 aa, Homo sapiens
MVPDTESYDAVEIIRKVAVPPRLSEHTQRYEAANRTVQMAENFVNDPENEINRWFREFEHGPVSEAKSNRRVYAKGE

SEQ ID NO: 6628 - protein, 63 aa, Homo sapiens
MQVLTKRYPKNCLLTVMDRYAAEVHNMEQVVMIPSLLRDVQLSGPGGQAQAEAPDLYTYFTML

SEQ ID NO: 6629 - protein, 70 aa, Homo sapiens
MPGRGRCPDCGSTELVEDSHYSQSQLVCSDCGCVVTEGVLTTTFSDEGNLREVTYSRSTGENEQVSRSQR

SEQ ID NO: 6630 - protein, 55 aa, Homo sapiens
MESLHGDDLIVTPFAQVLASLRTVRNNFAALTNLQDRAPSKRSPMCTNHPSTKPR

SEQ ID NO: 6631 - protein, 54 aa, Homo sapiens
  UNSURE 35: Xaa=Asp or Gly
MVAPAVQEKKVKKRVSFADNQGLALTMVKVFSEFXDPLDMPFNITELLDNIVSL

SEQ ID NO: 6632 - protein, 67 aa, Homo sapiens
  UNSURE 28: Xaa=Glu or Lys
  UNSURE 29: Xaa=Ala or Thr
  UNSURE 30: Xaa= *  or Lys
  UNSURE 32: Xaa=Gly or Ser
MNETDLNHLLPPVSRLFELLWPHNTGRXXXSXKGTYSVCSMGWLTRIVCLFWEYYLQQEQTIRMGRT

SEQ ID NO: 6633 - protein, 61 aa, Homo sapiens
MAHSHHRQWKLTVSGSPAGAVNHPSPCEHVASPDFLHMAGFLQSKHPERARQKLPSLTSPR

SEQ ID NO: 6634 - protein, 54 aa, Homo sapiens
  UNSURE 7: Xaa=His or Gln
  UNSURE 8: Xaa=Leu or Met or Val
MHQHNIXXAKEPVQNEISATYIRRALGQGQSVKYLIPDAVITYIKDHGLYTKGR

SEQ ID NO: 6635 - protein, 69 aa, Homo sapiens
  UNSURE 41: Xaa=Lys or Asn or Thr
MDVLAEEFGNLTPEQLAAPIPTVEEKWRLLPAFLKVKGLVXQHIDSFNYFINVEIKKIMKANEKVTSDA

SEQ ID NO: 6636 - protein, 53 aa, Homo sapiens [sequence omitted]

SEQ ID NO: 6637 - protein, 56 aa, Homo sapiens
  UNSURE 28: Xaa= *  or Leu or Ser or Trp
MPLMYQTEGEPLNPVKQFHKIFTKCLYXRNHVDFSPADVCTVSTLVYQYLTGSNDG

SEQ ID NO: 6638 - protein, 52 aa, Homo sapiens
MASYSGFSGLLEIRYGPGHRSCLPQFAFFPQPPLPRPRICMWKYLDVHSMHQ

SEQ ID NO: 6639 - protein, 61 aa, Homo sapiens [sequence omitted]

SEQ ID NO: 6640 - protein, 79 aa, Homo sapiens
MAATEQDKTPLQQKLDEFGEQLSKVISLICVAVWLINIGHFNDPVHGGSWFRGAIYYFKIAVALAVAAIPEVFLQSSPH

SEQ ID NO: 6641 - protein, 65 aa, Homo sapiens [sequence omitted]

SEQ ID NO: 6642 - protein, 57 aa, Homo sapiens
  UNSURE 48: Xaa=His or Gln
MDEESLDGLLFKDHDFSSDLLRQLNSLRQSRILTDVSICAGAREIPCXRNVLASSSP

SEQ ID NO: 6643 - protein, 59 aa, Homo sapiens
MAPKKKIVKKNKGDINEMTIIVEDSPLNKLNALNGLLEGGNGLSCISSELQMLLMAPTS

SEQ ID NO: 6644 - protein, 58 aa, Homo sapiens
MQYLIFCSCANLLRIMASRGIHVSAKGLISFFFMAVKYSMVYMYHIFFIQSSISEHPR

SEQ ID NO: 6645 - protein, 57 aa, Homo sapiens [sequence omitted]

SEQ ID NO: 6646 - protein, 56 aa, Homo sapiens
MKSPAITATLEGKNRTLYLQSVTSIEERTRPNLSKTLKELGLVDGQELAVADVTTP

SEQ ID NO: 6647 - protein, 56 aa, Homo sapiens
MATDSAIDILGFTNEEKVSIYKLTGAVMHYGNLKFKQKQREEQAEPDGTEVADKAA

SEQ ID NO: 6648 - protein, 53 aa, Homo sapiens [sequence omitted]

SEQ ID NO: 6649 - protein, 79 aa, Homo sapiens
MECADAAHGLKGHIISDGGCSCPGDVAKAFGAGADFVMLGGMLAGHSESGGELIERDGKKYKLFYGMSSEMAMKKYAGS

SEQ ID NO: 6650 - protein, 79 aa, Homo sapiens
  UNSURE 58: Xaa=Lys or Arg
MPVTGIHSVQPSFSKPNCTIITLPRNKNFQGLYSPKFCSSEHLLIHIYHTKFSSLKKXKKRPVAWLPSVIPALSEAKLG

SEQ ID NO: 6651 - protein, 54 aa, Homo sapiens [sequence omitted]

SEQ ID NO: 6652 - protein, 52 aa, Homo sapiens
MSLRKCGYTLLTAPRAVARVSSRTKVAVGPSTCLECKSHMMLSTVQSNTPCN

SEQ ID NO: 6653 - protein, 103 aa, Homo sapiens
MEGPRAACLLKEARERQAREPQGSGERNGRALGLWLECEQIVSPCLSVSPGGDPNRNNAPGNPAVQGRNGRPAKCVLVPILVVMVWGGYETATAREAWTDGHA

SEQ ID NO: 6654 - protein, 64 aa, Homo sapiens
METEETHLEETTESQQNGEEGTSTPEDKESGQEGVDSMAEEGTSDSNTGSESNSATVEEPPTDP

SEQ ID NO: 6655 - protein, 96 aa, Homo sapiens
  UNSURE 72: Xaa=Glu or Gly
  UNSURE 75: Xaa=Leu or Met
MEPPQETNRPFSTLDNRSGQVQVLSATPLLQRNPYSSPDIMHIKGSEASSVPYALNQGTTALPKNKNQEGTXHRXLNMLRKTLKESDSEELEITQE

SEQ ID NO: 6656 - protein, 87 aa, Homo sapiens
MEFEIEPDKECKSLSPGKENVSALDMEKESEEKEEKESEPQPEPVAQPQPQSQPQLQLQSQSQPVLQSQPPSQPEDLSLAVLQPTPP

SEQ ID NO: 6657 - protein, 66 aa, Homo sapiens
MLLHCKRDELRKLWIEGIEHKHVLNLLDEIENIKQVPQKLEQCMASKHYLSATDMLVSAVESLVGP

SEQ ID NO: 6658 - protein, 51 aa, Homo sapiens [sequence omitted]

SEQ ID NO: 6659 - protein, 85 aa, Homo sapiens
MGKTAERRHCIDRYAINYQFRIFIGLGFFNEGWKKAGNSRHQARTVCVGSCCFVISCSSPWRLTWSQPWCCVQPGLAPTEHTNSH

SEQ ID NO: 6660 - protein, 94 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSP

SEQ ID NO: 6661 - protein, 68 aa, Homo sapiens
  UNSURE 39: Xaa=Gly or Arg
  UNSURE 44: Xaa=Lys or Arg
  UNSURE 46: Xaa=Phe or Ile
  UNSURE 50: Xaa=Lys or Arg
  UNSURE 51: Xaa=Asn or Thr
  UNSURE 56: Xaa=Phe or Ile
  UNSURE 57: Xaa=Lys or Thr
MAILPKVIYRFNAIPIKLPMSFFTELEKTTLKFIWNQKXARIAXSXLSQXXKAGGXXLPDFKLYYKAP

SEQ ID NO: 6662 - protein, 83 aa, Homo sapiens
  UNSURE 60: Xaa=His or Gln or Arg
MPACNTHGEGHFLAPPAKYLQTLGRRLHSQHRTSLNSFRISDHHHVQVSECRPTTRDGFXPPALLQIHAAQQARAWREQLLST

SEQ ID NO: 6663 - protein, 77 aa, Homo sapiens [sequence omitted]

SEQ ID NO: 6664 - protein, 58 aa, Homo sapiens
  UNSURE 39: Xaa=Ala or Ser
  UNSURE 44: Xaa=Asp or Glu
  UNSURE 46: Xaa=Lys or Met or Arg or Thr
  UNSURE 47: Xaa=Lys or Asn
  UNSURE 56: Xaa=Ile or Ser
MPYIDESPTMSPQLSARSQGGGDGVSPTPPEGLAPGVEXGKGLXMXXLVLSGFLAXED

SEQ ID NO: 6665 - protein, 65 aa, Homo sapiens
  UNSURE 30: Xaa=Ala or Thr
MGPTGLKSRFGFVLFCFVLSEMESRSVAQXAVRWHNLGSLQALPPGFTPFSCLNLLSSWDYRHPP

SEQ ID NO: 6666 - protein, 52 aa, Homo sapiens
  UNSURE 12: Xaa= *  or Glu or Gly or Lys or Arg or Trp
  UNSURE 17: Xaa=His or Leu or Pro or Gln or Arg
  UNSURE 23: Xaa=Gly or Trp
  UNSURE 29: Xaa=Ala or Ser
  UNSURE 49: Xaa=Gly or Val
MRALQQKALWSXEDRKXMCIEVXISASCXEQCEHNDLFLLVRQVDFYLXQHN

SEQ ID NO: 6667 - protein, 60 aa, Homo sapiens [sequence omitted]

SEQ ID NO: 6668 - protein, 55 aa, Homo sapiens [sequence omitted]

SEQ ID NO: 6669 - protein, 65 aa, Homo sapiens
  UNSURE 7: Xaa=Gly or Val
  UNSURE 21: Xaa=Leu or Trp
MAEEVVXVAKFDYVAQQEQEXDIKKNERLWLLDDSKSWWRVRNSMNKTGFVPSNYVERKNSARKA

SEQ ID NO: 6670 - protein, 77 aa, Homo sapiens
MPMVACSIYQVQNIHGAFNALGGADRLTSNPNQWEGGPSPVQTQTLTEKEEGLSRGTADARTQWIPAITIIVALITA

SEQ ID NO: 6671 - protein, 133 aa, Homo sapiens
  UNSURE 4: Xaa=Asp or Glu
  UNSURE 6: Xaa=Glu or Lys
  UNSURE 19: Xaa=Asn or Thr
  UNSURE 63: Xaa=Asp or His
  UNSURE 124: Xaa=Leu or Arg
  UNSURE 127: Xaa=Cys or Phe or Ser or Tyr
MAAXSXPESEVFEITDFTXASEWERFISKVEEVLNDWKLIGNSLGKPLEKGIFTSGTWEEKSXEISFADFKFSVTHHYLVQESTDKEGKDELLEDVVPQSMQDLLGMNNDFPPRAHCLVRWYGXREXVVIAPA

SEQ ID NO: 6672 - protein, 109 aa, Homo sapiens
MSGLYSPVSEDSTVPQFEAPSPSHSSIIDSTEYSQPPGFSGSSQTKKQPWYNSTLASRRKRLTAHFEDLEQCYFSTRMSRISDDSRTANQLDEFQECLSKFTRYNSVRP

SEQ ID NO: 6673 - protein, 72 aa, Homo sapiens
MGSLQDRVIALETSTQVALDHLESVPEKLSLLEDFKDFRDSCSSSERTDGRYSKYRVRRNSLQHHQDDTKYR

SEQ ID NO: 6674 - protein, 55 aa, Homo sapiens
MDEGVVKESGNDTIDEEELILPNRNLRDKVEENSVRSPRKSPRLMAQEQVRSLRQ

SEQ ID NO: 6675 - protein, 89 aa, Homo sapiens
MGEETIGKKLPATTATPDSSKTEMDSRTKSKDYCKVIFPYEAQNDDELTIKEGDIVTLINKDCIDVGWWEGELNGRRGVFPDNFVKLLP

SEQ ID NO: 6676 - protein, 74 aa, Homo sapiens
MRKNEFGLRRLIPYWKTGIVDIYRAGLRTRWELEDVREGDPDFSKEGSKWLLRSWVQIFMGLSVTLMMSHLRQE

SEQ ID NO: 6677 - protein, 60 aa, Homo sapiens
MHGWKGTWMVAAWIDDYYVSPNSMSVHFPKPHQGVKSHAPGECFQLKNSVIQHHISFCPA

SEQ ID NO: 6678 - protein, 74 aa, Homo sapiens [sequence omitted]

SEQ ID NO: 6679 - protein, 55 aa, Homo sapiens
  UNSURE 10: Xaa= *  or Lys
MLCFVSAKNXTRYHLMASWFKSVFLLRRERLPLEYSAFNKLPNQLSSAKRSPSLA

SEQ ID NO: 6680 - protein, 62 aa, Homo sapiens
  UNSURE 52: Xaa=Gly or Arg
MELKSPEEEVVAALPEGMRPDSNLYGFPWELVICAAVVGFFAVLFFLWRSFXSVRSRLYVGR

SEQ ID NO: 6681 - protein, 105 aa, Homo sapiens
MKAQKSGKEQQLDIMNKQYQQLESRLDEILSRIAKETEEIKDLEEQLTEGQIAANEALKKDLEGVISGLQEYLGTIKGQATQAQNECRKLRDEKETLLQRLTEVE

SEQ ID NO: 6682 - protein, 63 aa, Homo sapiens
  UNSURE 2: Xaa=Phe or Leu or Ser
  UNSURE 25: Xaa=Ala or Ser
  UNSURE 33: Xaa= *  or Phe or Leu or Tyr
MXARELRPTLPRPSELVCLCSSWKXSLWICKYXNSQKLKERVGVGAGVVCCRPSVFIQAFSSP

SEQ ID NO: 6683 - protein, 80 aa, Homo sapiens
  UNSURE 33: Xaa=Pro or Arg
  UNSURE 57: Xaa=Glu or Gln
MCPCSRTFSSRGHFLSNLQPTRPPVRSTQGHFXNDQPPAEADGLRQMAGVTHSLGRXLPWLPRSDQASLTCDQQKRLISS

SEQ ID NO: 6684 - protein, 82 aa, Homo sapiens
MLPKLVSNLGATGVDSAGLGERLSPSLCVTGAFTKHCLVGSSLPPQVPFRGPSHKTPGSRISALEHQAKEFRFVFFCCSFLF

SEQ ID NO: 6685 - protein, 83 aa, Homo sapiens
  UNSURE 14: Xaa=Leu or Gln
  UNSURE 69: Xaa=Asp or Glu
MTVDSSMSSGYCSXDEELEDCFFTAKTTFFRNAQSKHLSKNVCKPVEETQRPPTLQEIKQKIDSYNTRXKNCLGMKLSEDGTI

SEQ ID NO: 6686 - protein, 80 aa, Homo sapiens
  UNSURE 31: Xaa=Cys or Phe or Gly or Leu or Val or Trp
  UNSURE 32: Xaa= *  or Lys
  UNSURE 78: Xaa= *  or Leu
MFLKEEVLLNFVSQSMMQNRHLVDIEFYNFXXLYFKFWYTCAERAGLLHRYTCAIVVCCTPSNRLLHWVFLLMLSLPXPP

SEQ ID NO: 6687 - protein, 54 aa, Homo sapiens
MLSNFAIKGRLHSFFFFSETESRSVTLAEEQWHNLGSLRLLPSRFKRFSCLSLL

SEQ ID NO: 6688 - protein, 70 aa, Homo sapiens
MIISIDAEKTFDKIQQPFMLKTLNKLGIDGTYFKIIRAIYDKPTANIILNVQKLEAFPLKTGTRQGCPLS

SEQ ID NO: 6689 - protein, 129 aa, Homo sapiens
  UNSURE 73: Xaa=Asp or His
MLQQVPENINFPAEEEKILEFWTEFNCFQECLKQSKHKPKFTFYDGPPFATGLPHYGHILAGTIKDIVTRYAXQSGFHVDRRFGWDCHGLPVEYEIDKTLGIRGPEDVAKMGITEYNNQCRAIVMRYSA

SEQ ID NO: 6690 - protein, 83 aa, Homo sapiens
MLALRDLGMGKREGEELIQAEARCLVETFQGTEGRPFDPSLLLAQATSNVVCSLLFGLRFSYEDKEFQAVVRAAGGTCWESAP

SEQ ID NO: 6691 - protein, 61 aa, Homo sapiens
MFVCLSGAQQPGPPYYTDPGGPGMNPVGNSMALAFQVPPNSPQGSVACPPPPAYCNTPPPP

SEQ ID NO: 6692 - protein, 59 aa, Homo sapiens
  UNSURE 3: Xaa=Glu or Gly
  UNSURE 4: Xaa=Ile or Lys
  UNSURE 50: Xaa=Asn or Ser
MKXXILRAAREKGRVTHKRKHIRITGDLLAEILQARREWGPIFKILKEKXFQPRILYPA

SEQ ID NO: 6693 - protein, 70 aa, Homo sapiens
METWFIKFPFPPHPLSFHGQFTEFLSNPNLSKNSFPTSATRILFPPSLYGGLDDSFTQSLFFSPNILISS

SEQ ID NO: 6694 - protein, 54 aa, Homo sapiens
MFQVNPQNNSLTEYHPHLTDKDSGAQGTGSVSMHTQVDRCPVSFYSVQLSPPHP

SEQ ID NO: 6695 - protein, 51 aa, Homo sapiens
  UNSURE 41: Xaa=Leu or Trp
  UNSURE 43: Xaa=Glu or Lys
MDAEHREVLPESLPVLHNQREFSMADFLLETTVSDFGQSHXTXEKVISDCE

SEQ ID NO: 6696 - protein, 67 aa, Homo sapiens
  UNSURE 11: Xaa=Glu or Gly
  UNSURE 31: Xaa=Ala or Thr
  UNSURE 44: Xaa=Cys or Gly
MMLRGGGTFKXCLSHEGSSFTKGLAQECVSXSCGTRLITAVASXYKARLPLAACPLLLPIFSHARSS

SEQ ID NO: 6697 - protein, 100 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQET

SEQ ID NO: 6698 - protein, 72 aa, Homo sapiens
MNYVGQLAGQVIVTVKELYKGINQATLSGCIDVIVVQQQDGSYQCSPFHVRFGKLGVLRSKEKVIDIEINGS

SEQ ID NO: 6699 - protein, 60 aa, Homo sapiens
MSATRAKKVKMATKSCPECDQQVPVACKSCPCGYIFISRKLLNAKHSEKSPPSTENKHEC

SEQ ID NO: 6700 - protein, 54 aa, Homo sapiens
MPDLPLLSQAFSAWEPDPEPQPWVTDRRIQVNVPQALLSDRSHSLLSPGGSLAH

SEQ ID NO: 6701 - protein, 60 aa, Homo sapiens
  UNSURE 14: Xaa=Cys or Gly or Arg
MRSPPCGLLRWFGXPLLASWCRCHLRFRAFGTSAGWYRAFPAPPPLLPPACPSPRDYRPH

SEQ ID NO: 6702 - protein, 90 aa, Homo sapiens
  UNSURE 23: Xaa=Arg or Thr
  UNSURE 38: Xaa=His or Gln or Arg
  UNSURE 39: Xaa=Ala or Ser
  UNSURE 49: Xaa=Cys or Ser
  UNSURE 52: Xaa=Ala or Gly
  UNSURE 62: Xaa=Pro or Arg
  UNSURE 80: Xaa=Glu or Gln
MSMYQSYGSPSQYGMAGSYGSAXPQQPSAPQHQGTLNXXPVPGMDESMXYQXPPQQLPSAQXPQPSNPPHGAHTLNSGPXPGTAPATQHS

SEQ ID NO: 6703 - protein, 71 aa, Homo sapiens [sequence omitted]

SEQ ID NO: 6704 - protein, 63 aa, Homo sapiens
  UNSURE 55: Xaa=Gly or Arg
MDLPCMPRIPGDEHVPQERPNSTLFSRVIRIVPVRGPSITEKFSSGSPLLARDGXLTEGEADR

SEQ ID NO: 6705 - protein, 56 aa, Homo sapiens
MGPSSFSKTSSGLPLILRYGELYNYFIIYCNVIIIQITCTINIMHLNHPETTLRPP

SEQ ID NO: 6706 - protein, 63 aa, Homo sapiens
MNDSTREEGSLGGHHLPSTTGQSPGSYTPATGSSCGLWLQSSSPQSLKPTLAQTPVPQPQPQA

SEQ ID NO: 6707 - protein, 57 aa, Homo sapiens
MKDKAGQKCKPIDVFDFPDNSDVSSIGRLGENEKDEETYETFDPPLHSTAIYADEEE

SEQ ID NO: 6708 - protein, 59 aa, Homo sapiens
MCGTSGPATDSHGAGTCASARSCPSCRSNQRTWLCTVAGPCATSLDHTPAKGKPGVKQQ

SEQ ID NO: 6709 - protein, 117 aa, Homo sapiens
MEGGGGRDEPSACRAGDVNMDDPKKEDILLLADEKFDFDLSLSSSSANEDDEVFFGPFGHKERCIAASLELNNPVPEQPPLPTSESPFAWSPLAGEKFVEVYKEAHLLALHIESSSR

SEQ ID NO: 6710 - protein, 55 aa, Homo sapiens [sequence omitted]

SEQ ID NO: 6711 - protein, 60 aa, Homo sapiens
  UNSURE 59: Xaa=Ser or Thr
MRLPDPFTPNLKVDMLSEINIAPRILTNFTGVMPPQFKKDLDSYLKTRSPVTFLSDLRXQ

SEQ ID NO: 6712 - protein, 54 aa, Homo sapiens
MEEHSMLMGRKRINIVKMAILPKVIYRFNAIPIKLPMTFFTELEKTTLKFIWNL

SEQ ID NO: 6713 - protein, 60 aa, Homo sapiens
MAVVSEDDFQHSSNSTYRTTSSSLRADQEALLEKLLDRPPPGLQRPEDRFCGTYIIFFSL

SEQ ID NO: 6714 - protein, 80 aa, Homo sapiens
  UNSURE 9: Xaa=Ala or Asp or Glu
  UNSURE 12: Xaa=Glu or Val
  UNSURE 17: Xaa=Ser or Thr
  UNSURE 34: Xaa=Ala or Phe or Ser or Val
  UNSURE 46: Xaa=Asp or Glu
  UNSURE 57: Xaa= *  or Lys or Arg or Trp
  UNSURE 68: Xaa=Gly or Ile or Met or Arg or Ser or Val
MLAMCSHTXRAXMMAKXSLPKPRWAESGDPWLPXVCEVNYTPLHGXETRFLWLIILXLNVGNSPTLIXSFVDYLMLYNTA

SEQ ID NO: 6715 - protein, 61 aa, Homo sapiens
MTHLLDFPHSTHVKSCFQNMEICKRRVNMYDTVNQSKTPFITHVAPSTSTNLTMTFNNQLT

SEQ ID NO: 6716 - protein, 51 aa, Homo sapiens
MAGTPPPTKQVISAFPTEVPGSSHWDWLDSGCSPWRASRSRVECCLSREAQ

SEQ ID NO: 6717 - protein, 119 aa, Homo sapiens
MAPISLSWLLRLATFCHLTVLLAGQHHGVTKCNITCSKMTSKIPVALLIHYQQNQASCGKRAIILETRQHRLFCADPKSNGSRTRCSIWTASCCPNSKWRHLREADRRGEARTTPAAGG

SEQ ID NO: 6718 - protein, 96 aa, Homo sapiens
MLYSMLQGLDTVPVPCGIGPKMDGMTEWGNVKPSVIKQTSAFVEGVKMRTYKPLMDRPKCQGLESRIQHFVRRGRIEHPHLFHEEETKAKRDCNDT

SEQ ID NO: 6719 - protein, 60 aa, Homo sapiens
  UNSURE 12: Xaa=Glu or Gly
MSRNCSLGLQSXRPSARDFQRAAPKAQCRGARGACAEGSLPGEAGRWESNAVRSICMQWV

SEQ ID NO: 6720 - protein, 90 aa, Homo sapiens
  UNSURE 73: Xaa=Ala or Asp or Glu or Ile or Lys or Met or Asn or Thr or Val
MFIEALFTIAKTWNQPKCPTMIDWIKKMWHIYTMEYYAAIKNDEFMSFVGTWMKLETIILSKLSQEQKTKHRXILTHRWELNNEITWTQE

SEQ ID NO: 6721 - protein, 90 aa, Homo sapiens [sequence omitted]

SEQ ID NO: 6722 - protein, 72 aa, Homo sapiens
  UNSURE 17: Xaa=Ala or Asp or Gly
MDDKSEDSMSVSTLSFXVNRPITGSFDHTVVVWDADTGRKVNILIGHCAEISSASFNWDCSLILTGSMDKTC

SEQ ID NO: 6723 - protein, 68 aa, Homo sapiens
MLRKHTFGKKRESQHPNSVTYDLLYFLGLPSEHVYFYLTFEVITVTAYIQSSFCFLNLNSIDIFPCHS

SEQ ID NO: 6724 - protein, 93 aa, Homo sapiens
  UNSURE 76: Xaa=Phe or Leu or Val
  UNSURE 77: Xaa=Phe or Val
MLPDLHALYFFVLPDYSVSDLLYFVKRCESGHTCFVSDYREKAFSTFPLCMMLAVGMLLITFIMLRYVLSIIIIIXXNFFFEMESRSVTQLEC

SEQ ID NO: 6725 - protein, 85 aa, Homo sapiens
MPELNRLRKKLNKKYPKLSRNSIGRDIPKMLELFKNGHEIKVDEERENFLQTKIATLDMSSDQIAANLQAVINEVCRHRPLNLGT

SEQ ID NO: 6726 - protein, 65 aa, Homo sapiens
  UNSURE 41: Xaa= *  or Ala or Glu or Gly or Lys or Pro or Gln or Arg or Ser or Thr
MSTGTQPKTKKLRQKKHVTGSVLPGSRNTLSYMRIHNFPSXLWLSRMIMIFLKGPCRTSLQTTKY

SEQ ID NO: 6727 - protein, 84 aa, Homo sapiens
MFTAMPPLTLGIFERSCRKENMLKYPELYKTSQNALDFNTKVFWVHCLNGLFHSVILFWFPLKALQYGTAFGNGKTSDYLLLGR

SEQ ID NO: 6728 - protein, 59 aa, Homo sapiens
MKFQHCLLHTSCYCKGNYLSSLSFQEPLLWIIPSPCLSNNSFVKISLLPIRCAEVPHVV

SEQ ID NO: 6729 - protein, 139 aa, Homo sapiens
MAGSVADSDAVVKLDDGHLNNSLSSPVQADVYFPRLIVPFCGHIKGGMRPGKKVLVMGIVDLNPESFAISLTCGDSEDPPADVAIELKAVFTDRQLLRNSCISGERGEEQSAIPYFPFIPDQPFRWKFFVSTTFPSVCG

SEQ ID NO: 6730 - protein, 96 aa, Homo sapiens
  UNSURE 88: Xaa=Glu or Gln
MSEELAQLESILKEAESASENEEIDISKAAQTTIETAIHSLIETLKNKEFISAVAQVKAFRSLWPSDIFGSCEDDPVQTLLHIYFHHXDAGPDRKQ

SEQ ID NO: 6731 - protein, 122 aa, Homo sapiens
  UNSURE 81: Xaa=Pro or Arg
  UNSURE 83: Xaa=Ala or Cys or Asp or Phe or Gly or His or Ile or Leu or Asn or Pro or Arg or Ser or Thr or Val or Tyr
  UNSURE 94: Xaa=Ala or Pro or Ser
MEEKEILRRQIRLLQGLIDDYKTLHGNAPAPGTPAASGWQPPTYHSGRAFSARYPRPSRRGYSSHHGPSWRKKYSLVNRPXGXSDPPADHAVRXLHGARGGQPPVPQQHVLERQVQLSQGQN

SEQ ID NO: 6732 - protein, 131 aa, Homo sapiens
MSMILSASVIRVRDGLPLSASTDYEQSTGMQECRKYFKMLSRKLAQLPDRCTLKTGHYNINFISSLGVSYMMLCTENYPNVLAFSFLDELQKEFITTYNMMKTNTAVRPYCFIEFDTSFRGPSSDIIIPGL

SEQ ID NO: 6733 - protein, 69 aa, Homo sapiens
MAPTVQKCKGRELRRHRHFLSPLKTFAYMAGCWRKDLLSSLPKDDFLKLHSKSLFISLQSDAGTDGKAP

SEQ ID NO: 6734 - protein, 100 aa, Homo sapiens
MSYTPGVGGDPAQLAQRISSNIQKITQCSVEIQRTLNQLGTPQDSPELRQQLQQKQQYTNQLAKETDKYIKEFGSLPTTPSEQRQRKIQKDRLVAEFTTS

SEQ ID NO: 6735 - protein, 75 aa, Homo sapiens
MKEKMLRVAREKGRVTHKGKPIRLTADLSAETLQARREWGPIFNILKEKDFHPRISYAAKLNFVSEGEIKYFTDK

SEQ ID NO: 6736 - protein, 79 aa, Homo sapiens
  UNSURE 60: Xaa=His or Gln
MYPNWGRYGGSSHYPPPPVPPPPPVALPEASPGPGYSSSTTPAAPSSSGFMSFREQHLAXSSSCSRCTRSKCSACFSPH

SEQ ID NO: 6737 - protein, 77 aa, Homo sapiens
MEAEETMECLQEFPEHHKMILDRLNEQREQDRFTDITLIVDGHHFKAHKAVLAACSKFFYKFFQEFTQEPLVEIEGA

SEQ ID NO: 6738 - protein, 73 aa, Homo sapiens
MDMVSNQHPWFGMEQEYTLMGTDGHPFGWPSNGFPGPQGPYYCGVGADRAYGRDIVEAHYRACLYAGVKIAGC

SEQ ID NO: 6739 - protein, 103 aa, Homo sapiens
  UNSURE 81: Xaa=Leu or Pro or Gln or Arg
MKKSVGIIKTKAGTDSLCRRREGTRDSGRASREHPQLCFLRFYSLNLVEVLCVQCVNILYTLPILYKCFISIQYLEGSYKXDAFNSKVADEHQEGTFMSFHPR

SEQ ID NO: 6740 - protein, 66 aa, Homo sapiens
  UNSURE 55: Xaa=Asp or Glu or Lys or Asn
  UNSURE 56: Xaa= *  or Arg
MSQEPLSFKDVAVVFTEEELELLDSTQRQLYQDVMQENFRNLLSVGERNPLGNWXXTSWSVLVPGR

SEQ ID NO: 6741 - protein, 75 aa, Homo sapiens
MVALRLEHQRLSAKLKDYYIFNKYLEKVVENSEESRWAHIQNTAAKKTLLLGTIKMATLNLFQIVSKHLKEVTEV

SEQ ID NO: 6742 - protein, 74 aa, Homo sapiens
MNRWLNRINMLTAGYAERERIKQEQDYWSESDKEEADTPSTPKQDSPPPPYDTYPRPPSMSCASPYVEAKHSRT

SEQ ID NO: 6743 - protein, 54 aa, Homo sapiens
  UNSURE 2: Xaa=Ile or Thr
  UNSURE 24: Xaa=Met or Thr
  UNSURE 33: Xaa= *  or Lys
  UNSURE 36: Xaa=Gly or Leu or Arg or Val
  UNSURE 47: Xaa=Ala or Gly
  UNSURE 54: Xaa=Asp or Glu or Val
MXDAAVSFAKDFLAGGVAAAISKXAVAPIERVXLLXQVQHASKQITXDKQYKGX

SEQ ID NO: 6744 - protein, 85 aa, Homo sapiens
MLHHELAAECKSAGYPGTLIPYRCDLSNEEDILSMFSAIRSQHSGVDICINNAGLARPDTLLSGSTSGWKDMFNVNVLASASAHG

SEQ ID NO: 6745 - protein, 66 aa, Homo sapiens
MTYSEKDERESSLPNGRSVSLMDLQDTHAAQVEHASVMLDVPIRLTGSQLSITQVASIKQLRETQS

SEQ ID NO: 6746 - protein, 51 aa, Homo sapiens
  UNSURE 38: Xaa=Ser or Thr
MIAGLYGKTMFSCRRNCQTVFQCDCVDFVFLPAMNESXCDSTFLPSFGVVS

SEQ ID NO: 6747 - protein, 55 aa, Homo sapiens
MHTLLREKEEELERIKEAHEKVLEKKEQDLNEALVKMVALGSSLEETEIKLQAKE

SEQ ID NO: 6748 - protein, 107 aa, Homo sapiens
MQFGKLWCGCSGEFPTRLRRRTPLTEAMEGGPAVCCQDPRAELVERVAAIDVTHLEEADGGPEPTRNGVDPPPRARAASVIPGSTSRLLPARPSLSARKLSLQERPA

SEQ ID NO: 6749 - protein, 55 aa, Homo sapiens [sequence omitted]

SEQ ID NO: 6750 - protein, 61 aa, Homo sapiens
MLFINHIFQMREWEFIGLRSDAIPQTPALMPVSCCHPHPLLFQSRPGALHPCFCGPLCLLQ

SEQ ID NO: 6751 - protein, 77 aa, Homo sapiens
MESALAVPRLPPHDPGTPVLSVVDMHTGGEPLRIVLAGCPEVSGPTLLAKRRYMRQHLDHVRRRLMFEPRGHRDMYG

SEQ ID NO: 6752 - protein, 58 aa, Homo sapiens
MTTDFDFGGPGHFWCPPHSWLMAGSSVSQMKIDLVHSQTSRALASIPFPQASPLHSTL

SEQ ID NO: 6753 - protein, 79 aa, Homo sapiens
MNYIFGNNTLLYSRGSRGGNTSSSHGSAGPKQKHWAKKGSSDELQAEPEPSRWQQIVAFFTRRHSFIDCISVATSSTQA

SEQ ID NO: 6754 - protein, 68 aa, Homo sapiens
MLKGRCPSVSAPSLITDSVISVPSWKSERPTAISEHWDQGQRLKLSPNKYQPIQPIQTSKLEQDHFQV

SEQ ID NO: 6755 - protein, 56 aa, Homo sapiens
MEYCRIMYDIFPFKKLVNFIVSDSGAHVLNSWTQEDQNLQELMAALAAVGPPNPRA

SEQ ID NO: 6756 - protein, 77 aa, Homo sapiens
MYDSFDNTYQATIGIDFLSKTMYLEDRTVRLQLWDTAGQERFRSLIPSYIRDSTVAVVVYDITNLNSFQQTSKWIDI

SEQ ID NO: 6757 - protein, 65 aa, Homo sapiens
  UNSURE 65: Xaa=Pro or Gln or Arg
MKITEMRIKGNYIHSTLQPNTGYKDENGINRPVCSYVKPLRAGRLLDTPRQAARFVNVLGYERAX

SEQ ID NO: 6758 - protein, 52 aa, Homo sapiens
MILLRNSQFYLYLFVCVCAYFILCSFITHVDISPTTVKIQSSSSPQRSFSLP

SEQ ID NO: 6759 - protein, 66 aa, Homo sapiens
  UNSURE 40: Xaa=Cys or Ser
  UNSURE 43: Xaa=Lys or Arg
  UNSURE 44: Xaa= *  or Ser
MCVLYDVLSIVRDKKFMTLDPVSQDALPPKQNPQTLQLIXKKXXLAGAAQILLKGAERLTKSVTEN

SEQ ID NO: 6760 - protein, 62 aa, Homo sapiens
MKKKESSSMLATVKEEVSGSSAAVTENADSDRISDEANSNFNQGTENEQSKETQSHESKLGV

SEQ ID NO: 6761 - protein, 81 aa, Homo sapiens
MGKWKRSQAIEKLVALLNTLDRWIDETPPVDQPSRFGNKAYRTWYAKLDEEAENLVATVVPTHLAAAVPEVAVYLKESVGI

SEQ ID NO: 6762 - protein, 80 aa, Homo sapiens
  UNSURE 63: Xaa=His or Leu or Pro or Gln or Arg
  UNSURE 69: Xaa=Ala or Asp or Glu or Gly or His or Ile or Lys or Leu or Asn or Pro or Gln or Arg or Ser or Thr or Val
  UNSURE 74: Xaa=Arg or Ser or Thr
MPAHSLVMSSPALPAFLLCSTLLVIKMYVVAIITGQVRLRKKAFANPEDALRHGGPQYCRSDXDVERCXGPTGXHGDHLP

SEQ ID NO: 6763 - protein, 125 aa, Homo sapiens
MCGWNSLHQASFQENAEIIKLLLRKGANKECQDDFGITPLFVAAQYGKLESLSILISSGANVNCQALDKATPLFIAAQEGHTKCVELLLSSGADPDLYCNEDSWQLPIHAAAQMGHTKILDLLIP

SEQ ID NO: 6764 - protein, 89 aa, Homo sapiens
MATAASNPYSILSSTSLVHADSAGMQQGSPFRNPQKLLQSDYLQGVPSNGHPLGHHWVTSLSDGGPWSSTLATSPLDQQDVKPGREDLQ

SEQ ID NO: 6765 - protein, 69 aa, Homo sapiens
  UNSURE 44: Xaa=Phe or Ser
MAMLVLVPGRVMRPLGGQLWRFLPRGLEFWGPAEGTARVLLRQXCARQAEAWRASGRPGYCLGTRPLNT

SEQ ID NO: 6766 - protein, 53 aa, Homo sapiens
  UNSURE 13: Xaa=Gly or Arg
  UNSURE 14: Xaa=Pro or Ser
  UNSURE 23: Xaa= *  or Cys
  UNSURE 28: Xaa=Lys or Asn
  UNSURE 29: Xaa=Ala or Pro
  UNSURE 39: Xaa=Ile or Asn
  UNSURE 43: Xaa=Leu or Trp
  UNSURE 44: Xaa=Phe or Ser
  UNSURE 47: Xaa=Gly or Ser
MRSCYVAQAGLKXXSCLSFPKCXNDRCXXPRPAPNHLLXNASXXHYXKFSLVC

SEQ ID NO: 6767 - protein, 61 aa, Homo sapiens
MSSLGFTSKEQRNLGLLVHLMTSNPKILYAPAGSEVDRVILKANETFAFVGNVTHYAQVWL

SEQ ID NO: 6768 - protein, 62 aa, Homo sapiens
MEQLTTLPRPGDPGAMEPWALPTWHSWTPGRGGEPSSAAPSIADTPPAALQLQELRSEESSK

SEQ ID NO: 6769 - protein, 98 aa, Homo sapiens
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGF

SEQ ID NO: 6770 - protein, 90 aa, Homo sapiens
MRGGAADRSGLIHVGDELREVNGIPVEDKRPEEIIQILAQSQGAITFKIIPGSKEETPSKEGKMFIKALFDYNPNEDKAIPCKEAGLSFK

SEQ ID NO: 6771 - protein, 76 aa, Homo sapiens
MLGFLGGVSWAMLVARTCQLYPNAAASTLVHKFFLVFSKWEWPNPVLLKQPEESNLNLPVWDPRVNPSDRYHLMPR

SEQ ID NO: 6772 - protein, 70 aa, Homo sapiens
MASPSRQPPPGGSGLLQGSRARSYGSLVQSACSPVRERRLEHQLEPGDTLAGLALKYGVTMEQIKRANRL

SEQ ID NO: 6773 - protein, 51 aa, Homo sapiens
MVLSSKALGKPELFIFFYVHLFFCIIWYIVCLTTSILLLFLRMNLPYIYHA

SEQ ID NO: 6774 - protein, 121 aa, Homo sapiens
MIFSDMNTVSGSPKVHPPNGTRFYTFQIVALREQNVHIQRKMASSEGSTESEHLEGMEPGQKVHEKRLSNGSIDSTDETSQIVELQELLEKQNYEMAQMKERLAALSSRVGEVEQEAETAR

SEQ ID NO: 6775 - protein, 55 aa, Homo sapiens
MKSGKGRPISFVDSFPLSIWICQPTRYAESQKEPQTCNQVSLNTSQSESSDLAGH

SEQ ID NO: 6776 - protein, 71 aa, Homo sapiens [sequence omitted]

SEQ ID NO: 6777 - protein, 84 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMP

SEQ ID NO: 6778 - protein, 59 aa, Homo sapiens
MREDLFKQYIEKIAKNLDSEKEKELERQARIEASLREREREVQKARSEQTKEIDREREQ

SEQ ID NO: 6779 - protein, 56 aa, Homo sapiens
  UNSURE 20: Xaa=His or Gln
  UNSURE 21: Xaa=Cys or Phe
MTVQQEDLKNHVDSYYHRSXXMESSDQKSSRRISSFPFSFLEIGCLYQNGILLLGY

SEQ ID NO: 6780 - protein, 115 aa, Homo sapiens
  UNSURE 39: Xaa=His or Gln
  UNSURE 103: Xaa=Asn or Tyr
MMADDNIEDSTARLDTQHSEDMNATRSEEQFHVINHAEXTLRKMENYLKEKQLCDVLLIAGHLRIPAHRLVLSAVSDYFAAMFTNDVLEAKQEEVRMEGVDPXALNSLVQYAYTG

SEQ ID NO: 6781 - protein, 53 aa, Homo sapiens
  UNSURE 3: Xaa=Glu or Val
  UNSURE 36: Xaa=Cys or Phe or Ser or Tyr
MAXPGEAEEEATVYLVVSGIPSVLRSAHLRSYFSQXREERGGGFLCFHYRHRP

SEQ ID NO: 6782 - protein, 107 aa, Homo sapiens
MRYNEKELQALSRQPAEMAAELGMRGPKKGSVLKRRLVKLVVNFLFYFRTDEAEPVGALLLERCRVVREEPGTFSISFIEDPERKYHFECSSEEQCQEWMEALRRGQ

SEQ ID NO: 6783 - protein, 56 aa, Homo sapiens
  UNSURE 43: Xaa=Leu or Val
MASKKFAVKCGNFAVLVDLHILPQGSNKDTSWFSEQKKEEVCXLLKETIDSRVQET

SEQ ID NO: 6784 - protein, 90 aa, Homo sapiens
MDQPRNPCENEPLTPGYHGFPARDSQGNQEPTTTPDAMVQPFTTIPFPPPPQNGIPTEYGVPHTQDYAGQTGEHNLTLYGSTQAHGEQSS

SEQ ID NO: 6785 - protein, 110 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTG

SEQ ID NO: 6786 - protein, 73 aa, Homo sapiens
MERMSDSADKPIDNDAEGVWSPDIEQSFQEALAIYPPCGRRKIILSDEGKMYGRNELIARYIKLRTGKTRTRA

SEQ ID NO: 6787 - protein, 64 aa, Homo sapiens
  UNSURE 2: Xaa=Cys or Ser
  UNSURE 7: Xaa=Asp or Asn
MXHRDSXHQLQLLDTKFKGTVEELSNQILSARSWLQQEQERIEKELLQKIDQLSLIVKENSGAS

SEQ ID NO: 6788 - protein, 67 aa, Homo sapiens
MTKSLESVSFKDVTVDFSRDEWQQLDLAQKSLYREVMLENYFNLISVGCQVPKPEVIFSLEQEEPCM

SEQ ID NO: 6789 - protein, 100 aa, Homo sapiens
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISP

SEQ ID NO: 6790 - protein, 62 aa, Homo sapiens
  UNSURE 60: Xaa=Ala or Asp or Glu or Val
MEGFLKSDERQRLAKERREEREKCLAAREQQILEKQKRARLQYEKQMEERWRKLEEQRHXRT

SEQ ID NO: 6791 - protein, 55 aa, Homo sapiens
  UNSURE 2: Xaa=Asp or Glu
  UNSURE 3: Xaa=Asp or Tyr
  UNSURE 10: Xaa= *  or Cys or Phe or Gly or Ile or Leu or Arg or Ser or Val
MXXQGTRHGXTMKTNTYERGTYYFFDCLNWRKVAKEFHLEYDKLEERPHLPSTFN

SEQ ID NO: 6792 - protein, 81 aa, Homo sapiens
  UNSURE 76: Xaa=Glu or Gly or Lys or Arg
MTVQLVSNFSRDAEPFLVRTLVEEITEEQYYMMRRYESSASHPPPRPPKHPSVEETKLTLLTLAEERTVDLPKSPXRHHAD

SEQ ID NO: 6793 - protein, 62 aa, Homo sapiens
MIRTHSSLNLPRLKQSSHLSLPWQLGATGSCHHAQLIFVFFVKMRFCISPRQAGLKLLDSSD

SEQ ID NO: 6794 - protein, 59 aa, Homo sapiens
MLVAAVISPYPQLVKKESKMAAGLCQLLSSAAIIRELPLSFSPAITTLPHGHHHLNHLA

SEQ ID NO: 6795 - protein, 63 aa, Homo sapiens
MKMEGTSPAPPPAAGKYPSCSELIKTADGGQISLDWFDNDNSTCYMDASTRPTILLLPGLTGT

SEQ ID NO: 6796 - protein, 81 aa, Homo sapiens
MIFKGPRWASWNIGVFICIRCAGIHRNLGVHISRVKSVNLDQWTQEQIQCMQEMGNGKANRLYEAYLPETFRRPQIDPAVE

SEQ ID NO: 6797 - protein, 55 aa, Homo sapiens
MFNDAFLFHQQGQIEVESETIFKLAAFILQEAKGDYTSDENARKDLKTLPAFPTN

SEQ ID NO: 6798 - protein, 56 aa, Homo sapiens [sequence omitted]

SEQ ID NO: 6799 - protein, 78 aa, Homo sapiens
  UNSURE 66: Xaa=Glu or Gly
MACRRRYFVEGEAPSSETGTSLDSPSAYPQGPLVPGSSLSPDHYEHTSVEPMGCTRGRRGNSSARXGPSCSTRPPSCA

SEQ ID NO: 6800 - protein, 55 aa, Homo sapiens
MEAVNLLSSNKYTEKQIGYLFISVLVNSNSELIRLINNAIKNDLASRNPTFMCLA

SEQ ID NO: 6801 - protein, 51 aa, Homo sapiens
MVLNEVDKDMESVIPKTDCRLRPDIRAMENGEIDQASEEKKRLEEKQRAAR

SEQ ID NO: 6802 - protein, 120 aa, Homo sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIR

SEQ ID NO: 6803 - protein, 62 aa, Homo sapiens
MSSTRSQNPHGLKQIGLDQIWDDLRAGIQQVYTRQTWPSPDIWSSTLMFITTVLVFTSQTKH

SEQ ID NO: 6804 - protein, 90 aa, Homo sapiens
MDGEWLCLRELDDISLTPDPEPTHEDPNYLMANERMNLMNMAKLSIKGLIESALNLGRTLDSDYAPLQQFFVVMEHCLKRGLKAKKTFLE

SEQ ID NO: 6805 - protein, 80 aa, Homo sapiens
MTRHLRLTAEGEREEKTEEASDITGRTEKQQWGRTDQTPRLPAPKEQGRAADALLKAVAASSVAEKAVEAARMAKLIAQN

SEQ ID NO: 6806 - protein, 82 aa, Homo sapiens
MNRMKEPSSPPPAPTSSTFGLQDGNLRAPHKESTLPRSGSSGGQQPSGMKEGVKRYEQEHSAIQDKLFQVAKREREAATKHS

SEQ ID NO: 6807 - protein, 67 aa, Homo sapiens
  UNSURE 32: Xaa=Arg or Thr
  UNSURE 54: Xaa=Phe or Leu
  UNSURE 63: Xaa=Ala or Pro or Ser or Thr
MPRSPGSYADLQRFYFLALESAEIRRHRAQRXASDPDCVCLSGYVYTDEYKMFXSLGFLLLFXPPSH

SEQ ID NO: 6808 - protein, 125 aa, Homo sapiens
MCQQEEVKQEITATLEALCGIAEATQIDNVAILFNFLMDFLTNCIGLMEVYKNTPETVNLIIEVFVEVAHKQICYLGESKAMNLYEACLTLLQVYSKNNLGRQRIDVTAEEEQYQDLLLIMELLT

SEQ ID NO: 6809 - protein, 64 aa, Homo sapiens
  UNSURE 17: Xaa=Ile or Ser
  UNSURE 46: Xaa= *  or Tyr
MHPPLPLPQYPPSSSNXVVTERIPLSPSSGSPVQILDFPPKMKKNXLKNLDLKCLENNHLFFYV

SEQ ID NO: 6810 - protein, 53 aa, Homo sapiens
  UNSURE 42: Xaa=Gly or Leu or Arg or Val
MKPSHVSVSPAPRQKGWAQSYGSGWCGLPRRPQLGAWAAMLXAGPVTSLSLLE

SEQ ID NO: 6811 - protein, 66 aa, Homo sapiens
  UNSURE 48: Xaa=His or Gln
  UNSURE 49: Xaa=Ala or Asp or Glu or Gly or His or Lys or Asn or Pro or Gln or Arg or Ser or Thr
  UNSURE 58: Xaa=Cys or Phe or Leu or Trp
  UNSURE 59: Xaa=Lys or Met or Arg or Thr
MSKSASFAFEFPKDRSGIETFSPPPPPPKSRHLLKMNKSSSDLEKVSXXSARGLSPSXXGVHVSFT

SEQ ID NO: 6812 - protein, 62 aa, Homo sapiens
  UNSURE 47: Xaa=Cys or Gly or Ser
MGMPECPGKSLLQGQSPQGKPLLGQCGREMWGWSPQSPHWSTAYWSXEKGLPFSRPQNYRPT

SEQ ID NO: 6813 - protein, 56 aa, Homo sapiens
MMGVKFWATFSSIILTSRIVSCTVCIRSHHFWGAFLSSLYLPYFGSFWLFSETRDM

SEQ ID NO: 6814 - protein, 58 aa, Homo sapiens
  UNSURE 29: Xaa=Glu or Gln
MPRLVGAQNPHRKVPRAARGGTHGVRVSXAPSIPPGPGPLQLIARGFSASALVGRSCS

SEQ ID NO: 6815 - protein, 82 aa, Homo sapiens
MLLLWRNVFPRSLKELEAEKARGDSFTWQVTLEGRAGALCAMRSFVAHCPELLTEDVIRKLMTPIECAMTMMSHIPSVMKAP

SEQ ID NO: 6816 - protein, 59 aa, Homo sapiens
MPNRHLSWHGGPSALPSSPQVMDSSMPLIGEHVEEDRQLMADLVVSKMSQLPMPGGTAP

SEQ ID NO: 6817 - protein, 72 aa, Homo sapiens
  UNSURE 12: Xaa=Gly or Arg
MGCKRASEVCGXAVEGLRDPLKPSEPSQGAAGKRKGTEYLMKQKLEFGGRGEELLLGVHLRGAQKTGGGWRR

SEQ ID NO: 6818 - protein, 100 aa, Homo sapiens
  UNSURE 91: Xaa=Ala or Gly or Pro or Arg
MQESLRVKQLAEEQKRREREQHIAECMAKMPQMIVNWQQQQRENWEKAQADKERRARLQAEAQELLGYQVDPRSARFQELLQDLEKKERKXLKEEKQKRK

SEQ ID NO: 6819 - protein, 72 aa, Homo sapiens
MLDRDVGPTPIYPPTYLEPGIGRHTPYGNQTDYRIFELNKRLQNWTEECDNLWWDAFTTEFFEDDAMLTITF

SEQ ID NO: 6820 - protein, 108 aa, Homo sapiens
  UNSURE 24: Xaa=Arg or Ser
MPLFQSHLYSRQPCGVRCTGPAYXCRKRDVLPSDKVTWLFSNTDKAPRQGTRGRRGQQLAVAADVCPQLHHSSLWLCRARGFSVRVSMCLPFRSSQLVCLAVPGLCSV

SEQ ID NO: 6821 - protein, 88 aa, Homo sapiens
  UNSURE 76: Xaa=Cys or Tyr
MPRKRISGLEWLLQQDPGFSLVNTVKAGMIISFPSNNIYSSVCCCQSEIFKYEFSNSKKSSWIQEERHLGKNNVLXSAHDVSPEKVTS

SEQ ID NO: 6822 - protein, 52 aa, Homo sapiens
MILSLRNLVEPTGESSFWETMDVPHCRRISREQCLEQMLVLKKVYEMPADVS

SEQ ID NO: 6823 - protein, 76 aa, Homo sapiens
  UNSURE 39: Xaa=Glu or Val
MRRKMEDKHVCIPDFNMLFNLEDQEEQAYFAVFDGHGGXDAAIYASIHLHVNLVRQEMFPHDPAEALCRAFRVTDE

SEQ ID NO: 6824 - protein, 112 aa, Homo sapiens
MATALALRSLYRARPSLRCPPVELPWAPRRGHRLSPADDELYQRTRISLLQREAAQAMYIDSYNSRGFMINGNRVLGPCALLPYSVVQWNVGSHQDITEDSFSLFWLLEPRI

SEQ ID NO: 6825 - protein, 56 aa, Homo sapiens
MPSGSSDLMEDSKVSNRLKGDKGSSSRYVPSVTKLQVETITRNFVPYVSFHQMTNS

SEQ ID NO: 6826 - protein, 154 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHGEDPGPALTSKNHFLGHAPLRASLLL

SEQ ID NO: 6827 - protein, 58 aa, Homo sapiens
MIGLEDFVADNYSKIGNQVLPPGASLGNGLTPEAARDLGLLPGIAVAASLIDAHAGGL

SEQ ID NO: 6828 - protein, 60 aa, Homo sapiens
MEHKSGSLSSSRESAFTSPISVTKPVVLASGAALSSPKESPSSTTPPIEISSSRLTKLTR

SEQ ID NO: 6829 - protein, 125 aa, Homo sapiens
MENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRGPVLGKEYTEKTPISEHA

SEQ ID NO: 6830 - protein, 102 aa, Homo sapiens
MKEKGQHLEPFIMNFINSCESPKPKPSRPELTILSPTSENNKKLFNDLFKNNANRAENTERKQNQNYFMEVMTVEGVYDYLMYVGRVVFQVPDWLHHLLMGT

SEQ ID NO: 6831 - protein, 97 aa, Homo sapiens
MERLLDYRDCMKMGEVDGKKIGCTVSLLNFYKTELNKEEMYIRYIHKLYDLHLKAQNFTEAAYTLLLYDELLEWSDRPLREFLTYPMQTEWQRKEHL

SEQ ID NO: 6832 - protein, 60 aa, Homo sapiens [sequence omitted]

SEQ ID NO: 6833 - protein, 106 aa, Homo sapiens
  UNSURE 80: Xaa=Asp or Glu
  UNSURE 87: Xaa=Ala or Asp or His or Pro or Ser or Tyr
  UNSURE 88: Xaa=Phe or Ile
  UNSURE 96: Xaa=Asn or Ser
  UNSURE 97: Xaa=His or Asn
MTKNHAAIKTHAHVCLLWHYSQIAKTWNQPKCPTMIDWIKKMWHIYTMEYYAAIKNDEFMSFVGTWMKLETIILSKLSQXQKNQTPXXLTHRWELXXEITWTQEGD

SEQ ID NO: 6834 - protein, 92 aa, Homo sapiens
  UNSURE 2: Xaa=Phe or Tyr
MXIVALFTIAKTWNQPKCPTMIDWIKKMWHIYTMEYYAAIKNDEFMSFVGTWMKLETIILSKLSQEQKNQTPHILTHRWELNNEITWTQEGD

SEQ ID NO: 6835 - protein, 51 aa, Homo sapiens
MLTRLDLRRSAHLGLLKCWDYRREDSLSPGVRDLPGQYSETPFSRKRKKKK

SEQ ID NO: 6836 - protein, 54 aa, Homo sapiens
MLTRLDLRRSAHLGLLKCWDYRREDSLSPGVRDLPGQYSETPFSRKRKKKKKKP

SEQ ID NO: 6837 - protein, 54 aa, Homo sapiens
  UNSURE 53: Xaa=Lys or Asn
MLTRLDLRRSAHLGLLKCWDYRREDSLSPGVRDLPGQYSETPFSRKRKKKKKXP

SEQ ID NO: 6838 - protein, 55 aa, Homo sapiens
MKIIFSFLSDLESRNETKHLSVGKDIIQNTGSQWEVMESSKLCGLEGSIFRNDWP

SEQ ID NO: 6839 - protein, 74 aa, Homo sapiens
  UNSURE 4: Xaa= *  or Leu
  UNSURE 20: Xaa= *  or Glu
MTNXSTSGKKASQVIVQVNXRASVTTIAEGIQPEEQDVSSGTHIFKSKHIKLQRPCEAAVISSMRSQQQALPEQ

SEQ ID NO: 6840 - protein, 76 aa, Homo sapiens
MSLSDWHLAVKLADQPLTPKSILRLPETELGEYSLGGYSISFLKQLIAGKLQESVPDPELIDLIYCGRKLKDDQTL

SEQ ID NO: 6841 - protein, 68 aa, Homo sapiens
  UNSURE 40: Xaa=Ser or Thr
  UNSURE 43: Xaa=Asn or Tyr
  UNSURE 64: Xaa=His or Gln
MQNSPDPEEEEEVLEEEDGGETSSQADSVLLQEMQALTQXFNXNWSYEGLRHMSGSELTELLDXVEGA

SEQ ID NO: 6842 - protein, 55 aa, Homo sapiens [sequence omitted]

SEQ ID NO: 6843 - protein, 57 aa, Homo sapiens
MRLIRNIYIFCSIVMTAEGDAPELPEERELMTNCSNMSLRKVPADLTPATTTLDSYN

SEQ ID NO: 6844 - protein, 86 aa, Homo sapiens
  UNSURE 34: Xaa=Lys or Asn
  UNSURE 35: Xaa=Lys or Pro or Gln or Arg or Thr
  UNSURE 47: Xaa=Asp or Glu
  UNSURE 48: Xaa=Ile or Leu or Val
  UNSURE 62: Xaa=Pro or Ser
  UNSURE 63: Xaa= *  or Lys
  UNSURE 64: Xaa=Met or Arg or Thr
  UNSURE 72: Xaa=Arg or Ser
MLSKVGMWDFDIFLFDRLTNGNSLVTLLCHLFNXXWTHSPFQVRYGXXTPIFSHGSRRLPQXXXVSQCCSRXRRHPGHALLPERAG

SEQ ID NO: 6845 - protein, 52 aa, Homo sapiens
MAPLPGAELVRRPLQLYRYLLRCCQQLPTKGIQQHYKHAVRQSFRVHSDEDN

SEQ ID NO: 6846 - protein, 69 aa, Homo sapiens
  UNSURE 8: Xaa=Ala or Cys or Phe or Gly or Ser or Val
  UNSURE 15: Xaa=Met or Arg
  UNSURE 17: Xaa= *  or Lys
  UNSURE 20: Xaa= *  or Ile or Lys or Leu or Arg
  UNSURE 31: Xaa=Asp or Gly
  UNSURE 50: Xaa=Lys or Arg
MVNDSSRXGEHFPGXIXKDXGENVNANCHLXNVCIAANINKTLTKIRSIXEPVALLQEVYRNSVTDLSP

SEQ ID NO: 6847 - protein, 86 aa, Homo sapiens
MPYDLCEDEPTLDVIETCMAYQGITQEKINEMRVAPEQQMIADIHCMIAAGQDLDWIDAQGATLLHIAGANGYLRAAELLLDHGVR

SEQ ID NO: 6848 - protein, 97 aa, Homo sapiens
MMRFIYTGRAPNLDKMADNLLAAADKYALERLKVMCEEALCSNLSVENVADTLVLADLHSAEQLKAQAIDFINRCSVLRQLGCKDGKNWNSNQATVI

SEQ ID NO: 6849 - protein, 73 aa, Homo sapiens
  UNSURE 23: Xaa=Glu or Gly or Gln or Arg
  UNSURE 58: Xaa=Cys or Phe or Leu or Trp
  UNSURE 63: Xaa=Asp or His or Asn
  UNSURE 65: Xaa=Cys or Phe or Ser or Tyr
MLIPQLKESLQTLMKVAAQNLIXNTNIDNGQKSSDGPIQRFDKCLEEFYALCDQLELXLRLAXEXLSQSCDSA

SEQ ID NO: 6850 - protein, 85 aa, Homo sapiens
  UNSURE 56: Xaa=Asn or Ser
MASDIPGSVTLPVAPMAATGQVRMAGAMPARGGKRRSGMDFDDEDGEGPSKFSREXHSEIERRRRNKMTQYITELSDMVPTCSDW

SEQ ID NO: 6851 - protein, 55 aa, Homo sapiens
  UNSURE 26: Xaa=Pro or Gln
  UNSURE 33: Xaa= *  or Glu or Lys
  UNSURE 37: Xaa=Leu or Val
  UNSURE 42: Xaa=Pro or Ser
  UNSURE 50: Xaa=Phe or Ser
MQLVLQTRVHTGASSPPGTDRCSPWXVTWGASXKQVXKENIXGKPADRKXTVGVG

SEQ ID NO: 6852 - protein, 58 aa, Homo sapiens
  UNSURE 44: Xaa=Asp or Glu or His or Gln
MDNVTVRQGESATLRCTIDDRVTRVAWLNRSTILYAGNDKWSIXPRVIILVNTPTQYS

SEQ ID NO: 6853 - protein, 83 aa, Homo sapiens
MKPDETPMFDPSLLKEVDWSQNTATFSPAISPTHPGEGLVLRPLCTADLNRGFFKVLGQLTETGVVSPEQFMKSFEHMKKSGD

SEQ ID NO: 6854 - protein, 58 aa, Homo sapiens
  UNSURE 55: Xaa=Gln or Arg
MAGSSEEAPDYGRGVVIMDDWPGYDLNLFTYPQHYYGDLEYVLIPHGIIVDRIEXLAK

SEQ ID NO: 6855 - protein, 52 aa, Homo sapiens
  UNSURE 23: Xaa=Phe or Tyr
  UNSURE 26: Xaa= *  or Leu
  UNSURE 44: Xaa= *  or Glu
MCGIYYICWPFYLFFLCIYQCEXFAXFPWRYLLVIEAHVFIINXFFCNNCSS

SEQ ID NO: 6856 - protein, 64 aa, Homo sapiens
MIEFYAPWCPACQNLQPEWESFAEWGEDLEVNIAKVDVTEQPGLSGRFIITALPTIYHCKDGEF

SEQ ID NO: 6857 - protein, 75 aa, Homo sapiens
MQELRSRNFQQLSVDVLHESDEPTLENLPESQPIPSMDLHELESIVEDATSDLGYHEIPEDPLVAEEYYADAFDS

SEQ ID NO: 6858 - protein, 101 aa, Homo sapiens
  UNSURE 70: Xaa=Gly or Val
MAGDTHCPAEPLAREGTLWEALRALLPHSKEDLKLDLGEKVERSVVTLLQRATELFYEGRRDECLQSSEXILDYSWEKLNTGTWQDVDKDWRRVYAIGCLL

SEQ ID NO: 6859 - protein, 83 aa, Homo sapiens
MIHQVPIKSLPQEWLWCETWCDDASKKRAKTIDLCNNPMTKEPKLEAAVRIVPEWQDYDQEIKQLQIRFQKEKETGALYKEKT

SEQ ID NO: 6860 - protein, 79 aa, Homo sapiens
  UNSURE 64: Xaa=Ala or Glu
MRYGELEEGIDVLDSDGNLVGSSKIAARHALLETALTRVVLPMPILVLPPIVMSMLEKTALLQXRPRLLLPVQSLVCLA

SEQ ID NO: 6861 - protein, 114 aa, Homo sapiens
  UNSURE 56: Xaa=Gly or Val
MLTKRALQKPCSDRFLRTAQINRSRRPVTSVTSGSSSRSRSFRGSRRDLGAEKAPXPSRLPGPRLLQRRASRPPSPLPSSPSFLTFPLSLNRLLLPPGGLTATCSSALHLIAPG

SEQ ID NO: 6862 - protein, 63 aa, Homo sapiens
  UNSURE 25: Xaa=Asp or Gly or Val
MMETHLLIPDRGVAGQVVDQAGQAXQVVDLAAGQVDRVDKEVAQEVDKMVEDEVGIEIDQEVG

SEQ ID NO: 6863 - protein, 98 aa, Homo sapiens
  UNSURE 6: Xaa=Ala or Asp
  UNSURE 14: Xaa=Gly or Arg
MADAAXTAGAGGSXTRSGSKQSTNPADNYHLARRRTLQVVVSSLLTEAGFESAEKASVETLTEMLQSYISEIGRSAKSYCEHTEFGVNLFPPPSLLPT

SEQ ID NO: 6864 - protein, 60 aa, Homo sapiens [sequence omitted]

SEQ ID NO: 6865 - protein, 78 aa, Homo sapiens
MARKNCLVKNLEAVETLGSTSTICSDKTGTLTQNRMTVAHMWFDNQIHEADTTEDQSGATFDKRSPTWTALSRIAGLC

SEQ ID NO: 6866 - protein, 105 aa, Homo sapiens
MQVEGSHNSLFTSSVYIELCEVGSSPAWRTPMFKVTSYFVIIQAKVTEELAAATAQVSHLQLKMTAHQKKETELQMQLTESLKETDLLRGQLTKCRQSSQSSKKP

SEQ ID NO: 6867 - protein, 140 aa, Homo sapiens
  UNSURE 74: Xaa=Ala or Asp or Glu or Gly or Val
  UNSURE 134: Xaa=Lys or Arg
MTVEQLLTGSPTSPTVEPEKPTREKKFLDDIKKLQENLKKTLDNVAIVEEEKMEAVPDVERKEDKPEGQSPVKXEWPSETPVLCQQCGGKPGVTFTSAKGEVFSVLEFAPSNHSFKKIEFQPPEAKKFFSTVRXEMALLA

SEQ ID NO: 6868 - protein, 108 aa, Homo sapiens
  UNSURE 3: Xaa= *  or Glu or Lys or Gln
  UNSURE 55: Xaa= *  or Lys
MAXDSESAASQQSLELDDQDTCGIDGDNEEETEHAKGSPGGYLGAKKKKKKQKRXKEKPNSGGTKSDSASDSQEIKIQQPSKNPSVPMQKLQDIQRAMELLSACQGPA

SEQ ID NO: 6869 - protein, 56 aa, Homo sapiens
  UNSURE 27: Xaa=any one of the twenty amino acids
MSAFSEAALEKKLSELSNSQQSVQTLXLWLIHHRKHSRPIVTVWERDCGKPNQTGS

SEQ ID NO: 6870 - protein, 55 aa, Homo sapiens
MFVLFFKKSNYKQVFKGGLTIHLMRILLFEINHLYTEKNELFSMRNSEQTIEHTP

SEQ ID NO: 6871 - protein, 90 aa, Homo sapiens
  UNSURE 34: Xaa=Ile or Lys
  UNSURE 50: Xaa=Lys or Asn or Thr
  UNSURE 51: Xaa=Glu or Gln
  UNSURE 69: Xaa=Asp or Glu
  UNSURE 74: Xaa=Asp or His
MENEDEMSEEEDGGLEAFDDFFPVEPVSLPKKKXPKKLKENKCKGKRKKXXGSNDELSENEEDLEEKSXSEGSXYSPNKKKKKKLKDKKE

SEQ ID NO: 6872 - protein, 72 aa, Homo sapiens
  UNSURE 52: Xaa=Gly or Val
  UNSURE 58: Xaa=Gly or Val
MTWSHNDMWMLTADHGGYVKYWQSNMNNVKMFQAHKEAIREARFIHNIPFSXVPIVMXKLFSKCILGAEMHG

SEQ ID NO: 6873 - protein, 64 aa, Homo sapiens
  UNSURE 41: Xaa=Asn or Ser or Thr
MGRKLEKPNPEKNAWEHNSLTIPSPACASEASLEVTDLLLXALENPVKYAEDNMEQKDTDRIIC

SEQ ID NO: 6874 - protein, 51 aa, Homo sapiens
  UNSURE 46: Xaa=Asn or Thr
MDGGTKWQRKREEERCLDAKRSLAGASQRRVQRLGSPTPGEDHLPXPSPFT

SEQ ID NO: 6875 - protein, 108 aa, Homo sapiens
  UNSURE 18: Xaa= *  or Arg
  UNSURE 22: Xaa=Gly or Trp
  UNSURE 84: Xaa=His or Gln
  UNSURE 101: Xaa=Ile or Leu
MLQLLGCQEGNRLRKVLXEKRXRDTEPGPDEFALNLKSVGPWTFLLWKPRRTSPPPSEASVDRVSGTCSVCTVSSPSFSIALSXPPGPATLNYRDTCCSCXQACTSSC

SEQ ID NO: 6876 - protein, 72 aa, Homo sapiens
MLSCPWFPLSCSPSLPLSIPDCLPAFLWPLGIPWPDGEGLRPSRLLRTRENITPLSLFAMLSGREGAPLLVP

SEQ ID NO: 6877 - protein, 52 aa, Homo sapiens
  UNSURE 13: Xaa=Ile or Lys or Met or Asn or Arg or Ser or Thr
MNAAVRAVTRMGXYVGAKVFLIYEGYEGLVEGGENIKQANWLSVSNIIQLGV

SEQ ID NO: 6878 - protein, 77 aa, Homo sapiens
MLSRSRCVSRAFSRSLSAFQKGNCPLGRRSLPGVSLCQGPGYPNSRKVVINNSVFSVRFFRTTAVCKDDLVTVKTPA

SEQ ID NO: 6879 - protein, 111 aa, Homo sapiens
  UNSURE 18: Xaa=Glu or Gly
MDVLLTYLPKNYAKSELXAVIFWRQNQTLDPNNMTILNRTFQDEPLIMDFNGDLIPDIFGITNESNQPQILLGGNLSWHPALTTTSKMRIPHSHAFIDLTEDFTADLFLTK

SEQ ID NO: 6880 - protein, 57 aa, Homo sapiens
  UNSURE 42: Xaa=Leu or Pro
  UNSURE 43: Xaa= *  or Lys
  UNSURE 46: Xaa=Phe or Leu
  UNSURE 52: Xaa=Ala or Glu
MINFTPSLLPFFMSYRENPLGSPLCMSVKFYLLSQHSHTFVXXLVXGSHTPXDTETH

SEQ ID NO: 6881 - protein, 85 aa, Homo sapiens [sequence omitted]

SEQ ID NO: 6882 - protein, 92 aa, Homo sapiens
MDSKKRSSTEAEGSKERGLVHIWQAGSFPITPERLPGWGGKTVLQAALGVKHGVLLTEDGEVYSFGTLPWRSGPVEICPSSPILENALVGQY

SEQ ID NO: 6883 - protein, 95 aa, Homo sapiens
MPPSPLDDRVVVALSRPVRPQDLNLCLDSSYLGSANPGSNSHPPVIATTVVSLKAANLTYMPSSSGSARSLNCGCSSASCCTVATYDKDNQAQTQ

SEQ ID NO: 6884 - protein, 104 aa, Homo sapiens
MAAGGGGGSSKASSSSASSAGALESSLDRKFQSVTNTMESIQGLSSWCIENKKHHSTIVYHWMKWLRRSAYPHRLNLFYLANDVIQNCKRKNAIIFRESFADVL

SEQ ID NO: 6885 - protein, 56 aa, Homo sapiens
MGYNLSPQFTQLLVSRYCPRSANPAMQLDRFIQVCTQLQVLTEAFREKDTAVQGNG

SEQ ID NO: 6886 - protein, 79 aa, Homo sapiens
  UNSURE 12: Xaa=Leu or Val
  UNSURE 43: Xaa=Gly or Ile or Met or Arg or Ser or Val
  UNSURE 64: Xaa=Cys or Gly
MLFSKHSFFTLXCGLDPSRNLLIGKRLQTPAVCVLQVHAAKVXPAHPCPVSVSFRVIPYLSIGXLILLDFLKTLRWSIR

SEQ ID NO: 6887 - protein, 70 aa, Homo sapiens
  UNSURE 18: Xaa=His or Gln
  UNSURE 19: Xaa=Gln or Arg
MVISSFGGLILSKTVSKXXYKGMAIFTPVICGVGGNLVAIQTSRISTYLHMWSAPGVLPLQMKKFWPNPC

SEQ ID NO: 6888 - protein, 55 aa, Homo sapiens
  UNSURE 15: Xaa=Lys or Arg
MRNQHEKMIKIHILXHEKALNGLDDALPYCGGQYALLSLQIQMLISSGNKLTDTP

SEQ ID NO: 6889 - protein, 108 aa, Homo sapiens
  UNSURE 31: Xaa= *  or Lys or Leu or Met or Pro or Gln or Arg or Ser or Thr or Trp
  UNSURE 37: Xaa=Ala or Asp or Gly or His or Asn or Pro or Arg or Ser or Thr
  UNSURE 43: Xaa=Asp or His or Ile or Leu or Asn or Val
  UNSURE 70: Xaa=Ala or Asp
  UNSURE 85: Xaa=Asp or Glu
MRQGPSVSVTTGSLTNGCRVAAGEGEEDCGXGGEPLXFFLVGXGRRGTGRQPRRPSACRSGAPSLKGCPXDLAPLSREKSLGERXDAATMVTQCPARRTQMLPSIKSS

SEQ ID NO: 6890 - protein, 89 aa, Homo sapiens
MKEICKTCPGTYRIYFAEALSYSIYICVTRDLLTKHIRKYLLGSISGLRPITVEQLSFLPTCKPWRCCLRLLQPFLLPWYFSNFVKTCT

SEQ ID NO: 6891 - protein, 80 aa, Homo sapiens
MKNHEKSKKHREMVALLKQQLEEEEENFSRPQIDENPLDDNSEEEMEDAPKQKVKYLTFRFIFALRLSKKQKKKKQKPAQ

SEQ ID NO: 6892 - protein, 92 aa, Homo sapiens
MKNNHSKSGTSTLRLLTTILHSDGDLTEQGKISKPDMSRLRLAAGSAIVKLAQEPCYHEIITLEQYQLCALAINDECYQVRQVFAQKLHKGQ

SEQ ID NO: 6893 - protein, 63 aa, Homo sapiens
  UNSURE 46: Xaa=Lys or Met or Arg or Thr
MPGAPCSQAGQEGRCPAQGLWYVFTGATSGRGRDRLANSKEARSEXVCFSFPSKSTGKLEGSP

SEQ ID NO: 6894 - protein, 54 aa, Homo sapiens
MDKNFVRIGKWFVRPYEKDEKPVNKSEHLSCAFTFFLHGESNVCTSVEIAPAPV

SEQ ID NO: 6895 - protein, 54 aa, Homo sapiens
  UNSURE 21: Xaa= *  or Tyr
  UNSURE 22: Xaa=Ile or Val
  UNSURE 46: Xaa=Asp or Asn
  UNSURE 50: Xaa=Asp or Glu
MTMDGDSSTTDASQLGISADXXGGSHYVIQPHDDTEDSMNDHEDTXGSKXSFRE

SEQ ID NO: 6896 - protein, 88 aa, Homo sapiens
  UNSURE 48: Xaa=His or Gln
  UNSURE 50: Xaa=Ala or Pro or Ser or Thr
MKITRQKHAKKHLGFFRNNFGVREPYQILLDGTFCQAALRGRIQLREXCXRYLMGETQLCTTRKLDIGFRCNAIKVPNQECAALEKEI

SEQ ID NO: 6897 - protein, 115 aa, Homo sapiens
MYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNAN

SEQ ID NO: 6898 - protein, 98 aa, Homo sapiens
  UNSURE 65: Xaa=Lys or Gln
  UNSURE 89: Xaa= *  or Ser
  UNSURE 93: Xaa=Ile or Leu
MMPQSLGVIGGKPNSAHYFIGYVGEELIYLDPHTTQPAVEPTDGCFIPDESFHCQHPPCRMSIAXLTRPSLWGFSVRLKMTSMIGASKXKSCXCLEVP

SEQ ID NO: 6899 - protein, 63 aa, Homo sapiens
MAATASPQPLATEDADSENSSFYYYDYLDEVAFMLCRKDAVVSFGKVFLPVFYSLIFVLGLSG

SEQ ID NO: 6900 - protein, 68 aa, Homo sapiens
MKGRERSHVSVPQTESRGSRRLLGARNQGSSLGLSMNWSRNASPFGMCVDKNVSRKFADPCSRLEKSN

SEQ ID NO: 6901 - protein, 63 aa, Homo sapiens
MKTEGNGVDTKAIKSFPAHLAADSDSPSTQLRAHELKFFPNDDPEAVSSPRTSDSLSRSKNSP

SEQ ID NO: 6902 - protein, 91 aa, Homo sapiens
  UNSURE 21: Xaa=Glu or Lys
  UNSURE 22: Xaa=Lys or Arg
  UNSURE 85: Xaa=Lys or Arg
MLYVTLLTLFNFQLLYHLERXXNKKKTKMIWGLTDSQHSQMIPALDSVHKLRWLRIFWTNTGMPLNGPAPVMEQWQTMKVQRCKXETEACS

SEQ ID NO: 6903 - protein, 80 aa, Homo sapiens
  UNSURE 28: Xaa=Ala or Pro or Ser or Thr
MLRFLAPRLLSLQGRTARYSSAAALPSXILNPDIPYNQLFINNEWQDAVSKKTFPTVNPTTGEVIGHVAEGDRADVDRGA

SEQ ID NO: 6904 - protein, 51 aa, Homo sapiens
MELALFDLDNTLLSGDSDFEWAQFLIGKGVLDREIQEAKNIEFYEQYKAGP

SEQ ID NO: 6905 - protein, 63 aa, Homo sapiens
  UNSURE 5: Xaa=Asp or Gly
  UNSURE 49: Xaa=Asn or Thr
  UNSURE 63: Xaa=Phe or Val
MELPXTNGAGVKSQRPFSPREALRSRAIIKPVIVDKDVKKIMGGSGTEXTLEKQKPVSKPGPX

SEQ ID NO: 6906 - protein, 98 aa, Homo sapiens
  UNSURE 59: Xaa=Asp or His
MLLMCNASPNPVVTEIFAVLTQGLMDIGLCRMCFVKNVFARSMLGKSHHPSLVSSTQGXNALSKATGTSAQERLGIVQGFSPLRQPETWPRGKGKTLP

SEQ ID NO: 6907 - protein, 62 aa, Homo sapiens
  UNSURE 4: Xaa=Ile or Met
  UNSURE 48: Xaa= *  or Cys or Asp or Glu or Gly or Tyr
  UNSURE 49: Xaa=Glu or Lys
  UNSURE 52: Xaa= *  or Lys or Arg
  UNSURE 59: Xaa=Asp or Phe or His or Ile or Leu or Asn or Val or Tyr
MIIXIKKTALPSRQLYMAWNFKNFNINFHPVSFITFTFQNFVYFPVNXXHFXRYQWDRXGFL

SEQ ID NO: 6908 - protein, 57 aa, Homo sapiens
MLSVLHPLSCTHFPTFPSEMNPVPQLEMQKSHIFCIAHAWSCRLELFLFGHLGSTPR

SEQ ID NO: 6909 - protein, 58 aa, Homo sapiens
MISAHCNFCLPGSGESPATATQVAGTTGACHHAQLIFVFLVKTGFHHVGQDGLNLLTT

SEQ ID NO: 6910 - protein, 58 aa, Homo sapiens
  UNSURE 2: Xaa=Lys or Arg or Thr
  UNSURE 45: Xaa=His or Asn
MXLVLIGHSIGSYFTLQMLKRVPELPVIRAFLLFPTIERMSESPXGRIATPLLCWFRY

SEQ ID NO: 6911 - protein, 55 aa, Homo sapiens
  UNSURE 6: Xaa=Lys or Gln
  UNSURE 8: Xaa=Gly or Ser
  UNSURE 26: Xaa=Lys or Gln
  UNSURE 28: Xaa=Lys or Thr
  UNSURE 40: Xaa= *  or Tyr
MPTNRXSXVFKCDTYTPQNTKKPPRXIXHRNKIMPSAATXDRTAGHSAKRTQART

SEQ ID NO: 6912 - protein, 64 aa, Homo sapiens
MRPLGKGLLPAEELIRSNLGVGRSLRDCLSQSGKLAEELGSKRLKPAKFGTEGKERVEQRTERP

SEQ ID NO: 6913 - protein, 68 aa, Homo sapiens
MPPPQRNSFFFIIYLFNNRDEVSPCCPGWCQSPGLKQSICPGSPKCWDYCRKPPYLAKKFIHFFFFFF

SEQ ID NO: 6914 - protein, 60 aa, Homo sapiens
MTRIYPLHLSPIPVSRNTLAWKVSVPLTNLYRWVTVWELMAHSFSLKQMHSGKLQQQTYP

SEQ ID NO: 6915 - protein, 78 aa, Homo sapiens
  UNSURE 31: Xaa=Ile or Ser
  UNSURE 33: Xaa=Pro or Arg
MSDHGDVSLPPEDRVRALSQLGSAVEVNEDXPXRRYFRSGVEIIRMASIYSEEGNIEHAFILYNKYITLFIEKLPKHR

SEQ ID NO: 6916 - protein, 69 aa, Homo sapiens
  UNSURE 7: Xaa=Leu or Arg
  UNSURE 8: Xaa=Ala or Thr
MADPDVXXEVPAALKRLAKYVIRGFYGIEHALALDILIRNSCVKEEDMLELLKFDRKQLRSVLNNLKGD

SEQ ID NO: 6917 - protein, 67 aa, Homo sapiens
  UNSURE 28: Xaa=Leu or Met
  UNSURE 29: Xaa=Leu or Val
  UNSURE 30: Xaa= *  or Cys
MVEFIVTHMMKEFPMDLYIRCIQVVHKXXXYQKKCRVRLHYTWRELWSALINLLKFLMSNETVLLAK

SEQ ID NO: 6918 - protein, 55 aa, Homo sapiens
  UNSURE 14: Xaa= *  or Cys or Trp
  UNSURE 15: Xaa=Cys or Gly or Arg or Ser
  UNSURE 32: Xaa=Pro or Thr
MQSPAWKLCSGNFXXRPGYSCRARTASEVPGXETKARRLSVHVCICVLVCVCVCE

SEQ ID NO: 6919 - protein, 86 aa, Homo sapiens
  UNSURE 59: Xaa=His or Asn or Arg or Ser
MASTSTTIRSHSSSRRGFSASSARLPGVSRSGFSSVSVSRSRGSGGLGGACGGAGFGSXSLYGLGGSKRISIGGGSCAISGGYGSR

SEQ ID NO: 6920 - protein, 70 aa, Homo sapiens
  UNSURE 65: Xaa=Ser or Thr
MGPWKLHFKKPSGGFRIFFGLGHLVRISGGDNISAELCNPSWFPHCLWNFSCSFPPPQLCPGSAXPSNAQ

SEQ ID NO: 6921 - protein, 77 aa, Homo sapiens
MKGKNTIICAPTGCGKTFVSLLICEHHLKKFPQGQKGKVVFFANQIPVYEQQKSVFSKYFERHGYRVTGISGATAEK

SEQ ID NO: 6922 - protein, 64 aa, Homo sapiens
  UNSURE 29: Xaa=Glu or Lys
  UNSURE 35: Xaa=Asp or Glu or Val
MSTAMNFGTKSFQPRPPDKGSFPLDHLGXCKSFKXKFMKCLHNNNFENALCRKESKEYLECWIE

SEQ ID NO: 6923 - protein, 78 aa, Homo sapiens [sequence omitted]

SEQ ID NO: 6924 - protein, 51 aa, Homo sapiens
  UNSURE 15: Xaa=Cys or Phe
  UNSURE 35: Xaa= *  or Ser
MPKYIHLCMVQFLIXMYSINSVFSLFKQTVVSSEXVICDLRWFHFVKLSLS

SEQ ID NO: 6925 - protein, 147 aa, Homo sapiens
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGD

SEQ ID NO: 6926 - protein, 52 aa, Homo sapiens
MWVTKRPVPVKQNAGVMIIHVYGLPGHTLIWVVLQRSKQPIPVFIKLILQLE

SEQ ID NO: 6927 - protein, 91 aa, Homo sapiens
  UNSURE 77: Xaa=Asp or His or Asn
MVHAASDPSSSSGRLSEPDPSHTLEERVVHWYFKLLDKNSSGDIGKKEIKPFKRFLRKKSKPKKCVKKFVEYCDVNXDKSISVQELMGCLG

SEQ ID NO: 6928 - protein, 98 aa, Homo sapiens
  UNSURE 74: Xaa=Leu or Val
MSDGGFHEAQINNMEMAPGGVITSDMIEMIFSKSPEQQLSATQKFRKLLSKEPNPPIDEVISTPGVVARFVEFXKRKENCTLQAVWALGNIAGDSTMC

SEQ ID NO: 6929 - protein, 55 aa, Homo sapiens
MLLMHYLLPKDFPSRKVYFDRLVCGFCGILNHFSVTYSPSLPTGPTSKKNLKLSH

SEQ ID NO: 6930 - protein, 62 aa, Homo sapiens
MVMACRVVNKRRHMGLQQLSSFAETGRTFLDPLKSSKFIIDEECHESVLISSTVRLLESLDL

SEQ ID NO: 6931 - protein, 149 aa, Homo sapiens
  UNSURE 10: Xaa=Leu or Arg
  UNSURE 118: Xaa=Ala or Glu or Val
  UNSURE 131: Xaa=Lys or Asn
MCNPEEAALXGLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKXAKRRSEFWRGQRXALRQLLSGVSSEGSVGAS

SEQ ID NO: 6932 - protein, 52 aa, Homo sapiens
MIDWIKKMWHIYTMEYYAAIKNDEFMSFVGTWMKLETIILSKLSQGQKTKHR

SEQ ID NO: 6933 - protein, 53 aa, Homo sapiens
MHVSTAYAYCNRKHIDEVVYPPPVDPKKLIDSLEWMDDGLVNDITPKLIGDRP

SEQ ID NO: 6934 - protein, 56 aa, Homo sapiens
  UNSURE 33: Xaa=Lys or Arg
  UNSURE 38: Xaa=Asp or Glu
  UNSURE 42: Xaa= *  or Cys
  UNSURE 44: Xaa=Ile or Ser
  UNSURE 46: Xaa=Asp or Asn
MFQGPVIRFEVYKCFWYQDLSAIARACWCPGIXLQTTXHCVXSXRXYCEIHGIWLD

SEQ ID NO: 6935 - protein, 105 aa, Homo sapiens
MTARTLSLMASLVAYDDSDSEAETEHAGSFNATGQQKDTSGVARPPGQDFASGTLDVPRAGAQPTKHGFCEDPGGYRLPLAQLGRSDRGSCPSQRLQWPGKEPQS

SEQ ID NO: 6936 - protein, 67 aa, Homo sapiens
  UNSURE 58: Xaa=Asp or Glu or Val
MPKCVKFGWFLPYTPTDNEYGAWKRHYIACVSHLDWLTPREAAATYGTLNEPKTEDEXLLERQREKC

SEQ ID NO: 6937 - protein, 51 aa, Homo sapiens
MLSLGKNHPGLMPEPNRPDPAGLSRSQVQTDGTDLSGHHRDVEARVKSWST

SEQ ID NO: 6938 - protein, 77 aa, Homo sapiens
  UNSURE 8: Xaa=Ala or Asp or His or Asn or Pro or Thr
MKEEEGFXEDEATESEKNFKFGKRVGCLSEVPESYVETSASGGTVSLIAFTTMALLTIMEFSVYQDTWMKYEYEVDS

SEQ ID NO: 6939 - protein, 75 aa, Homo sapiens
  UNSURE 7: Xaa=Gln or Arg
  UNSURE 8: Xaa=Arg or Ser
  UNSURE 9: Xaa=Ala or Glu
  UNSURE 12: Xaa=His or Gln
  UNSURE 23: Xaa= *  or Cys
  UNSURE 24: Xaa= *  or Lys
  UNSURE 26: Xaa=Glu or Val
  UNSURE 36: Xaa= *  or Lys
  UNSURE 42: Xaa=Phe or Tyr
  UNSURE 45: Xaa=Phe or Ile
  UNSURE 55: Xaa= *  or Tyr
MYTGESXXXLFXNLKLVYIMVVXXSXPSPQDAVGCXFVGRVXSWXFLTEAHSTGXFFVGVFNEAYKWQKQKASKT

SEQ ID NO: 6940 - protein, 60 aa, Homo sapiens
  UNSURE 48: Xaa= *  or Lys or Gln
MSAVNCSFHKHFIHDLKYCAIIGTTELQNYFKIVPYLLDIPFSAVFKXTPGVGWGRETQL

SEQ ID NO: 6941 - protein, 71 aa, Homo sapiens
  UNSURE 70: Xaa=Glu or Gly or Lys or Arg
MAEKKSKKKVEEEEEDGVNMENFQEFIRQASEAELEEVLTFYTQKNKSASVFLGTHSKISKNNNNYSDSXA

SEQ ID NO: 6942 - protein, 67 aa, Homo sapiens
  UNSURE 45: Xaa=Asp or Glu
  UNSURE 46: Xaa= *  or Glu or Gly
MWCPLVTSVSCVIKMVCHAIHSNMLFCIFPQDVPTGPPEGETQSXXLNSSLFSPHHLRLSFVIVTSE

SEQ ID NO: 6943 - protein, 57 aa, Homo sapiens [sequence omitted]

SEQ ID NO: 6944 - protein, 65 aa, Homo sapiens
MPANSGLALRLLQHEWEESNVQILKLQAKMFTYNIPTCLATWKIAIAAEIVLKGQREVHRLYQRA

SEQ ID NO: 6945 - protein, 124 aa, Homo sapiens
MGLPKLNARLKDETLQPFFEGLLPRDNPRNTRFAINFFTSIGLGGLTDELREHLKNTPKVIVAQKPDVEQNKSSPSSSSSASSSSESDSSDSDSDSSDSSSESSSEESDSSSISSHSSASANDV

SEQ ID NO: 6946 - protein, 59 aa, Homo sapiens
MGTGFDVNIVEEELGIISRAVKHLFKSIEEKKHIAIKNGLPAPDFKVNAQFLELYNEEV

SEQ ID NO: 6947 - protein, 79 aa, Homo sapiens
  UNSURE 42: Xaa=Arg or Ser
  UNSURE 43: Xaa=His or Asn
MLTLLWDRGSSWTLHLSHQILGDAGQMLHAFRGFQRWPGCCXXEDIQGDWTKEEPYYVNCQRSRSQAKVTCCLPHLPPG

SEQ ID NO: 6948 - protein, 73 aa, Homo sapiens [sequence omitted]

SEQ ID NO: 6949 - protein, 104 aa, Homo sapiens
  UNSURE 102: Xaa=His or Asn
MNTWSLHKPEDYPQTAVSVVMETTAFEATKAPLGHRALLAFQETMETMATMEPLVMKEPKVRRATKVTWGLEGSGGSMAPKERRATRGFHQNFRLHSWLLWXPL

SEQ ID NO: 6950 - protein, 74 aa, Homo sapiens
MTSLFAQEIRLSKRHEEIVSQRLMLLQQMENKLGDQHTEKASQLQTVETAFKRNLSLLKDIEAAEKSLQTRIHP

SEQ ID NO: 6951 - protein, 70 aa, Homo sapiens
MTSLFAVVLQREKEPHLWLSSPHIRFSLRVNKLSELMLQLLQFKAFPSSLVPFFLFTCFGHFPSFTTFQG

SEQ ID NO: 6952 - protein, 104 aa, Homo sapiens
MAAASPLRDCQAWKDARLPLSTTSNEACKLFDATLTQYVKWTNDKSLGGIEGCLSKLKAADPTFVMGHAMATGLVLIGTGSSVKLDKELDLAVKTMVEISRTHA

SEQ ID NO: 6953 - protein, 144 aa, Homo sapiens
  UNSURE 9: Xaa= *  or Cys or Trp
  UNSURE 10: Xaa=Leu or Met or Val
  UNSURE 72: Xaa=Glu or Val
  UNSURE 110: Xaa=Asp or His or Asn or Tyr
  UNSURE 132: Xaa=Asn or Thr
MYTTVVYCXXFVFGRGGGMGDRFSLLSPRPECNGVILAHCNLRLSGSTHSPVSASGVAGITGMHHHAQLIFXFLVETGFHHVGQAGLELLTSGDPPASASQSAEVTGVSXHTWPALCYFYLVAFTQVFLVEXIQVIKAVILNTI

SEQ ID NO: 6954 - protein, 69 aa, Homo sapiens
  UNSURE 37: Xaa=His or Gln
MKRRLQQDKVLITELIQHSAKHKVDIDCSQKVVVYDXSSQDVASLSSDCFLTVLLGKLEKSFNSVHLLA

SEQ ID NO: 6955 - protein, 93 aa, Homo sapiens
MQKYEQKIRHFGMLSRWDDSQRFLSDHPYLVCEETAKYLILWCFHLEAEKKGALMEQIAHQAVVMQFIMEMAKNCNVDPRGCFRLFFQKAKAE

SEQ ID NO: 6956 - protein, 54 aa, Homo sapiens [sequence omitted]

SEQ ID NO: 6957 - protein, 63 aa, Homo sapiens [sequence omitted]

SEQ ID NO: 6958 - protein, 54 aa, Homo sapiens
  UNSURE 18: Xaa=Lys or Gln
  UNSURE 31: Xaa=Ala or Val
  UNSURE 33: Xaa= *  or Cys
  UNSURE 39: Xaa=Ala or Glu
  UNSURE 43: Xaa=Pro or Gln
  UNSURE 44: Xaa=His or Leu or Gln
  UNSURE 52: Xaa=Glu or Lys
MDGNRPSPGPISSHIFCXGGNQFCREKYLPXPXKDQCQXILVXXFWLLHVKXPV

SEQ ID NO: 6959 - protein, 66 aa, Homo sapiens [sequence omitted]

SEQ ID NO: 6960 - protein, 55 aa, Homo sapiens
MMCQCRFIKCNKYTTLLRLFIMEEATQVLGRGYNLYLPLSFAVNLKLLLKRLYMT

SEQ ID NO: 6961 - protein, 76 aa, Homo sapiens
MSAEWVSKANAKQRKGRAGRVQPGHCYHLYNGLRASLLDDYQLPEILRTPLEELCLQIKILRLGGIAYFLSRLMDH

SEQ ID NO: 6962 - protein, 61 aa, Homo sapiens
MPYIPLMEFSCSHSHLVCLPAEWRTSCMPSSKMKEMSSLFPEDWYQFVLRQLECYHSEEKA

SEQ ID NO: 6963 - protein, 126 aa, Homo sapiens
  UNSURE 92: Xaa=Met or Arg
  UNSURE 103: Xaa=Lys or Arg
MTMYKSKRRHQRYINMAGEPKPYRPKPGNKRPLSALYRLESKEPFLSVGGYVFDYDYYRDDFYNRLFDYHGRVPPPPRAVIPLKRPRVAVTXTRRGKGVFSMXGGSRSTASGSTGSKLKSDELQTI

SEQ ID NO: 6964 - protein, 86 aa, Homo sapiens
MASSVAPYEQLVRQVEALKAENSHLRQELRDNSSHLSKLETETSGMKEVLKHLQGKLEQEARVLVSSGQTEVLEQLKALQMDITSL

SEQ ID NO: 6965 - protein, 60 aa, Homo sapiens
  UNSURE 46: Xaa=Lys or Arg
MTVTVKKTVPSPEAVQILYQRMRYEYEFYHYVKEQFHLLKRKFGLXSHVSKPPLRPHFFI

SEQ ID NO: 6966 - protein, 72 aa, Homo sapiens
METLIECQSEGDIKEHPLLASCESEDSICQLIEVKKRKKVLSWPFLMRRLSPASDFSGALETDLKASLFDQP

SEQ ID NO: 6967 - protein, 56 aa, Homo sapiens
MEELDRKWREKVLPAAKLIKRRNLFSTCTPQYGTHAAFLSLHASLVTKAFSINSWE

SEQ ID NO: 6968 - protein, 78 aa, Homo sapiens
  UNSURE 15: Xaa=His or Asn or Pro or Thr
MAYGSASQLLRTYFXEGMSETLIRNILFGAVRGLNYLHQNGCIHRSIKASHILISGDGLVTLSGLSHLHSLVKHGQRQ

SEQ ID NO: 6969 - protein, 51 aa, Homo sapiens
  UNSURE 12: Xaa=Glu or Gly
  UNSURE 13: Xaa=Asp or Glu
MKAKKGMLKGLXXMFRFGKHRKDDKIEKTGKIKIQESFTSEEERIRMKQEQ

SEQ ID NO: 6970 - protein, 117 aa, Homo sapiens
  UNSURE 5: Xaa=Gly or Val
  UNSURE 7: Xaa=Phe or Tyr
  UNSURE 9: Xaa=Asp or Asn
  UNSURE 94: Xaa= *  or Cys or Phe or Leu or Trp or Tyr
MSCLXNXLXVLFSTASIMHLCAISVDRYIAIKKPIQANQYNSRATAFIKITVVWLISIGIAIPVPIKGIETDVDNPNNITCVLTKERFGDFMLXGSLAAFFTPLAIMIVTYFLTIHA

SEQ ID NO: 6971 - protein, 80 aa, Homo sapiens
  UNSURE 70: Xaa=Phe or Leu
  UNSURE 71: Xaa=Ile or Leu or Val
MVILWTMETSSEYADFPLLTLPSLWLLLPDKGQGHLKTLPPVGFGVTGASACSHIFQKGSALRTSLYLGXXIPLAVLTSS

SEQ ID NO: 6972 - protein, 52 aa, Homo sapiens
  UNSURE 5: Xaa=Phe or Leu or Val
MLFGXRFDWPVAISLETCVFTRHEESFSFQLELYHQPKGEECPNAYQVLRLG

SEQ ID NO: 6973 - protein, 55 aa, Homo sapiens
MFRTFNSKRKRVSIEKWSCLLSNRHVSFIYKRSKLNGFFPPSREVAFETRISLLT

SEQ ID NO: 6974 - protein, 86 aa, Homo sapiens
  UNSURE 79: Xaa= *  or Cys or Ser or Trp or Tyr
MSRLEAKKPSLCKSEPLTTERVRTTLSVLKRIVTSCYGPSGRLKQLHNGFGGYVCTTSQSSALLSHLLVTHPILKILTXSIQNHVS

SEQ ID NO: 6975 - protein, 122 aa, Homo sapiens
  UNSURE 65: Xaa=Glu or Lys
  UNSURE 81: Xaa=Asp or His
  UNSURE 113: Xaa=Ser or Thr
MVLVSWIMWYVPVGIMFLVGSKIVEMKDIIVLVTSLGKYIFASILGHVIHGGIVLPLIYFVFTRXNPFRFLLGLLAPFATXLLPAPGEWVLGLFTALSHVNMEPGEPSGRCTXSVLTYFNSW

SEQ ID NO: 6976 - protein, 81 aa, Homo sapiens
  UNSURE 66: Xaa=Cys or Arg
  UNSURE 68: Xaa=Lys or Met
  UNSURE 72: Xaa=Gly or Ser
MASKYVKRCLVSLVITEIKTTMRYHFIPTGMVVIKRTKITGFDEDVQKLEPLYIACINTNWWYSCXGXQFGXPQKVNIKAG

SEQ ID NO: 6977 - protein, 53 aa, Homo sapiens
  UNSURE 19: Xaa=Phe or Ile or Asn or Tyr
MLFYLFKMEFHSSPRLECXGTISAHCNLLLVGSKSFSCLNLPSSWDWRRTPPP

SEQ ID NO: 6978 - protein, 61 aa, Homo sapiens
  UNSURE 47: Xaa=Ala or Cys or Asp or Phe or Gly or Ser or Val or Tyr
MQSPFSFPLSLHFGKFFLTVLPTNFFKCSSLCAVGTKIWPQVVTFLXFSLIDNPQKSVNGM

SEQ ID NO: 6979 - protein, 67 aa, Homo sapiens
MQFLPSLDGLYILACFCSGWYRFFLSMFSASFRSSFRVGLVVTKSLNICLSVKYFISPSLMKLSLAG

SEQ ID NO: 6980 - protein, 97 aa, Homo sapiens
MDLKAKMPDDHARKILLSRINNYTIPEEEIGSFLFHAINKPNAPIWLILNEAGLYWRAVGNSTFAIACLQRALNLAPLQYQDVPLVNLANLLIHYGQ

SEQ ID NO: 6981 - protein, 86 aa, Homo sapiens
  UNSURE 80: Xaa=Lys or Asn
MDEAKILKSLHHPNIVGYRAFTEANDGSLCLAMEYGGEKSLNDLIEERYKASQDPFPAAIILKVALNMARGLKYLHQEKXLLHGDI

SEQ ID NO: 6982 - protein, 68 aa, Homo sapiens
MASPANSFVGTPYWMAPEVILAMDEGQYDGKVDIWSLGITCIELAERKPPLFNMNAMSALYHIAQNDS

SEQ ID NO: 6983 - protein, 61 aa, Homo sapiens
MRQKNRLNPGGGGCGEPRSRHCTPAWRLSDTPSPSPRPKKNLFSGERQGRSFQPDWGRREE

SEQ ID NO: 6984 - protein, 72 aa, Homo sapiens [sequence omitted]

SEQ ID NO: 6985 - protein, 74 aa, Homo sapiens
  UNSURE 67: Xaa=Asp or Glu
MEKEKGNDDGIPDQENSLDFSEHFNQLELLETHGHLIPTGTQSLWVGNSDEDEEQDDKNEEWYRLQXKKMEKDP

SEQ ID NO: 6986 - protein, 119 aa, Homo sapiens
  UNSURE 58: Xaa=Asp or Glu
  UNSURE 59: Xaa= *  or Ile or Lys or Leu
  UNSURE 80: Xaa=Leu or Ser or Trp
  UNSURE 81: Xaa=Glu or Gln
MIVSLVEDYPNYMIINLDKLDYCASLKNLETISNKQNYKFIQGDICDSHFVKLLFETXXIDIVLHFAAQTHVDLSFVRAXXFTYVNVYGTHVLVSAAHEARVESLFMSAQMKYMVAVLI

SEQ ID NO: 6987 - protein, 109 aa, Homo sapiens
MLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDR

SEQ ID NO: 6988 - protein, 100 aa, Homo sapiens
  UNSURE 49: Xaa=Cys or Phe or Gly or Ile or Leu or Arg or Ser or Val
MAASAFAGAVRAASGILRPLNILASSTYRNCVKNASLISALSTGRFSQXQTPVVSSTPRLTTSERNLTCGHTSVILNRMAPVLPSVLKLPVRSLTYFSAR

SEQ ID NO: 6989 - protein, 61 aa, Homo sapiens
MWRPNEEGRGLRPFGQGSRVAGGSLLSTLAKVLLDSEAPTSRLAVKAIFKMTCFQASGRRP

SEQ ID NO: 6990 - protein, 60 aa, Homo sapiens
  UNSURE 28: Xaa=Asp or Glu
  UNSURE 50: Xaa=Lys or Asn
  UNSURE 53: Xaa=Leu or Met
MLCLGPAEKEKRDKASQEGGDVLGARQXCTPPLKSLVATGNLLDLEETAXAPXSTVSANT

SEQ ID NO: 6991 - protein, 94 aa, Homo sapiens
MEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPE

SEQ ID NO: 6992 - protein, 52 aa, Homo sapiens
  UNSURE 46: Xaa=His or Leu
MALGLENTVAGFKNSFHTCQTKNLSAHVVWLVNSACQEEAVPPHQXSSQDDH

SEQ ID NO: 6993 - protein, 75 aa, Homo sapiens
MPLPFFLLHQALSMPLFLFLSYIINYCVHIGVWNHESVLSRKNHGTERIDSDFIRSTLVTARFYKVLNGYTFVPK

SEQ ID NO: 6994 - protein, 59 aa, Homo sapiens
MPQCNAFLSKIMTSLLSPPHRRPTLHRRPTLPYRTWEAALRQKVQQWYTAVGQTENPDI

SEQ ID NO: 6995 - protein, 53 aa, Homo sapiens
MVPSAAASQNPESEKRNTCVLREQIVAQYPSLKRESEKIIENFKKKMKVKNGD

SEQ ID NO: 6996 - protein, 80 aa, Homo sapiens
  UNSURE 75: Xaa=Cys or Asp or Gly or Tyr
MQKGSQGCALPHPLPGASLPAQPGPADHRGWECRIGEKLTAELGKFWVRGHSAACQRTLCLCSGRRGSLWTAAGXYLILN

SEQ ID NO: 6997 - protein, 113 aa, Homo sapiens
MEVWDVKNYKLISKPVASDSTYFAWCPDGEHILTATCAPRLRVNNGYKIWHYTGSILHKYDVPSNAELWQVSWQPFLDGIFPAKTITYQAVPSEVPNEEPKVATAYRPPALRN

SEQ ID NO: 6998 - protein, 55 aa, Homo sapiens
  UNSURE 7: Xaa= *  or Leu
MVSFSSXNISIRAVFEVSAKSGPSQSQFLLPTFFLYVGHTFFCACLKFFCLKPDL

SEQ ID NO: 6999 - protein, 52 aa, Homo sapiens
  UNSURE 2: Xaa=Phe or Tyr
  UNSURE 6: Xaa=Ile or Val
  UNSURE 7: Xaa=Met or Val
  UNSURE 9: Xaa=Glu or Gly
MXLTIXXCXMVAALSAIRANCHQEPSVCLQAACPESWIGFQRKCFYFSDDTK

SEQ ID NO: 7000 - protein, 103 aa, Homo sapiens
  UNSURE 28: Xaa=Ala or Glu
MECPSCQHVSKEETPKFCSQCGERLPPXAPIADSENNNSTMASASEGEMECGQELKEEGGPCLFPGSDSWQENPEEPCSKASWTVQESKKKKRKKKKKGNKSA

SEQ ID NO: 7001 - protein, 64 aa, Homo sapiens [sequence omitted]

SEQ ID NO: 7002 - protein, 73 aa, Homo sapiens
  UNSURE 18: Xaa= *  or Ala or Glu or Gly or Lys or Leu or Met or Pro or Gln or Arg or Ser or Thr or Val or Trp
MSLVVMDVKIEQVICKVXLKHKICKLCQAPISACLHCSFVRKHMSDCEKLMQTCYTPSHVGGNTSSSPQSPRP

SEQ ID NO: 7003 - protein, 70 aa, Homo sapiens
MEKKQSRKTGNSKNQSASPPPKEHSSSPATEQSWTESDFDELREEGFRRSNYSELKEEVRTHGKEVKNLG

SEQ ID NO: 7004 - protein, 78 aa, Homo sapiens [sequence omitted]

SEQ ID NO: 7005 - protein, 106 aa, Homo sapiens
  UNSURE 60: Xaa=Ile or Lys or Arg
  UNSURE 86: Xaa= *  or Cys or Trp or Tyr
  UNSURE 87: Xaa= *  or Glu
MPSSENEKAVSPKKALLPPTVSLSATSTSSEPLSSNQPASVTDYQNVSFSNLTVNTSWQXKSAFTRTVSPGSVSPIHGQGQVVETXXAQALCSWTAKKIPLELLKH

SEQ ID NO: 7006 - protein, 53 aa, Homo sapiens
MILTEEILQVFTAKPKEMRVNSKWPTQRSMDYVETWTIAAISQWCSFQVFYPR

SEQ ID NO: 7007 - protein, 63 aa, Homo sapiens
  UNSURE 18: Xaa=Phe or Leu
  UNSURE 22: Xaa=Asp or Glu
  UNSURE 25: Xaa=Ser or Thr
  UNSURE 34: Xaa= *  or Lys
  UNSURE 44: Xaa= *  or Lys or Asn or Tyr
  UNSURE 45: Xaa= *  or Lys
  UNSURE 52: Xaa= *  or Lys
  UNSURE 55: Xaa=Ile or Lys or Arg or Thr
  UNSURE 56: Xaa=Asp or Val
MTYGSVFNNTVSISKGIXMQVXLQXSMLTYNTWXMMHKNIFIPXXPDYDPEXALXXSLQPYEA

SEQ ID NO: 7008 - protein, 115 aa, Homo sapiens
  UNSURE 30: Xaa=His or Asn
  UNSURE 67: Xaa=His or Gln
  UNSURE 68: Xaa=His or Asn
  UNSURE 93: Xaa=Ile or Val
  UNSURE 97: Xaa=His or Asn
  UNSURE 102: Xaa=Lys or Gln
  UNSURE 106: Xaa=His or Gln
  UNSURE 107: Xaa=His or Asn
MNWNEKPKSATLPPLYPKSQPPFLHQSLIXQITTTSQSSFSYPGSNQEACMYPGNSNPISQPLLNIXXYPQQISVSDMHNGTVVASHTSVERXTYAXVNGPXQLTXXLQMSSGVT

SEQ ID NO: 7009 - protein, 145 aa, Homo sapiens
  UNSURE 3: Xaa=Pro or Arg
  UNSURE 7: Xaa=Leu or Pro
  UNSURE 31: Xaa=His or Gln
  UNSURE 128: Xaa=Gly or Ser
  UNSURE 133: Xaa=Cys or Trp
  UNSURE 134: Xaa= *  or Leu
MGXLALXAWLQPRYRKNAYLFIYYLIQFCGXSWIFANMTVRFFSFGKDSMVDTFYAIGLVMRLCQSVSLLELLHIYVGIESNHLLPRFLQLTERIIILFVVITSRRGSPTRNMWCVCYSSLDLWIWLXTLIAXXSVIGISYAVLT

SEQ ID NO: 7010 - protein, 88 aa, Homo sapiens
  UNSURE 32: Xaa=Asp or Glu
MFNDTLELFLIGNDSYPIPIALKKKGIAWWTXKNVKFRNPPGGDNLEERFKGTTKPVNWLKPVYMLDSDPDNNGFINEDFIVWMRTAA

SEQ ID NO: 7011 - protein, 94 aa, Homo sapiens
MGRRRPAPFRALVRLACRMAGQPGHMPHGGSSNNLCHTLGPVHPPDPQRHPNTLSFRCSLADFQIEKKIGRGQFSEVYKATCLLDRKTVALKKV

SEQ ID NO: 7012 - protein, 60 aa, Homo sapiens
MLPGFLHRLLAEIRYLVEKPKYKKALGTKTFRIHTPPAKANCVAWLGGAIFGALQDILGS

SEQ ID NO: 7013 - protein, 136 aa, Homo sapiens
  UNSURE 130: Xaa=Lys or Met or Arg or Thr
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMXFINDQH

SEQ ID NO: 7014 - protein, 57 aa, Homo sapiens [sequence omitted]

SEQ ID NO: 7015 - protein, 51 aa, Homo sapiens
MTHSGKFYRTTSLRQRPVRNNLFFRLPTTQTQSQSTGHYHPPPCRNNYPAS

SEQ ID NO: 7016 - protein, 60 aa, Homo sapiens
  UNSURE 48: Xaa=Asp or Glu
MNTNDFSFPDSRNTKKKQLPQMDRNRKYPWLNTEAWFQPSLDVGRNSXPLSYLIPNPFPT

SEQ ID NO: 7017 - protein, 82 aa, Homo sapiens
MEEEQIIKEDSCHRLSPVKGEFHQEFQPEPSLLGDSTNSGEERDQFTDRADGLHSEFMNYKARAEDCEELLRIEEDVHWQTE

SEQ ID NO: 7018 - protein, 53 aa, Homo sapiens
MVLWILWRPFGFSGRFLKLESHSITESKSLIPVAWTSLTQMLLEAPGIFLLGL

SEQ ID NO: 7019 - protein, 76 aa, Homo sapiens
  UNSURE 70: Xaa=Asp or His or Asn
MKALFKKKTYDEKKTYDQQKFDSERADGTISSEIKSARGSHHLSIYAENSLKSDGYHKRTDRKSRIIAKXVSTSKP

SEQ ID NO: 7020 - protein, 71 aa, Homo sapiens
MGCLPYPLQNKNLPDPRMLKAFFSSELQKACKTHGGWGVGGLLQGMELAVIYFDFSYRSCFRAVGTFIPWA

SEQ ID NO: 7021 - protein, 86 aa, Homo sapiens
  UNSURE 42: Xaa=Ile or Met
  UNSURE 77: Xaa= *  or Gly or Leu or Val
  UNSURE 78: Xaa=Asn or Thr
MGAAVASGTAKGARRRRQNNSAKQSWLLRLFESKLFDISMAXHTCITPRSLEYKPTLATGSSAFATRTWTSICPSCXXMYIHMDED

SEQ ID NO: 7022 - protein, 103 aa, Homo sapiens
MIDDPSKGKEALAESGGLVGAGNGVFFPSTEAFWDGGAVLASRGLELAGSSVPCCERFQDFDLAQPASLHPTCATAFSQCDVECYSMSLYFPLLFLVMGTLEP

SEQ ID NO: 7023 - protein, 52 aa, Homo sapiens
  UNSURE 6: Xaa=Pro or Ser
MGDDRXFVCNAPGCGQRFTNEDHLAVHKHKHEMTLKFGPARTDSVIIADQTP

SEQ ID NO: 7024 - protein, 102 aa, Homo sapiens
  UNSURE 39: Xaa=Ala or Asp or Asn or Thr
MDGMLMVFEQESYAFGRFLPGFLLPGPLAYSSRTDSFLXVSSCQQVESYKYQVLAFATDADKRQETEQQKLGSGKRLVVDWTLNIGEQALDICIVSFNQSAC

SEQ ID NO: 7025 - protein, 73 aa, Homo sapiens
  UNSURE 24: Xaa=Leu or Val
MKILKKEVIIAKDEVAHTLTESRXLKNTRHPFLTSLKYSFQTKDRLCFVMEYVNGGELFFHLSRERVFSEDRH

SEQ ID NO: 7026 - protein, 104 aa, Homo sapiens
MIYEEDAEEWALYLTEVFLHVVKREAILLYRLENFSFRHLELLNLTSYKCKLLILSNSLLRDLTPKKCQFLEKILHSPKSVVTLLCGVKSSDQLYELLNISQSR

SEQ ID NO: 7027 - protein, 80 aa, Homo sapiens
  UNSURE 4: Xaa=Arg or Thr
  UNSURE 27: Xaa=Asp or His
  UNSURE 50: Xaa=Asp or Glu
MFVXESLQLREQQQQQQQQQQKHEDGXSNGTFFVYHAIYLEELTAVELTXKIAQLFSISPCQISQIYKQGPTGIHVLISD

SEQ ID NO: 7028 - protein, 63 aa, Homo sapiens
  UNSURE 51: Xaa=Ala or Gly
MLRKQPREMNTAEDWGLILDICDKVGQSRTGPKDCLRSIMRRVNHKDPHVXMQALTLLGACVS

SEQ ID NO: 7029 - protein, 105 aa, Homo sapiens
  UNSURE 11: Xaa=Arg or Ser
  UNSURE 12: Xaa= *  or Glu
MDEAQIAAVCXXSLQALEFLHANQVIHRDIKSDSVLLGMEGSVKLTDFGFCAQITPEQSKRSTVVRTPYWMAPEVVTRKAYGPKVNVWSLGIMATEMVEGEPPYP

SEQ ID NO: 7030 - protein, 147 aa, Homo sapiens
  UNSURE 55: Xaa=Glu or Gly or Lys or Arg
MDESVKEKYAGQDIVFKCLGENILQNAFDGYNACIFAYGQTGSGKSYTMMGTAGXPGLIPRLCSGLFERTQKEENEEQSFKVEVSYMEIYNEKVRDLLDPKGSRQTLKVREHSVLGPYVDGLSKLAVTSYKDIESLMSEGNKSRTVA

SEQ ID NO: 7031 - protein, 70 aa, Homo sapiens
  UNSURE 49: Xaa=Glu or Lys
  UNSURE 51: Xaa=Lys or Arg
MKINSRWIKDLNVRPQTVKILEENLGNTLINISLGKELLAKSPKAIATXQXLASGDLIKALCTAKDTINR

SEQ ID NO: 7032 - protein, 78 aa, Homo sapiens
MKTLPAMLGTGKLFWVFFLIPYLDIWNIHGKESCDVQLYIKRQSEHSILAGDPFELECPVKYCANRPHVTWCKLNGTT

SEQ ID NO: 7033 - protein, 62 aa, Homo sapiens
  UNSURE 54: Xaa=Leu or Pro or Gln or Arg
  UNSURE 56: Xaa=Cys or Phe or Ser or Tyr
  UNSURE 57: Xaa= *  or Lys or Gln
MDKFLDTYTLPRLNQEEAESLNRPITGSEIVAIINSLPTKKSAGLDGFTAELYXRXXEELVA

SEQ ID NO: 7034 - protein, 84 aa, Homo sapiens
  UNSURE 42: Xaa=Glu or Gln
MENIKATQLLEGLVQELQKKAEHQVGEDGFLLKIKLGHYATXLQNTYDRCPMELVRCIRHILYNEQRLVREANNGSSPAGSLAD

SEQ ID NO: 7035 - protein, 58 aa, Homo sapiens [sequence omitted]

SEQ ID NO: 7036 - protein, 56 aa, Homo sapiens
MLESEDAEKVLQVCLDEITFWTCSRSFSYLVPMFDGENGLSSYCLWQKVLGLIHSR

SEQ ID NO: 7037 - protein, 81 aa, Homo sapiens
  UNSURE 47: Xaa=Ile or Lys or Arg or Thr
  UNSURE 66: Xaa=Lys or Arg
MLKNKGHSSKKDNLAVNAVALQDHILHDLQLRNLSVADHSKTQVQKXENKSLKRDTKAIIDTGLKXTTQCPKLEDSEKEYV

SEQ ID NO: 7038 - protein, 114 aa, Homo sapiens
  UNSURE 103: Xaa=Glu or Gly
MDDTNSEQQFRVFRDFDFLDVELEDGEGESMDNFNWGVRRRSLDSLDKCDMQILEERQLSGSTPSLNKMHHEDSDESSEEEDLTASQILEHSDLIMTLSPSEXTNPMELLTTAC

SEQ ID NO: 7039 - protein, 92 aa, Homo sapiens
MHGAGLTYLLFLPDWAAVFELYNCEDERCYLDLARLRGVHYITWRRQNKVFPQDKGHHPTLGEHPKFTNYSFDVEEFMYLVLQAADHVLQHP

SEQ ID NO: 7040 - protein, 81 aa, Homo sapiens
  UNSURE 42: Xaa= *  or Trp
MSHFQHCKKCASLVSVSKSSLTAEAYLQSRERFHSSSGGPSXPWNNLQSLPHVQSQHAGLISPATSQTTGLSTWQPASCTQ

SEQ ID NO: 7041 - protein, 54 aa, Homo sapiens
MIVCISPFNFLLLSHHSLKLQRKSFDWCSRVVPFIENRIDGITLIRQVHALKPV

SEQ ID NO: 7042 - protein, 103 aa, Homo sapiens
MNRTKGDEEEYWNSSKFKAFTFDDEDDELSQLKESKRAVNSLRDFVDDDDDDDLERVSWSGEPVGSISWSIRETAGNSGSTHEGREQLKSRNSFSSYAQLPKP

SEQ ID NO: 7043 - protein, 72 aa, Homo sapiens
  UNSURE 64: Xaa= *  or Tyr
MFFKVGSIEPLFMHSSLFRISSSPLQRLHGPLDSQLEAPLCFRRTQQICFSFTSCRLHALLTRXTRLTTPSR

SEQ ID NO: 7044 - protein, 70 aa, Homo sapiens
MQLLDVPPGEDKGGYVIKASEGPAFFPGRCAEIFARGQSVGKLGVLHPDVITKFELTMPCSSLEINIGPI

SEQ ID NO: 7045 - protein, 125 aa, Homo sapiens
  UNSURE 14: Xaa=Asp or Glu
MSDLGSEELEEEGXNDIGVRAPGEWANDLRHGHGVYYYINNDTYTGEWFAHQRHGQGTYLYAETGSKYVGTWVNGQQEGTAELIHLNHRYQGKFLNKNPVGPGKYVFDVGCEQHGEYRLTDMERG

SEQ ID NO: 7046 - protein, 67 aa, Homo sapiens
MDKDAKKRIHNFSVINPVPGQAITQIFAVDNREDLQKWMEAFWQHFFDLSQWKHCCEELMKIEIMSP

SEQ ID NO: 7047 - protein, 78 aa, Homo sapiens
  UNSURE 39: Xaa=Asp or Asn
MLFPGKCKPKDVVSDLILRECDHEDTFPTWSKGAGIGEXVYKASNTMALGVTSSVPCLPLPNILLMASVKWHQGQNQT

SEQ ID NO: 7048 - protein, 84 aa, Homo sapiens
MFRDFGRRLQRDLKRVVDARLRLSEELSGGRIKPKPVEVQVVTHHMQRYAVWFGGSMLASTPEFFQVCHTKKDYEEYGPSICRQ

SEQ ID NO: 7049 - protein, 75 aa, Homo sapiens
MAQQQQELQQKEQELKNHQEEEQQSEEKLQPHKKLNVPQPPVAKLWTSQEQPQPSQQQPSVQPPSQPPPQPSTLP

SEQ ID NO: 7050 - protein, 52 aa, Homo sapiens
  UNSURE 8: Xaa=Cys or Arg or Ser
MGNILTCXINSHCGWPRGKDAPCYESDTDIYETVAAATSESTTVEPGKLDVG

SEQ ID NO: 7051 - protein, 130 aa, Homo sapiens
  UNSURE 79: Xaa=Ala or Gly or Val
  UNSURE 84: Xaa=Ala or Cys or Asp or Phe or Gly or His or Ile or Leu or Asn or Pro or Arg or Ser or Thr or Val or Tyr
  UNSURE 115: Xaa=Glu or Gly
MCFIRDLKILARLMTAKFLHTEIREKGGAYGGGAKLSHNGIFTLYSYRDPNTIETLQSFGKAVDWAKSGKFTQQDIDEXKLSVXSTIDAPVAPSDKGEQEPGVEAQGPGLLLWIXTDTWQIWNGPYSWNR

SEQ ID NO: 7052 - protein, 60 aa, Homo sapiens
  UNSURE 6: Xaa=Ala or Ser
MPVIPXLWEAEVAGSFQPRSSRPAWATQPPPKENMRPLHIWNSRNTGCSNQPPVPRLAPM

SEQ ID NO: 7053 - protein, 66 aa, Homo sapiens
  UNSURE 21: Xaa= *  or Ser
  UNSURE 32: Xaa=Leu or Val
  UNSURE 33: Xaa=Arg or Thr
  UNSURE 39: Xaa= *  or Ser
  UNSURE 44: Xaa=Glu or Gln
  UNSURE 45: Xaa=Ser or Thr
  UNSURE 60: Xaa=Gly or Val
  UNSURE 63: Xaa=Asp or Glu
MQWHVSVIKVPVMYLDDVTQXQSLKEVITDFXXQTHKLXLYLCXXMKVGTKGPGDNLHQXAPXLLL

SEQ ID NO: 7054 - protein, 120 aa, Homo sapiens
  UNSURE 31: Xaa=Asp or Glu
MALLTPQGVKEVFQFQRPQGRERLRRLLNWXEFDEQRARRSILLDTLYESIIFAVGKGFPWVEVAQVVKFTEELLRETKGCSITEAVTILGNKLRDYRGHFNTTHLLALCDYFHHTFIRH

SEQ ID NO: 7055 - protein, 110 aa, Homo sapiens
MEPEREGTERHPRKVRESRQAPNKLVGAAEAMKAGWDLEESQPEAKKARLSTILFTDNCEVTHDQLCELLKYAVLGKSNVPKPSWCQLFHQNHLNNVVVFVLQGMSQLHF

SEQ ID NO: 7056 - protein, 51 aa, Homo sapiens
  UNSURE 40: Xaa= *  or Lys
MLKGILNRLKYFTWVMLFSIIFTGSLEVEKFISREFNRRXAGNVVEMCGVR

SEQ ID NO: 7057 - protein, 51 aa, Homo sapiens
  UNSURE 44: Xaa=Asp or Glu
MLCANGIGRNGSMHYAHLSSAQTQIIETSEEKFKLSYTRISLRXEPSCHPG

SEQ ID NO: 7058 - protein, 52 aa, Homo sapiens
MVTEEKKVSMGKPDPLRDSGTDDQEEEPLERDFDRFIGATANFSRFTLWGLE

SEQ ID NO: 7059 - protein, 124 aa, Homo sapiens
MTRLCLPRPEAREDPIPVPPRGLGAGEGSGSPVRPPVSTWGPSWAQLLDSVLWLGALGLTIQAVFSTTGPALLLLLVSFLTFDLLHRPAVTLCHSANFSPGARVRGPVKVLDSRRLYSCKWVQS

SEQ ID NO: 7060 - protein, 109 aa, Homo sapiens
  UNSURE 67: Xaa=Asp or Glu
  UNSURE 86: Xaa=Lys or Arg
  UNSURE 90: Xaa=Glu or Lys
MSGSKKKKVTKAERLKLLQEEEERRLKEEEEARLKYEKEEMERLEIQRIEKEKWHRLEAKDLERRNXELEELYLLERCFPEAEKLXQETXLLSQWKHYIQCDGSPDPSV

SEQ ID NO: 7061 - protein, 55 aa, Homo sapiens
MEIHTWQRAEASHQQPHEGARVGVAPPAPVEPSDVTDLAADSLQSHETLSQNHPA

SEQ ID NO: 7062 - protein, 68 aa, Homo sapiens [sequence omitted]

SEQ ID NO: 7063 - protein, 52 aa, Homo sapiens
MPVIPALWEAEGGGSLEVGSLRPAWPIPPSLLKIQKLAGHGGACLWSRLLGW

SEQ ID NO: 7064 - protein, 59 aa, Homo sapiens
  UNSURE 14: Xaa=Glu or Val
MLDAAVIKMEGGTXNDLRILEQEEEEEQAGKPGEPSKKEEGRAGAGLGDGERKTNDKEE

SEQ ID NO: 7065 - protein, 52 aa, Homo sapiens
  UNSURE 25: Xaa=Ala or Ser
MFNRAVSRLSRKRPPSDIHDSDGSXSSSHQSLKSTAKWAASLENLLEDPEGV

SEQ ID NO: 7066 - protein, 51 aa, Homo sapiens
MYRTLHLSTEQVAAFCRSLHEMNPSDQSPSPQDSTGPQLATMRQLSDADKL

SEQ ID NO: 7067 - protein, 92 aa, Homo sapiens
  UNSURE 83: Xaa=Glu or Gln
  UNSURE 88: Xaa=Ala or Gly or Val
MNCFQGTNASALEKDIGPEQFPINEHYFGLVNFGNTCYCNSVLQALYSCRPFRENVLAYKAQQKKKENLLTCLADLFHSIATXKKKVXSSHL

SEQ ID NO: 7068 - protein, 54 aa, Homo sapiens
MESHSVAQAGVQWHELGSLQPPPPRFKQFSCLSFAHSWNCGRAPPCLANFFFFF

SEQ ID NO: 7069 - protein, 74 aa, Homo sapiens
MNIRNAQPDDLMNMQHCNLLCLPENYQMKYYLYHGLSWPQLSYIAEDEDGKIVGYVLAKMEEEPDDVPHGHITS

SEQ ID NO: 7070 - protein, 62 aa, Homo sapiens
  UNSURE 13: Xaa=Ala or Glu
  UNSURE 26: Xaa= *  or Lys or Gln
MADKEVGNKEDAXKEVAISTFSSSNXVSCPLCDQCFPPTKIERHAMYCNGLMEEDTVLTRSQ

SEQ ID NO: 7071 - protein, 90 aa, Homo sapiens
MSTMGNEASYPAEMCSHFDNDEIKRLGRRFKKLDLDKSGSLSVEEFMSLPELRHNPLVRRVIDVFDTDGDGEVDFKEFILGTSQFSVKGD

SEQ ID NO: 7072 - protein, 70 aa, Homo sapiens
  UNSURE 51: Xaa=Ala or Pro
  UNSURE 56: Xaa=Glu or Gly
MIPASAKAPHKQPHKQSISIGRGTRKRDEDSGTEVGEGTDEWAQSKATVRXPDQLXLTDAELKEEFTRIL

SEQ ID NO: 7073 - protein, 53 aa, Homo sapiens [sequence omitted]

SEQ ID NO: 7074 - protein, 130 aa, Homo sapiens
  UNSURE 2: Xaa=Lys or Arg
  UNSURE 111: Xaa=Asp or His
MXPLKATATTSQPVLTIQQIETIFYKIQDIYEIHKEFYDNLCPKVQQWDSQVTMGHLFQKLASQLGVYKAFVDNYKVALETAEKCSQSNNQFQKISEELKVKGPKDSKDSXTSVTMEALLYKPIDRVTRS

SEQ ID NO: 7075 - protein, 60 aa, Homo sapiens
MEYIYIYFILFYFFEMNSCCFAQAGVQWRDLGSLQPPSPGFKQFSCLSLLSSWDYRHPPP

SEQ ID NO: 7076 - protein, 120 aa, Homo sapiens
  UNSURE 105: Xaa=His or Pro or Gln or Arg
  UNSURE 110: Xaa=Pro or Ser or Thr
  UNSURE 112: Xaa= *  or Tyr
  UNSURE 119: Xaa=Ile or Leu
MPKKLGPKSQRQRGAVAPLTQVQQAACSPTYKQAKRNARSYQGRRCRRRCSQNTTSRVPSQLQAVDSSSASCRTYKNSEELRSRIVSGIITPIHEQWEKANVSSXTGSSXCXRQRGGPXR

SEQ ID NO: 7077 - protein, 57 aa, Homo sapiens [sequence omitted]

SEQ ID NO: 7078 - protein, 55 aa, Homo sapiens [sequence omitted]

SEQ ID NO: 7079 - protein, 125 aa, Homo sapiens
  UNSURE 2: Xaa=Leu or Trp
  UNSURE 45: Xaa=Lys or Asn
  UNSURE 89: Xaa=Ile or Leu or Val
MXVYRLQTQEKPNTTVQVPAFLQELVDRDNSKFEEWCIEMAEMRXKVWIKEKQNTKRLRSCTKGYLLELSPMSLSLWNGCKSGWMNQQXPNLLIITLACVPMTSFTRNKISIMKRISEYAADIFY

SEQ ID NO: 7080 - protein, 82 aa, Homo sapiens
  UNSURE 45: Xaa=Leu or Val
MLESPEREEKKPSVGAVPTEDSTSFHLHALREAKIPRESSRGRKXPAVSCKCVGVGSDFHPCWTSAASDAFWKQVKGQGHPR

SEQ ID NO: 7081 - protein, 137 aa, Homo sapiens
MENAELKKVLQQMKKEMISLLSPQKKKPRERVDDSTGTVISDVEEDAGELSRESMWDLSCETVREQLTNSIRKQWRILKSHVEKLDNQVSKVHLEGFNDEDVISRQDHEQETEKLELEIQQCKEMIKTQQQLLQQQL

SEQ ID NO: 7082 - protein, 72 aa, Homo sapiens
MAGLQRLASHLPVGVMLPHNTTEAPGPHSAKQDSYEQGDSSQQSLKGHLRNNFQKQLLSNKELILDKVYTHP

SEQ ID NO: 7083 - protein, 74 aa, Homo sapiens [sequence omitted]

SEQ ID NO: 7084 - protein, 67 aa, Homo sapiens
MAQAKINAKANEGRFCRSSSMADRSSRLLESLDQLELRVEALREAATAVEQEKEILLEMIHSIQNSQ

SEQ ID NO: 7085 - protein, 74 aa, Homo sapiens
  UNSURE 10: Xaa=Asp or His or Tyr
  UNSURE 11: Xaa=Asp or Asn
MKLEFTEKNXXSFVLQNLNRQRKRKEYWDMALSVDNHVFFAHRNVLAAVSPLVRSLISSNDMKTADELFITIDT

SEQ ID NO: 7086 - protein, 143 aa, Homo sapiens
  UNSURE 104: Xaa=Glu or Lys or Gln
MVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFXDRLHLRGYTPEGTVLTVRPPLLPYIVTSKDSASRKVWPI

SEQ ID NO: 7087 - protein, 79 aa, Homo sapiens
MGSKCCKGGPDEDAVERQRRQKLLLAQLHHRKRVKAAGQIQAWWRGVLVRRTLLVAALRAWMIQCWWRTLVQRRIRQRR

SEQ ID NO: 7088 - protein, 97 aa, Homo sapiens
  UNSURE 71: Xaa=His or Gln
  UNSURE 72: Xaa= *  or Gly or Arg
  UNSURE 74: Xaa=Ala or Asp
  UNSURE 88: Xaa=His or Gln
MAKGGEALPQGSPAPVQDPHLIKVTVKTPKDKEDFSVTDTCTIQQLKEEISQRFKAHPDQLVLNLCWQNPXXSXSLAQCGVRDGLTVXLVIKRQHRA

SEQ ID NO: 7089 - protein, 55 aa, Homo sapiens
  UNSURE 9: Xaa=Pro or Gln
  UNSURE 14: Xaa=Glu or Lys or Met or Val
  UNSURE 34: Xaa=Lys or Arg or Thr
  UNSURE 40: Xaa=Gly or Val
  UNSURE 49: Xaa=Asp or Tyr
MFLPQLIHXPCDVXPCDLPYLVTMHLVTFFPCPXKLPLTXTFHYLLQAXKTNSTP

SEQ ID NO: 7090 - protein, 71 aa, Homo sapiens
MFCTTEQQGALSSELPSTSPSSVAAISSRSVIHKPFTQSRIPPDLPMHPAPRHITEEELSVLESCLHRWKD

SEQ ID NO: 7091 - protein, 68 aa, Homo sapiens
  UNSURE 43: Xaa=Leu or Pro or Arg
  UNSURE 55: Xaa=Ala or Glu
MQPSTRALPLLSPRLRLRSRIQMFCGIWTSPKPGAMLTKTATXRRKPCSPATCTXAGSTAAPGQIPIP

SEQ ID NO: 7092 - protein, 53 aa, Homo sapiens
  UNSURE 4: Xaa=His or Gln
  UNSURE 9: Xaa=Phe or Tyr
  UNSURE 12: Xaa=Leu or Val
  UNSURE 16: Xaa=Ala or Gly or Pro or Arg
  UNSURE 34: Xaa=Pro or Arg
  UNSURE 36: Xaa=Leu or Met or Val
MCHXAWLIXVCXVEMXFHNVGPAGLELLTSGDPXTXASQNAGITGVSHRTQPL

SEQ ID NO: 7093 - protein, 71 aa, Homo sapiens
  UNSURE 13: Xaa=Cys or Ser or Trp
  UNSURE 17: Xaa=Ala or Thr
  UNSURE 23: Xaa=Asn or Ser
  UNSURE 25: Xaa=Met or Arg
  UNSURE 43: Xaa=His or Tyr
MEMSSYLCWARGXKREXAFSRGXEXILNPRVPPPCPEPSSVSXQQFQPLHRMQQTNVALLGRETVGKKEPC

SEQ ID NO: 7094 - protein, 66 aa, Homo sapiens
  UNSURE 46: Xaa=Glu or Gly
MSTLFPSLFPRVTETLWFNLDRPCVEETELQQQEQQHQAWLQSIAXKDNNLVPIGKPASEHYDDEV

SEQ ID NO: 7095 - protein, 61 aa, Homo sapiens
  UNSURE 58: Xaa= *  or Ile or Lys or Leu
MLVDKLNTNTEMEEVMNDYNMLKAQNDRETQSLDVIFTERQAKEKQIRSVEEEIEQEXQAT

SEQ ID NO: 7096 - protein, 95 aa, Homo sapiens
  UNSURE 47: Xaa=Ala or Ser
  UNSURE 82: Xaa= *  or Leu or Ser
MGGRRGPNRTSYCRNPLCEPGSSGGSSGSHTSSASVTSVRSRTRSSXGTGLSSPPLATQTVVPLQHCKIPELPVQASILFEXQLFFCQLIALFVH

SEQ ID NO: 7097 - protein, 72 aa, Homo sapiens
MYGAMCVYGQNKKDALWLIILSIQIYFLSLPPSSSLLFIYIYKENDTAELGGKAWVWCMVFEILMPRQKANT

SEQ ID NO: 7098 - protein, 61 aa, Homo sapiens
MRGPCWEHVLLGISPSLCPVPTPPRRCSCSEPTPHLSEATQRAPCGQSWILALNKSESWGK

SEQ ID NO: 7099 - protein, 63 aa, Homo sapiens
MDSSRARQQLRRRFLLLPDAEAQLDREGDAGPKTSTAVEKKEKPLPRLNIHSGFWILASIVVT

SEQ ID NO: 7100 - protein, 55 aa, Homo sapiens [sequence omitted]

SEQ ID NO: 7101 - protein, 62 aa, Homo sapiens
  UNSURE 31: Xaa= *  or Gly or Arg
  UNSURE 36: Xaa=Leu or Met or Arg or Trp
  UNSURE 39: Xaa= *  or Glu
MRASQPGQGQGTSRPAASTKNRKEEKEREGXRSPAXTSXPSSGSLPLECLMRQNGSSSCIPA

SEQ ID NO: 7102 - protein, 51 aa, Homo sapiens
  UNSURE 2: Xaa=Ile or Met or Arg or Ser
MXPPGGTNNSRCATLRAVTLTAKVCSFTPEPARPRTHQKEETPDTSEHQKE

SEQ ID NO: 7103 - protein, 116 aa, Homo sapiens
MYLQGPRKLMTQGGYDMVQKLFLDFFRRRLSQRPTAEELEQRNILKPRNEQEEQEEKREIKRRLTRKLSQRPTVEELRERKILIRFSDYVEVADAQDYDRRADKPWTRLTAADKAA

SEQ ID NO: 7104 - protein, 72 aa, Homo sapiens [sequence omitted]

SEQ ID NO: 7105 - protein, 51 aa, Homo sapiens [sequence omitted]

SEQ ID NO: 7106 - protein, 74 aa, Homo sapiens [sequence omitted]

SEQ ID NO: 7107 - protein, 88 aa, Homo sapiens
  UNSURE 59: Xaa=Ala or Asp
MTDMLKEEEERLQLAHSNMTKGQELLLTIQMGIDNLYVRLMGITLPATQREVVLSNTLXLNSKLAYCEGKLTYLADRVQMVSRTEEGD

SEQ ID NO: 7108 - protein, 55 aa, Homo sapiens
  UNSURE 51: Xaa= *  or Ala or Cys or Phe or Gly or Ile or Leu or Met or Pro or Arg or Ser or Thr or Val or Trp
MSSTSSKRAPTTATQRLKQDYLRIKKDPVPYICAEPLPSNILEWHYVVRGXEMTP

SEQ ID NO: 7109 - protein, 55 aa, Homo sapiens [sequence omitted]

SEQ ID NO: 7110 - protein, 60 aa, Homo sapiens
  UNSURE 23: Xaa= *  or Tyr
  UNSURE 24: Xaa=Phe or Val
  UNSURE 52: Xaa=Cys or Phe or Ser
MAALLHLQSQKHWAKPFCLSLFXXKRPLWPSLANMAHRREAGTDGKTFFFSXSSTSTLSP

SEQ ID NO: 7111 - protein, 59 aa, Homo sapiens
  UNSURE 15: Xaa=Arg or Thr
  UNSURE 23: Xaa=Ile or Leu
  UNSURE 24: Xaa=Ser or Thr
  UNSURE 29: Xaa=Phe or Tyr
  UNSURE 34: Xaa=Phe or Tyr
  UNSURE 38: Xaa=Cys or Tyr
  UNSURE 39: Xaa=Leu or Met
  UNSURE 58: Xaa=Ala or Thr
MTLSPIPVLRDISEXGRDLEQIXXQYITXVKPAXEEFXXPTKKYADVIIPRGADNLVXI

SEQ ID NO: 7112 - protein, 69 aa, Homo sapiens
MVARRRKCAARDPEDRIPSPLGYAAIPIKFSEKQQASHYLYVRAHGVRQGTKSTWPQKRTLFVLNVPPR

SEQ ID NO: 7113 - protein, 77 aa, Homo sapiens
MNGRKHFVEKRYSEFHALHKKLKKCIKTPEIPSKHVRNWVPKVLEQRRQGLETYLQAVILENEELPKLFLDFLNVRH

SEQ ID NO: 7114 - protein, 91 aa, Homo sapiens
  UNSURE 42: Xaa=Leu or Pro
  UNSURE 64: Xaa=Pro or Thr
MEDKHSSDASSLLPQNILSQTSRHNDRDYRLPRAETHSSSTXVQHPIKPVVHPTATPSTVPSSXFTLQSDHQPKKSFDANGASTLSKLPTP

SEQ ID NO: 7115 - protein, 63 aa, Homo sapiens [sequence omitted]

SEQ ID NO: 7116 - protein, 53 aa, Homo sapiens
  UNSURE 53: Xaa=Phe or Ile or Leu or Val
MIKQSSRVWLCLVTRRVYIGRARALGHPTGKLQHSCGSLQSTGAYYRHSTTNX

SEQ ID NO: 7117 - protein, 79 aa, Homo sapiens
  UNSURE 41: Xaa=Ile or Ser or Thr
MARLINAFASLAEGRLYLAQNTKVLQMLEGRLKEEDKDIIXRENVLGALQKFSLRRPLQTAMIQDGLIFWLVDVLKDPD

SEQ ID NO: 7118 - protein, 53 aa, Homo sapiens
  UNSURE 2: Xaa=Arg or Ser
  UNSURE 3: Xaa=Arg or Ser
MXXGHLAKSRDFICVNILERGLHPFVRTEAWKFLTGYFSWQSSQDERLTVDSM

SEQ ID NO: 7119 - protein, 82 aa, Homo sapiens
  UNSURE 75: Xaa=Ala or Ser
MYAGVGFGGLCGRGSRGDTARSLLEGDDHFSPENRLDMQETTRKTWRTSSAMSAGGCSGEKNCLRWTRSPGSPPXGCGGLSR

SEQ ID NO: 7120 - protein, 61 aa, Homo sapiens
MSTPCHPLRSLNFRKTTKESALLNKLSILASKLAPAMKTQKLRYRRCSSELLPMAKSYKRL

SEQ ID NO: 7121 - protein, 75 aa, Homo sapiens
MQIKTTMRYHLMPARMVIIKKLRNTRCLRGCGEIGKLLPCWQECKLVQSLWKAVWRFLKDLEPEILFDPEILLLG

SEQ ID NO: 7122 - protein, 73 aa, Homo sapiens
  UNSURE 44: Xaa= *  or Glu or Lys or Gln
  UNSURE 56: Xaa=Ile or Thr
  UNSURE 58: Xaa=Pro or Arg
  UNSURE 59: Xaa=Ile or Val
  UNSURE 61: Xaa=Pro or Ser
  UNSURE 62: Xaa=Ala or Pro
MLFALNIMNSQEGGPSSQRQVQNGPSPDEMDIQRRQVMEQHQQXRQESLERRTSAXGXXLXXGHPSSAASAPD

SEQ ID NO: 7123 - protein, 124 aa, Homo sapiens
  UNSURE 104: Xaa=Lys or Gln
  UNSURE 115: Xaa=Pro or Thr
MAQKRPACTLKPECVQQLLVCSQEAKKSAYCPYSHFPVGAALLTQEGRIFKGCNIENACYPLGICAERTAIQKAVSRKGTKDFRAIAIASDMQDDFISPCGACXAKLMQRVWHQXGPCYMTKPD

SEQ ID NO: 7124 - protein, 96 aa, Homo sapiens
  UNSURE 43: Xaa=Ile or Met
  UNSURE 51: Xaa= *  or Leu or Trp
  UNSURE 82: Xaa= *  or Cys or Trp
MGKTREIDTSTRGQQMLLQIGVRRGRYLVEDRGMFPGHRSKYXNKELPGQXRWLTPVIPALWEAEAGGSRGQEIETILATQXSPSLLKIKSGVVVG

SEQ ID NO: 7125 - protein, 58 aa, Homo sapiens [sequence omitted]

SEQ ID NO: 7126 - protein, 54 aa, Homo sapiens
MIERMTEKMLESPPMHESERKLLPSSRSTEEAHTECWKHQGRSPAVLVRATLKA

SEQ ID NO: 7127 - protein, 53 aa, Homo sapiens
  UNSURE 27: Xaa= *  or Cys
  UNSURE 28: Xaa=His or Asn
  UNSURE 41: Xaa=Leu or Met
  UNSURE 43: Xaa=Met or Val
MGQCFTKVLAGSSLEDCGISGHTQERXXRCSSIRHQLPPHXLXVLILLRDTSP

SEQ ID NO: 7128 - protein, 76 aa, Homo sapiens
  UNSURE 31: Xaa=His or Asn
  UNSURE 36: Xaa=Ala or Asp
MVKTNKPGAKVAVSAKRGSEVTTNTSPQQGXGYVLXSSHRSAAVSLNPSHRRSEAAHPTTPHSASDYPRSVSLQSG

SEQ ID NO: 7129 - protein, 55 aa, Homo sapiens
  UNSURE 47: Xaa=Lys or Gln
MVSLRHLASGTQLGHCVPPASLAGPSRGPLLAGFPGHSFHSIQGPSXDHTQVPVI

SEQ ID NO: 7130 - protein, 58 aa, Homo sapiens
  UNSURE 21: Xaa= *  or Lys or Asn or Ser or Thr or Tyr
MRPPSKSLHSGMWLPDMRRRXESGTPGEGVEAPTPHLHTACYASLPSAAPGFQSFLMN

SEQ ID NO: 7131 - protein, 52 aa, Homo sapiens
  UNSURE 39: Xaa= *  or Cys or Arg or Ser or Thr or Trp
  UNSURE 41: Xaa= *  or Arg
MSPPGGTNNSRCATLRAVTLTAKVCSFTPEPARPRTHPXGXNSEHIRTSEGS

SEQ ID NO: 7132 - protein, 79 aa, Homo sapiens
  UNSURE 6: Xaa=Gln or Arg
  UNSURE 14: Xaa=Gly or Arg
  UNSURE 79: Xaa=Cys or Tyr
MLSPQXVAAAASRXADDAMESSKPGPVQVVLVQKDQHSFELDEKALASILLQDHIRDLDVVVVSVAGAFRKGKSFILDX

SEQ ID NO: 7133 - protein, 83 aa, Homo sapiens
  UNSURE 38: Xaa=Ala or Asp or Glu
  UNSURE 61: Xaa=Phe or Leu
  UNSURE 72: Xaa=Glu or Gly or Val
MFFISFECVPRSRIARSYGNSVFNFLRNCQTVLQSSCXILHSHQQCLRVPISPHSCQHLSXKILAIHPSVCXVASHCGFDFFF

SEQ ID NO: 7134 - protein, 118 aa, Homo sapiens
  UNSURE 34: Xaa=Pro or Thr
  UNSURE 50: Xaa=Ala or Pro
  UNSURE 67: Xaa=Phe or Tyr
  UNSURE 78: Xaa=Ile or Leu or Val
  UNSURE 79: Xaa= *  or Ala or Gly or Ile or Leu or Arg or Ser or Thr or Val
  UNSURE 81: Xaa=Ile or Met
  UNSURE 82: Xaa=Asp or His or Asn or Tyr
  UNSURE 100: Xaa= *  or Gly or Arg
  UNSURE 101: Xaa=Leu or Met or Pro or Thr
MIISFLRPPQPRFLCSLQSLSYIYILRQGLTLSXRLECRVVINSSLQPQXPGLKRSSSLSLRKQWNXRCEPPCPALEXXKXXEKRQVKRSEVYIENGLNXXKNHKRSENSQFLPLLMT

SEQ ID NO: 7135 - protein, 63 aa, Homo sapiens
  UNSURE 4: Xaa=Arg or Ser
  UNSURE 5: Xaa= *  or Cys or Arg
  UNSURE 10: Xaa=Glu or Val
  UNSURE 22: Xaa= *  or Cys
  UNSURE 36: Xaa=Pro or Gln
  UNSURE 37: Xaa=Cys or Ser
  UNSURE 41: Xaa=Ser or Thr
  UNSURE 46: Xaa=Pro or Thr
  UNSURE 53: Xaa=Met or Val
  UNSURE 58: Xaa= *  or Lys
MAQXXNRDFXDVAKALRSSWHXSRKWGETLLQLSTXXTPPXEIFVXHLHFKIXATMSXNLVAL

SEQ ID NO: 7136 - protein, 68 aa, Homo sapiens
MTAIRLREFIERRPVIPPSIFIAHQGRDVQGYYPGQLARLHFDHSAKRAPRPLIDLTIPPKTKYHYQP

SEQ ID NO: 7137 - protein, 126 aa, Homo sapiens
  UNSURE 49: Xaa=Ser or Thr
MYSLCLLATLMGEDVWSYAKGLPHMFQQGGVFYSIMKKTMGMADGKHCXFPHLPGKTFVYNASEDRLELCVDAAGHFPIGPDVEDLVKEAVSQVRAEATTRSRESSPSHGLLKLGSGGVVKRNLSI

SEQ ID NO: 7138 - protein, 63 aa, Homo sapiens
  UNSURE 40: Xaa=Lys or Asn
MKPAYPSPVCWPQFSNQVLNELDGLCQIPPCKAGISPLFXCALWGCGSFGSDFSYMFSPPTPI

SEQ ID NO: 7139 - protein, 66 aa, Homo sapiens [sequence omitted]

SEQ ID NO: 7140 - protein, 53 aa, Homo sapiens
MEAAADGPAETQSPVEKDSPAKTQSPAQDTSIMSRNNADTGRVLALPEHKKKR

SEQ ID NO: 7141 - protein, 51 aa, Homo sapiens
  UNSURE 41: Xaa=Asp or Glu
MSPPGGTNNSRCATLRAVTLTAKVCSFTPEPARPRTHQKEXTPNTSEHQKE

SEQ ID NO: 7142 - protein, 58 aa, Homo sapiens
  UNSURE 2: Xaa=Asp or Val
  UNSURE 36: Xaa=Lys or Arg
MXITSTRKPPSPEGAKRAHPGDPTMNVSVAGAQGQXPWPERVPLEVRGSWDTQHSHQP

SEQ ID NO: 7143 - protein, 60 aa, Homo sapiens
  UNSURE 7: Xaa=Asp or Tyr
  UNSURE 37: Xaa=Pro or Gln
MEYIYIXFILFYFFEMNSCCFAQAGVQWRDLGSLQPXSPGFKQFSCLSLLSSWDYRHPPP

SEQ ID NO: 7144 - protein, 117 aa, Homo sapiens
  UNSURE 100: Xaa=Gly or Arg or Trp
  UNSURE 112: Xaa=Gly or Arg
MEILAKAKADMTIVDNEGKGVLFYCILPTKRHYRCALIALEHGADVNNSTYEGKPIFLRACEDAHDVKDVCLTFLEKGANPNAINSSTGRTALMEASREXVVEIVRGILERXGEVNA

SEQ ID NO: 7145 - protein, 51 aa, Homo sapiens
  UNSURE 31: Xaa=Leu or Met or Val
MGFLHVGRGWSQTRPRVIHPPGPPKVLGLQXWATVPGRFLFFKKLHDKQQP

SEQ ID NO: 7146 - protein, 51 aa, Homo sapiens
  UNSURE 28: Xaa=Leu or Arg
MDETEWIHRHPKAEDLRVGLISWAGTYXTFEACKNTVTATAKSLGRRQTWE

SEQ ID NO: 7147 - protein, 91 aa, Homo sapiens
  UNSURE 11: Xaa= *  or Gln
  UNSURE 12: Xaa=Asp or Glu
  UNSURE 27: Xaa=Ile or Leu
  UNSURE 44: Xaa=His or Gln
  UNSURE 45: Xaa=Glu or Lys
  UNSURE 57: Xaa=Ala or Pro
  UNSURE 77: Xaa=Ala or Gly
MLVPTLPAAGXXPPPTTEAGARLFDLXLPRGEPKSQSHVFHRWXXHLPRVLLGCCAXWASCSCSFQGPLPFPPVCTXPGSALRTLPSAVER

SEQ ID NO: 7148 - protein, 80 aa, Homo sapiens
  UNSURE 2: Xaa=Ser or Thr
  UNSURE 9: Xaa=Cys or Ser
  UNSURE 29: Xaa=Ser or Thr
  UNSURE 30: Xaa=Leu or Gln
  UNSURE 41: Xaa=Ala or Ser
  UNSURE 66: Xaa=Leu or Gln or Arg
  UNSURE 73: Xaa=Ile or Met
  UNSURE 77: Xaa=Ala or Ser
MXTRLTNRXSHSVTFGVNEAPDLSEVAVXXRHILNAGWTPXAARSLWWRFLISGGKENTLTSRRGXEKYDLKXLLYXTTS

SEQ ID NO: 7149 - protein, 75 aa, Homo sapiens
MAKDILGEAGLHFDELNKLRVLDPEVTQQTIELKEECKDFVDKIGQFQKIVGGLIELVDQLAKEAENEKMKAIGA

SEQ ID NO: 7150 - protein, 58 aa, Homo sapiens
  UNSURE 11: Xaa=His or Arg
  UNSURE 15: Xaa=Phe or Leu
  UNSURE 33: Xaa=Ala or Thr
  UNSURE 56: Xaa=Leu or Ser
MGIKNSSEAGXKTSXKRYLPYTQRKEAFLSSKXQKCQEESEQTGFAKFFSITTVRXYH

SEQ ID NO: 7151 - protein, 62 aa, Homo sapiens
  UNSURE 6: Xaa=Lys or Arg
  UNSURE 8: Xaa=Ala or Pro
  UNSURE 17: Xaa=Lys or Gln
  UNSURE 22: Xaa=Lys or Asn
  UNSURE 23: Xaa=Lys or Gln
  UNSURE 24: Xaa=His or Asn or Pro or Thr
  UNSURE 26: Xaa=Ala or Glu
  UNSURE 42: Xaa= *  or Glu or Lys or Gln
MWHMMXVXVTMEKEGGXNTFKXXXKXNSTSQRVHTNMLRCLXCNKQHVRRLAFCRNPFSVLP

SEQ ID NO: 7152 - protein, 77 aa, Homo sapiens
  UNSURE 52: Xaa=Ile or Met
  UNSURE 53: Xaa=Ala or Pro or Ser or Thr
  UNSURE 54: Xaa=Lys or Asn
  UNSURE 55: Xaa=Ala or Pro or Ser or Thr
MVSHTFHMRTEESDASQEGDDLPKSSANTSHPKQDDSPKSSEETIQPKEGDXXXXPEETIQSKKEDLPKSSEKATQP

SEQ ID NO: 7153 - protein, 76 aa, Homo sapiens
  UNSURE 20: Xaa=Asp or His or Asn or Tyr
  UNSURE 44: Xaa=Asp or Asn
  UNSURE 54: Xaa=Arg or Ser
  UNSURE 55: Xaa=Lys or Asn
MPRSSRSPGDPGALLEDVAXNPRPRRIAQRGRNTSRMADDTSPXMNDNILLPVXXNDQALGLTQCMLGCVSWFTCF

SEQ ID NO: 7154 - protein, 71 aa, Homo sapiens [sequence omitted]

SEQ ID NO: 7155 - protein, 77 aa, Homo sapiens
  UNSURE 33: Xaa=Ile or Asn
  UNSURE 39: Xaa=Ala or Pro or Ser or Thr
  UNSURE 48: Xaa=Phe or Leu
  UNSURE 51: Xaa= *  or Cys or Phe or Leu or Ser or Trp or Tyr
  UNSURE 64: Xaa= *  or Glu or Gly or Lys or Gln or Arg
MSPQNFQPRPFQLKAPCKKLFARKMKILGTIQXLFGIMXFSFGVIFLXTLXKPYPRFPFIFLSXYPFWGSVLFINSG

SEQ ID NO: 7156 - protein, 85 aa, Homo sapiens
  UNSURE 20: Xaa= *  or Tyr
  UNSURE 23: Xaa=Glu or Lys or Gln
  UNSURE 30: Xaa=Glu or Val
  UNSURE 43: Xaa=Ala or Thr
  UNSURE 49: Xaa= *  or Leu or Ser or Trp
MEVAGGACWESREGSGAGNXQAXSKEISKXGPGTRVTAEMGMXSSCPTXMEGQVQWLTPVTPALLEAEMGGSLETRSSRPARRCY

SEQ ID NO: 7157 - protein, 73 aa, Homo sapiens
  UNSURE 27: Xaa=Asp or Tyr
  UNSURE 30: Xaa= *  or Leu
MNSSFFFNFFYLFYFFIFYFYYYYYFXYTXSFRVHVHIVQVSYICIHVPCWCTAPTNLSSSLRYISQCYPSPL

SEQ ID NO: 7158 - protein, 54 aa, Homo sapiens
MEVNGINTSAGEWNGMECNGMESSGMEWNGMESTPLQWNGMEWNGIEWNGINPM

SEQ ID NO: 7159 - protein, 64 aa, Homo sapiens
  UNSURE 28: Xaa=His or Gln
MNDGFFLKVTALTQKPDVYIPETLEPGXPVTVICVFNWAFEECPPPSFSWTGAALSSQGTKPTT

SEQ ID NO: 7160 - protein, 61 aa, Homo sapiens
  UNSURE 33: Xaa=Asp or Asn
MPRQHKQDPGTPTGYGAVPQSQGPGFLPREVRXKDNFSLLPLSSPDTDLPTLYLPLLLPNP

SEQ ID NO: 7161 - protein, 59 aa, Homo sapiens
MQTNERRQVGPPSFVPDSPSIPVGSPNFSSVKQGHGNLSGTSFQQSPVRPSFTPALPAA

SEQ ID NO: 7162 - protein, 68 aa, Homo sapiens [sequence omitted]

SEQ ID NO: 7163 - protein, 57 aa, Homo sapiens
MPGLLDFISSEIYTKPKIISLLTIIIIMISICFYYQDRSINVQCVVCVFTHLPFTVS

SEQ ID NO: 7164 - protein, 58 aa, Homo sapiens
  UNSURE 55: Xaa=Asp or Glu
  UNSURE 56: Xaa=His or Asn or Tyr
MRRQIKMKNKHIFFTKESEKPFFKKSKILSKVEKFLTWVNKPMDEEASQESSSHXXVH

SEQ ID NO: 7165 - protein, 53 aa, Homo sapiens
MSPSLECSGAISAHCNLRLLGSGDSPASASRVSGIAAMRLHAQLIFVFSVETD

SEQ ID NO: 7166 - protein, 56 aa, Homo sapiens [sequence omitted]

SEQ ID NO: 7167 - protein, 60 aa, Homo sapiens
MNENIDILETAIKQAAEQGARIIVTPEDALYGWKFTRETVFPYLEDIPDPQVNWIPCQTP

SEQ ID NO: 7168 - protein, 63 aa, Homo sapiens
  UNSURE 22: Xaa=Phe or Ile or Leu or Val
MDSKGEESKISYPNIFFMIDSXEEVFSDMTVGKERWSVWSWWLVTKPTRSRGSSFRAPSATRR

SEQ ID NO: 7169 - protein, 66 aa, Homo sapiens
  UNSURE 24: Xaa= *  or Glu
MQMRVLCLFLNYTKQMGRSSEGRXASSLPGKALFSLPMKAAVLTVKETVSQLCLPAVGTTIYDREA

SEQ ID NO: 7170 - protein, 124 aa, Homo sapiens
  UNSURE 4: Xaa=Phe or Ser
MGEXKVHRVRFFNYVPSGIRCVAYNNQSNRLAVSRTDGTVEIYNLSANYFQEKFFPGHESRATEALCWAEGQRLFSAGLNGEIMEYDLQALNIKYAMDAFGGPIWSMAASPSGSQLLVGCEDGS

SEQ ID NO: 7171 - protein, 57 aa, Homo sapiens
MNISVDLETNYAELVLDVGRVTLGENSRKKMKDCKLRKKQNERVSRAMCALLNSGGG

SEQ ID NO: 7172 - protein, 102 aa, Homo sapiens
  UNSURE 100: Xaa=Lys or Thr
MGDKKSPTRPKRQPKPSSDEGYWDCSVCTFRNSAEAFKCMMCDVRKGTSTRKPRPVSQLVAQQVTQQFVPPTQSKKEKKDKVEKEKSEKETTSKKNSHKXTS

SEQ ID NO: 7173 - protein, 61 aa, Homo sapiens
  UNSURE 16: Xaa=Ile or Lys or Arg or Thr
  UNSURE 17: Xaa=Asp or Glu
  UNSURE 39: Xaa=Asp or Glu
MSELPSYGEMAAEKLXXRSKASGDENDNIEIDTNEEIPXGFVVGGGDELTNLENDLDTPEQ

SEQ ID NO: 7174 - protein, 78 aa, Homo sapiens
MLYFLFIYLFIFKFFLFIFFLFFSFFNYYYTLSFRVHVHNVQVTYICIHVPCWCAAPTNSSSSIMYISWCYPCPLPPP

SEQ ID NO: 7175 - protein, 69 aa, Homo sapiens
  UNSURE 5: Xaa=His or Gln
  UNSURE 45: Xaa=His or Leu or Arg
MRPEXPSPSFGGFVSTLSEASIRKLDPDTSDCTPEKDLTPTQCVXRDVVPLGGQGGGGPSPSPGGEPPP

SEQ ID NO: 7176 - protein, 69 aa, Homo sapiens
  UNSURE 8: Xaa=Asp or Glu
MNRHFSKXDIYAANRHTKKCSSSLAIREMQIKTTMRYHLTPVRMAIIKKSGNNRCWRGCGEIETLLHCW

SEQ ID NO: 7177 - protein, 52 aa, Homo sapiens
  UNSURE 28: Xaa=Asp or Glu
  UNSURE 32: Xaa=Lys or Asn
  UNSURE 34: Xaa=Lys or Thr
  UNSURE 40: Xaa=Ala or Thr
  UNSURE 46: Xaa=Ile or Val
MNRHFSKEDIYAANRHTKKCSSSLAIRXMQIXTXMRYHLXPVRMAXIKKSGT

SEQ ID NO: 7178 - protein, 88 aa, Homo sapiens [sequence omitted]

SEQ ID NO: 7179 - protein, 67 aa, Homo sapiens
  UNSURE 20: Xaa=Pro or Arg
MSFIISIESFLSLMKTAGGXSAAKKPEGTRIPVPYTHHQTHSHPHTFSDTHKSACRLYQTLLLLPAK

SEQ ID NO: 7180 - protein, 60 aa, Homo sapiens
  UNSURE 18: Xaa=Lys or Arg
  UNSURE 32: Xaa=Lys or Arg
  UNSURE 52: Xaa=Asp or Asn
MNRHFSKEDIYAANRHTXKCSSSLAIREMQIXTTMRYHLTPVRMAIIKKSGXNRCWRGCG

SEQ ID NO: 7181 - protein, 60 aa, Homo sapiens
MRRTPIGTDRNHNRYWLFSDEVPGLFIEKGWVHDSIDYRFNHHCKDHTVSGDEDYCPRSK

SEQ ID NO: 7182 - protein, 74 aa, Homo sapiens
  UNSURE 32: Xaa=Glu or Gly
MVPEAARGKVFQDSQEGAHIRRETVSKSVCAXPWRHQRSRDPAPTNFPLKCQKQRGASTSSGQHGGRVNLVFFI

SEQ ID NO: 7183 - protein, 61 aa, Homo sapiens
  UNSURE 48: Xaa=Lys or Asn
  UNSURE 61: Xaa=Ala or Glu or Gly
MNRHFSKEDIYAANRHTKKCSSSLAIREMQIKTTMRYHLTPVRMAIIXKSGNNRCWRGCGX

SEQ ID NO: 7184 - protein, 81 aa, Homo sapiens
MTPYLNTSNREVKVYVCKSGRLTAIPFWYHMYLDEEIRLDTSSEASHWKQAAVVLDNPIQVEMGEELVLSIQHHKSNVSIT

SEQ ID NO: 7185 - protein, 89 aa, Homo sapiens
  UNSURE 18: Xaa=His or Gln
MAGSPDQEGFFNLLSHVXGDRMEGQRCSLQAGPGQTTKSQSDPTPEMDSLMDMLASTQGRRMDDQRVTVSSLPGFQPVGSKDGAQKRAG

SEQ ID NO: 7186 - protein, 65 aa, Homo sapiens
  UNSURE 13: Xaa=Ile or Val
  UNSURE 56: Xaa=His or Pro
MLSCPHPVLSILXPPDFSRALLGQLRIIFQNVTLSCSVASFSPYKGGLNLPEFTSXCFSLSLTVP

SEQ ID NO: 7187 - protein, 78 aa, Homo sapiens
MVAELAGQQDPGLGAFSCQEARRAWLDRHGNLDEAVEECVRTRRRKVQELQSLGFGPEEGSLQALFQHGGDVSRALTH

SEQ ID NO: 7188 - protein, 52 aa, Homo sapiens
MNRHFSKEDIYAANRHTKKCSSSLAIREMQIKTTMRYHLTPVRMAIIKKSGT

SEQ ID NO: 7189 - protein, 73 aa, Homo sapiens
MCTVDHQDQRDWIKDRVEQIKEYHHLHQAVHAAKVILQVKESLGLNGDFSVLNTLLNFTDNFDDFRRETLDQA

SEQ ID NO: 7190 - protein, 55 aa, Homo sapiens
  UNSURE 30: Xaa=Pro or Gln
  UNSURE 32: Xaa=Glu or Lys or Gln
  UNSURE 45: Xaa=Ala or Gly
  UNSURE 52: Xaa=Asn or Ser
MNRHFSKEDIYAANRHTKKCSSSLAIREMXIXTTMRYHLTPVRMXIIKKSGXNRC

SEQ ID NO: 7191 - protein, 67 aa, Homo sapiens
  UNSURE 61: Xaa= *  or Leu
MIFPHCMYCLECITKNGLLGLKVLPLYGIMLIFFPKVVYNNQPLHYKSVMVFQLTSFLSIXIFVNPT

SEQ ID NO: 7192 - protein, 53 aa, Homo sapiens [sequence omitted]

SEQ ID NO: 7193 - protein, 77 aa, Homo sapiens
MNRHFSKEDIYAANRHTKKCSSSLAIREMQIKTTMRYHLTPVRMAIIKKSGNNRCWRGCGEIETLLHCWGAVTSSII

SEQ ID NO: 7194 - protein, 98 aa, Homo sapiens
MQRTGMNTVSAREKLSAFVRKFPFWQKRIEKRNFTNFPFLEEIIVSDNEGIFIAAEITLHLQQLSNFFHGYFSIGDLNEASKWILDPFLFNIDFVDDS

SEQ ID NO: 7195 - protein, 90 aa, Homo sapiens
  UNSURE 4: Xaa=Ile or Asn
  UNSURE 8: Xaa=Asp or Tyr
  UNSURE 11: Xaa=Asp or Gly
  UNSURE 23: Xaa=Glu or Gln
  UNSURE 68: Xaa=Asp or Glu
  UNSURE 72: Xaa=Glu or Lys
  UNSURE 73: Xaa=Ala or Thr
MGDXFTIXLSXKGLISRIYKELXQIYKKRTNNPIKKWAKDMNRHFSKEDIYAANRHTKKCSSSLAIRXMQIXXTMRYHLTPVRMAIIKKS

SEQ ID NO: 7196 - protein, 71 aa, Homo sapiens
  UNSURE 38: Xaa=Glu or Lys
MSTCTPMFTAASLSLSFFISPFLPSFLSQTPTLLPRLXCSAVISGRCNLRFPGSGDSHASASQEAGITDAP

SEQ ID NO: 7197 - protein, 56 aa, Homo sapiens
  UNSURE 43: Xaa=Arg or Ser
MNRHFSKEDIYAANRHTKKCSSSLAIREMQIKTTMRYHLTPVXMAIIKKSGNNRCW

SEQ ID NO: 7198 - protein, 61 aa, Homo sapiens
  UNSURE 31: Xaa=Phe or Leu
  UNSURE 33: Xaa=Phe or Val
MGGLVIKYLKKKHSKTWPHPTFPQAIPFDSXFXPLHVEEGEGEALKAASGGFQGTGGANHL

SEQ ID NO: 7199 - protein, 83 aa, Homo sapiens
MLGLIFVCEDLIKTPEKGSDHSFMIPHFKLAFTYYFLTLQQYVYKFVVYLAVEFPKNRHCHFIGAQGQLELIIIPNFKISVEN

SEQ ID NO: 7200 - protein, 82 aa, Homo sapiens
  UNSURE 64: Xaa=Ala or Thr
  UNSURE 69: Xaa= *  or Cys or Phe or Leu or Trp
  UNSURE 70: Xaa=Gly or Arg
MNRHFSKEDIYAANRHTKKCSSSLAIREMQIKTTMRYHLTPVRMAIIKKSGNNRCWRGCGEIEXLLHCXXDCKLVQSLWKTV

SEQ ID NO: 7201 - protein, 117 aa, Homo sapiens
  UNSURE 74: Xaa=Leu or Met
  UNSURE 86: Xaa=Asp or Gly
  UNSURE 105: Xaa= *  or Lys or Leu or Met or Ser or Thr
MVKAPQSEERLARGGKENNSVLDRVSHCHPGWSAVVQPHLPGSSNSHASASQVAGITGSSYRRVSCSPTPTIVXTGDATSPEGETXKNLANRVHSPHKRLSHRHXKVSTASLTSVDP

SEQ ID NO: 7202 - protein, 73 aa, Homo sapiens
MLFFTQCFGAVLDLIHLRFQHYKAKRVFSAAGQLVCVVNPTHNLKYVSSRRAVTQSAPEQGSFHPHHLSHHHR

SEQ ID NO: 7203 - protein, 118 aa, Homo sapiens
  UNSURE 92: Xaa=Asn or Thr
MCTVVDPRIVRRYLLRRQLGQGRTFREITLLQEFGDHPNIISLLDVIRAENDRDIYLVFEFMDTDLNAVIRKGGLLQDVHVRSIFYQLLRAXRFLHSGHVVHRDQKPSNVLLDANCTV

SEQ ID NO: 7204 - protein, 64 aa, Homo sapiens
MKKGKSTGSLLTPTRGESEKQEPTWKTKIADRLKLRPRAPADDMFGVGNHKVNAETAKRKSIRH

SEQ ID NO: 7205 - protein, 84 aa, Homo sapiens
  UNSURE 46: Xaa=Asp or Glu
  UNSURE 76: Xaa=Ala or Pro or Ser or Thr
MWIPVVGLPRRLRLSALAGAGRFCILGSEAATRKHLPARNHCGLSXSSPQLWPEPDFRNPPRKASKASLDFKRYVXDRRLAETW

SEQ ID NO: 7206 - protein, 111 aa, Homo sapiens
  UNSURE 54: Xaa=Arg or Ser
  UNSURE 55: Xaa= *  or Lys or Gln
  UNSURE 69: Xaa=Arg or Ser
  UNSURE 101: Xaa=Ala or Asp
MDRFLGFVKAIRRSRRRKGKKYRPEEDYHEGYEDVYYYASEHFRNESPYTKSAXXTKPPDGALAVRRQXIPEEFKGSTVVELMKKEGTTLGLTVSGGIDKXGKPRVSNLRQ

SEQ ID NO: 7207 - protein, 75 aa, Homo sapiens
  UNSURE 22: Xaa= *  or Lys or Gln or Arg or Trp
  UNSURE 42: Xaa=Ala or Glu or Gly or Val
  UNSURE 44: Xaa=Ile or Arg
  UNSURE 47: Xaa=Ala or Gly
  UNSURE 73: Xaa=Leu or Met or Val
MGPAALGTEGVAPSPALLPLPXPSHRTLFPHPSPASQEPLGXEXGWXRKLSCEAKGHYPFLFPSWQSWPHCLXLN

SEQ ID NO: 7208 - protein, 75 aa, Homo sapiens
MGQGGEAAHHTRSPYSTFYPPYHSPELTTPPGHGTLDNSKSMKPYNYCSAYESFYESTSPECASPQFEGPLSPPP

SEQ ID NO: 7209 - protein, 63 aa, Homo sapiens
  UNSURE 22: Xaa=Cys or Trp
MFVIDLGIFKRNFEGIRFCHTXWALNVKSQDEIPLLLSGPCGGWPLWELVDFLVKSLVCFLPP

SEQ ID NO: 7210 - protein, 78 aa, Homo sapiens
MLYALDNDREEDIYWECVLRLNKQPDIALLGFLGVQRKFWPATLSILGESKKVLPTTKDACFASAVECLQQISTTFTP

SEQ ID NO: 7211 - protein, 83 aa, Homo sapiens
  UNSURE 12: Xaa=Arg or Thr
  UNSURE 29: Xaa=Arg or Ser
MFDTTPHSGRSXPSSSPSLRKRLQLLPPXRPPPEPEPGTMVEKGSDSSSEKGGVPGTPSTQSLGSRNFIRNSKKMQSWYSMLS

SEQ ID NO: 7212 - protein, 55 aa, Homo sapiens
MEKHSMLMDRKINIMKMAILPKVIYRFNAIPIKLPLTFFTELEKTKFHMEPKKSA

SEQ ID NO: 7213 - protein, 64 aa, Homo sapiens
  UNSURE 6: Xaa= *  or Gly or Ile or Leu or Arg or Val
  UNSURE 27: Xaa=Asp or Glu
  UNSURE 57: Xaa=Leu or Val
MEDGGXTAFEEDQRCLSQSLPLPVSAXGPAAQTTAEPSRSFSSAHRHLSRRNGLSRXCQSRTAL

SEQ ID NO: 7214 - protein, 129 aa, Homo sapiens
  UNSURE 108: Xaa=Ala or Asp or Gly
MDRHFSKEDIYAAKKHMKKCSSSLAIREMQIKTTMRYHLTPVRMAIIKKSGNNRCWRGCGEIRTLLHCWWDCKLVQPLWKSVWQFLRDLELEIPFDPAIPLLGIYPKXYKSCCYKDTCTHMFIAALFTI

SEQ ID NO: 7215 - protein, 84 aa, Homo sapiens
  UNSURE 4: Xaa=Gly or Ser
  UNSURE 8: Xaa=Asp or Glu
MNAXSEGXSFAGSVQIPGGTTVLVELTPDIHICGICKQQFNNLDAFVAHKQSGCQLTGTSAAAPSTVQFVSEETVPATQTQTTT

SEQ ID NO: 7216 - protein, 69 aa, Homo sapiens
MDENMDESDKRKCSRSPKKIKIEPDSEKDEVKGSDAAKGADQNEMDISKITEKKDQDVKELLDSDSDKP

SEQ ID NO: 7217 - protein, 56 aa, Homo sapiens
MFPSLCPYVLIVQLPLMSENMQCLVFCSCVSLLRMMVSSVIHDPAKDMNSSFFMAA

SEQ ID NO: 7218 - protein, 63 aa, Homo sapiens
MSMFSSPTWTPATCVDVELGTALEASLTFLYSGIFSSSQNGSSQLTYLQGHRCFCQTKPDVKL

SEQ ID NO: 7219 - protein, 61 aa, Homo sapiens
  UNSURE 12: Xaa=His or Pro or Arg
MAMTAGTTTTFXMSNHTRERVTVAKLTLENFYSNLILQHEERETRQKKLEVAMEEEGLADD

SEQ ID NO: 7220 - protein, 69 aa, Homo sapiens
  UNSURE 30: Xaa=Ala or Glu or Gly or Lys or Leu or Met or Pro or Gln or Arg or Thr or Val
MGLPTDNGHDSDQVFEFNGTQAVRIPDGVXSVSPKEPFTISVWMRHGPFGRKKETILCSSDKTDMNRHH

SEQ ID NO: 7221 - protein, 58 aa, Homo sapiens
  UNSURE 42: Xaa=Phe or Ser
  UNSURE 44: Xaa= *  or Trp
  UNSURE 55: Xaa=Ile or Asn
MTGDFPRPAEAPSTPTLVHAHTHTHTHTHTHTFLAFDPLCVXHXSYLFLNRFTQXYPI

SEQ ID NO: 7222 - protein, 60 aa, Homo sapiens
  UNSURE 6: Xaa= *  or Tyr
  UNSURE 7: Xaa=Ala or Asp or Glu or Gly
  UNSURE 47: Xaa= *  or Ala or Glu or Gly or Ile or Lys or Leu or Pro or Gln or Arg or Ser or Thr or Val
MFNLHXXFYVRVSWKHSASRLIAIDSDMRINVIESLFMVRSTSQCLXPGFLILSEMGAAS

SEQ ID NO: 7223 - protein, 67 aa, Homo sapiens
MFRRWGLQLPLSCSCVSTSLMPVGTSERHKAKNSWPGLQGSAANAENGSAPLRTPPHLPLPSSLSLP

SEQ ID NO: 7224 - protein, 66 aa, Homo sapiens
MPWLLSAPKLVPAVANVRGLSGCMLCSQRRYSLQPVPERRIPNRYLGQPSPFTHPHLLRPGEVTPG

SEQ ID NO: 7225 - protein, 55 aa, Homo sapiens
  UNSURE 29: Xaa= *  or Leu or Ser or Trp
MEGSEPVAAHQGEEASCSSWGTGSTNKNXPIMSTASVEIDDALYSRQRYVLGDTA

SEQ ID NO: 7226 - protein, 80 aa, Homo sapiens
  UNSURE 75: Xaa=Asp or Gly
  UNSURE 77: Xaa=Glu or Gly
MTQSVVVQVGQCGNQIGCCFWDLALREHAAVNQKGIYDEAISSFFRNVDTRVVGDGGSISKGKICSLKARAVLIXMXEGV

SEQ ID NO: 7227 - protein, 67 aa, Homo sapiens
MPERILSMLKWINSLWNVLFNCFHTRNSSNYVQLLFKAPNNSLHCSLWPGQHLPSHHESFLFFHLNI

SEQ ID NO: 7228 - protein, 67 aa, Homo sapiens
MAHRGGERDFQTSARRMGTSLLFQLSVHERELDLVFLDHSYAKPWSAHPDASSARPTRMLFVTPRRS

SEQ ID NO: 7229 - protein, 128 aa, Homo sapiens
  UNSURE 82: Xaa=Leu or Pro or Arg
MAFKYLVHCLQSELNNYMPAFLDDPEENSLQRPKIDDVLHTLTGAMSLLRRCRVNAALTIQLFSQLFHFINMWLFNRLVTDXDSGLCSHYWGAIIRQQLGHIEAWAEKQGLGTGCGLSSEQDRAGNDF

SEQ ID NO: 7230 - protein, 76 aa, Homo sapiens
MVVPQVESGQKFLQHFFFKLLGAKSQTRICVCLCVYVFYLTLPSFNLPPFISNVEKAKLNLESKLLYIVAVTIMKR

SEQ ID NO: 7231 - protein, 60 aa, Homo sapiens
  UNSURE 51: Xaa=Ile or Leu or Val
MDTLVSSDCKYIACFILMVHYFIQQAFHLRMFNVDLILRASRSKYFSAELXGSHYSVVQC

SEQ ID NO: 7232 - protein, 55 aa, Homo sapiens
  UNSURE 4: Xaa=Asp or Asn or Tyr
MPLXPLRVRLVSHLNNYASQREAGERRPTRASDTFPGGPSSDITRTSRTRCCCPS

SEQ ID NO: 7233 - protein, 84 aa, Homo sapiens
  UNSURE 68: Xaa=Asp or Glu
  UNSURE 69: Xaa=Ala or Asp or His or Asn or Pro or Ser or Thr or Tyr
MNRQGNRKTTKEGSNDLKFQNFSLPKNRSWPRINSATGQYQRMNKPLLDWERNFAAVLDGAKGHSDDXXDDPELRMEETWQSIK

SEQ ID NO: 7234 - protein, 90 aa, Homo sapiens
  UNSURE 18: Xaa=Asp or Glu
  UNSURE 46: Xaa=Leu or Val
  UNSURE 78: Xaa=Ala or Gly
MSGEPGQTSVAPPPEEVXPGSGVRIVVEYCEPCGFEATYLELASAXKEQYPGIEIESRLGGTGAFEIEINGQLGVLQXGEWGFPYEKDVS

SEQ ID NO: 7235 - protein, 53 aa, Homo sapiens
  UNSURE 11: Xaa=Phe or Leu
  UNSURE 13: Xaa= *  or Lys
MCILFLNSLFXFXLFYPFSYNRLLMNIASNISFYICQEWFRGRILCLFLMIGS

SEQ ID NO: 7236 - protein, 59 aa, Homo sapiens
  UNSURE 11: Xaa=Ala or Pro
  UNSURE 19: Xaa=Lys or Arg
  UNSURE 36: Xaa=Asp or Glu
  UNSURE 40: Xaa=Asp or Glu
MRRILWQKAGXWMGRGAAXPRWAPLPLPGPAQVLRXLGPXIISACIMDASFSLLGNPQS

SEQ ID NO: 7237 - protein, 99 aa, Homo sapiens
  UNSURE 27: Xaa=Glu or Lys
  UNSURE 65: Xaa=Lys or Thr
MHQDQEGDTDAGLKAEEAGIGDTPSLXDEAAGHVTQARMVSKSKDGTGSDDKKAKGADGKTKIAXPRGAAPPGQKGQANATRIPAKTPPAPKTPPSSGE

SEQ ID NO: 7238 - protein, 95 aa, Homo sapiens
MEKNKVKLYHCLKDETFSWPGPKTVTLKRTSQGFGFTLRHFIVYPPESAIQFSYKDEENGNRGGKQRNRLEPMDTIFVKQVKEGGPAFEAGLCTG

SEQ ID NO: 7239 - protein, 82 aa, Homo sapiens
MNPFHASCWNTSAELLNKSWNKEFAYQTASVVDTVILPSMIGIICSTGLVGNILIVFTIIRSRKKTVPDIYICNLAVADLVH

SEQ ID NO: 7240 - protein, 56 aa, Homo sapiens
MDFKIAGTNKGITALQADIKLPGIPIKIVMEAIQTSFSGKKGDITDHEQNYFKTSS

SEQ ID NO: 7241 - protein, 142 aa, Homo sapiens
  UNSURE 6: Xaa= *  or Glu or Gly
MPGGSXGRKMAAGDIGELLVPHMPTIRVPRSGDRVYKNECAFSYDSPKVTIACDAVLSSKSPYRKQDPDTWENELPVSKYANNLTQLDNGVRIPPSGWKCARCDLRENLWLNLTDGSVLCGKWFFDSSGGNGHALEHYRDMG

SEQ ID NO: 7242 - protein, 63 aa, Homo sapiens
  UNSURE 12: Xaa= *  or Tyr
  UNSURE 33: Xaa=Ala or Asp
  UNSURE 34: Xaa=Ala or Asp
  UNSURE 36: Xaa=Asp or Phe or Ile or Asn or Val or Tyr
  UNSURE 38: Xaa=Leu or Val
  UNSURE 39: Xaa=His or Gln
  UNSURE 40: Xaa=His or Asn
  UNSURE 41: Xaa=His or Asn
  UNSURE 43: Xaa=Ile or Met
  UNSURE 44: Xaa=His or Pro
  UNSURE 45: Xaa=Ala or Thr
  UNSURE 47: Xaa= *  or Phe or Ile or Lys or Leu or Asn or Tyr
  UNSURE 52: Xaa=Ala or Asp
  UNSURE 60: Xaa=Ala or Glu
MPGAQSLQVGRXDRSELRPEQPASGMKVWGLAXXCXLXXXXGXXXQXTLPPXPRDETSPXDAV

SEQ ID NO: 7243 - protein, 108 aa, Homo sapiens
  UNSURE 34: Xaa= *  or Glu or Gln
  UNSURE 49: Xaa=Lys or Arg
  UNSURE 52: Xaa=Ile or Ser
  UNSURE 53: Xaa=Cys or Asp or Phe or Gly or Ile or Asn or Ser or Val or Tyr
  UNSURE 83: Xaa=Arg or Ser
  UNSURE 87: Xaa=Ala or Asp or Glu
  UNSURE 88: Xaa=Asp or Asn or Tyr
MENLLKIKIIREAYKKAFLFVNKGLNTDELGQKXEAKNYYKQGIGHLLXGIXXSSKESEHTGPGWESARQMQQKMKETLQNVXTRLXXSREGSCHFSSRMIFRRCPSY

SEQ ID NO: 7244 - protein, 51 aa, Homo sapiens
  UNSURE 20: Xaa=Cys or Gly
  UNSURE 25: Xaa=Lys or Asn
  UNSURE 28: Xaa= *  or Glu or Gly or Lys or Gln or Arg or Trp
  UNSURE 29: Xaa=His or Asn
  UNSURE 30: Xaa=Ala or Pro or Ser
MIANVFLSIYTLGPGKHFIXIISFXSPXXXSGEIICIILVLQLRKLRLRGG

SEQ ID NO: 7245 - protein, 57 aa, Homo sapiens
MCVHPGACLPHVGVSWAEFPGHFSVELSSLLVRNVNYEIPSLKKQIAKCQQLQQEYS

SEQ ID NO: 7246 - protein, 60 aa, Homo sapiens [sequence omitted]

SEQ ID NO: 7247 - protein, 58 aa, Homo sapiens
  UNSURE 5: Xaa=Glu or Gln
  UNSURE 7: Xaa=Cys or Trp
  UNSURE 8: Xaa=Gly or Arg
MLRAXIXXKLKSSVGFGLYKEDQNNRGNADFLALHDTWSNALYLPHSCPVVRFPLTFP

SEQ ID NO: 7248 - protein, 53 aa, Homo sapiens
MNTIQKITSVCKDAEILKAVVQPLWKVVSSYFKQLNITLPYDPAITCQCMHPP

SEQ ID NO: 7249 - protein, 78 aa, Homo sapiens
  UNSURE 57: Xaa=Ala or Asp or Glu or Gly
MSGDGPGSWGLEGRGPSALGSQGALPAQPGLSWEPLAQRLSLANLGGCVHPARPSCXLHSSPCSLLPRFESRVCGHSL

SEQ ID NO: 7250 - protein, 72 aa, Homo sapiens
MWQKTETVKQENAAVQKMVENLKKQISELKIKNQQLDLENTELSQKNSQNQEKLQELNQRLTEMLCQKEKEP

SEQ ID NO: 7251 - protein, 78 aa, Homo sapiens
  UNSURE 6: Xaa=Lys or Arg
  UNSURE 7: Xaa=His or Arg
  UNSURE 23: Xaa=Cys or Ser
  UNSURE 60: Xaa=Ala or Thr
MAQTFXXHIWAHEGVKPFKCSLXEYATRSKSNLKAHMNRHSTEKTHLCDMCGKKFKSKGXLKSHKLLHTADGKQFKCT

SEQ ID NO: 7252 - protein, 51 aa, Homo sapiens
  UNSURE 15: Xaa= *  or Glu or Gly or Trp
MSPFVALCGPCGIHXRSSSSDWSPLQLWIFKRVRQCGGGVPLLTPPWCLTH

SEQ ID NO: 7253 - protein, 110 aa, Homo sapiens [sequence omitted]

SEQ ID NO: 7254 - protein, 75 aa, Homo sapiens
  UNSURE 55: Xaa=Ala or Val
MKEYGPIHILWSASEEDLVDTLKDVASCIDRCCKATEKRMSGLSEALLPVVHEYXLYSEMLMGVMKRRDQIQAER

SEQ ID NO: 7255 - protein, 77 aa, Homo sapiens [sequence omitted]

SEQ ID NO: 7256 - protein, 55 aa, Homo sapiens
  UNSURE 52: Xaa=Ile or Met
MEVKGPSGRSFCCESEGQFKSCLKRHTPSLLLPSSWKGNSGSCLMAEALHRXSPT

SEQ ID NO: 7257 - protein, 55 aa, Homo sapiens
MITFYVRFFLTYVPLLGLKAFLGLFFIVRFLESNWFVWVTQMNHIPMHIDHDRNK

SEQ ID NO: 7258 - protein, 55 aa, Homo sapiens
  UNSURE 45: Xaa=Asp or Gly
  UNSURE 53: Xaa= *  or Ser
MWKTQEANSTVFLWSGCKGRDLTLYILMAAFEYLLTPSSLNWGCXILESSTHXKV

SEQ ID NO: 7259 - protein, 59 aa, Homo sapiens
MKLIINFTENPAMTRELVSCKVPSELISLFNKEWDREILLNILTLFENINDNIKNEGLA

SEQ ID NO: 7260 - protein, 94 aa, Homo sapiens
  UNSURE 34: Xaa=Leu or Trp
  UNSURE 36: Xaa=Ala or Gly
  UNSURE 39: Xaa=Cys or Arg or Ser
  UNSURE 41: Xaa=Leu or Met
  UNSURE 53: Xaa=Ile or Val
  UNSURE 88: Xaa=Ala or Asp or Glu or Gly or Ile or Lys or Met or Asn or Arg or Ser or Thr or Val
MNKPGAFTAEFSRQPSGTRMRQPLRIFFGTKNKXVXVQXPXAKTTQKRHKGSXNRSSLLLHGVLLSIFLKLKVPVSNICCMPIKMGLXRGAGEE

SEQ ID NO: 7261 - protein, 51 aa, Homo sapiens
MGSSATEIEELENTTFKYLTGEQTEKMWQRLKGILRCLVKQLERGDVNVVN

SEQ ID NO: 7262 - protein, 67 aa, Homo sapiens
MALDIEIAAYRKLLEGEETRLSFTSVGSITSGYSQSSQVFGRSAYGGLQTSSYLMSTRSFPSYYTSL

SEQ ID NO: 7263 - protein, 102 aa, Homo sapiens
  UNSURE 27: Xaa=Ala or Asp
  UNSURE 32: Xaa=His or Asn or Arg or Ser
  UNSURE 36: Xaa=Asp or Asn
  UNSURE 41: Xaa=Asp or Gly
  UNSURE 79: Xaa=Lys or Thr
  UNSURE 83: Xaa=Lys or Arg
  UNSURE 89: Xaa=Ser or Tyr
MTGIAAASFFSNTCRFGGCGLHFPTLXDLIEXIEDXHIDTXPRVLEKQELQQPTYVALSYINRFMTDAARREQESLKKXIQPXLSLTLXSSSVSRECVHSPT

SEQ ID NO: 7264 - protein, 84 aa, Homo sapiens
  UNSURE 16: Xaa=Gly or Arg
MHQQPCILFDFVIDLXLKNNSQCPACRVPITPENPCKEIIGGTSESEPMLSHTVRKHLRKTRLELLHKEYEDEIDCLQKEVEEP

SEQ ID NO: 7265 - protein, 58 aa, Homo sapiens
  UNSURE 3: Xaa=Lys or Asn
  UNSURE 4: Xaa=Pro or Thr
  UNSURE 20: Xaa=Asp or Glu
  UNSURE 21: Xaa=Gly or Arg
  UNSURE 27: Xaa=Asp or Gly
  UNSURE 38: Xaa=Ala or Gly or Pro or Arg
  UNSURE 42: Xaa=His or Asn
  UNSURE 48: Xaa=Ile or Val
  UNSURE 51: Xaa=Lys or Thr
MWXXSEASKNHPLIQEGQGXXPYRDVXMLDVPRLSEPXFPQXPSLQSXYFXSALSGTD

SEQ ID NO: 7266 - protein, 96 aa, Homo sapiens
  UNSURE 12: Xaa=Cys or Ser
  UNSURE 16: Xaa=Ile or Lys or Asn or Arg or Ser
  UNSURE 39: Xaa= *  or Tyr
  UNSURE 45: Xaa=His or Gln
  UNSURE 72: Xaa=Ser or Thr
  UNSURE 79: Xaa=Arg or Ser
  UNSURE 80: Xaa= *  or Arg
MCKCPQTRCTPXSLVXSFQAASSSSPTTSPSPVDISAKXFWNFIXFFWFPSPKHSHFTWTISIITQVSNLLXSLGHIGXXKIVLCHTYNTLTLTIA

SEQ ID NO: 7267 - protein, 64 aa, Homo sapiens
  UNSURE 31: Xaa=Cys or Phe or Tyr
MVHVDKRITLAAFKQHLEPFVGVLSSHFKVXRVYASNQEFESVRLNETLSSFSDDNKITIRPGR

SEQ ID NO: 7268 - protein, 82 aa, Homo sapiens
  UNSURE 77: Xaa=Phe or Ile
MSEPGKGDDCLELESSMAESRLRAPDLGVSRCLGKCQKNSPGARKHPFSGKSFYLDLPAGKNLQFLTGAIQQLGGVXEGFLS

SEQ ID NO: 7269 - protein, 56 aa, Homo sapiens
  UNSURE 5: Xaa=His or Arg
  UNSURE 7: Xaa=His or Gln
  UNSURE 9: Xaa=His or Gln
  UNSURE 11: Xaa= *  or Asp or Glu or His or Gln or Tyr
  UNSURE 13: Xaa=Cys or Ser
  UNSURE 16: Xaa=Lys or Asn
  UNSURE 32: Xaa= *  or Lys
  UNSURE 46: Xaa= *  or Cys
MPGPXRXSXCXKXHSXESDLETGCHNHFSFLXTQLTCIFKLFLASXNTYFYSGTQL

SEQ ID NO: 7270 - protein, 51 aa, Homo sapiens
MEANGLGPQGFPELKNDTFLRAAWGEETDYTPVWCMRQAGRYLPEFRETRA

SEQ ID NO: 7271 - protein, 72 aa, Homo sapiens
  UNSURE 13: Xaa=Pro or Thr
  UNSURE 21: Xaa=Lys or Arg
  UNSURE 32: Xaa=Leu or Met
MPLASSSLVTNTXTFPHHICXYSSCGWQFCPXKESMSVVFGKGHISKNSKVRARPITLEILVHEGLFYSPTA

SEQ ID NO: 7272 - protein, 102 aa, Homo sapiens
  UNSURE 9: Xaa=Pro or Thr
  UNSURE 61: Xaa=Ala or Glu or Val
  UNSURE 62: Xaa=Phe or Ile or Leu or Val
  UNSURE 67: Xaa=His or Gln
  UNSURE 72: Xaa=Lys or Gln
MRLKMFLTXHMCVMASLICSRQLFGWLFRRVRFEKVIFGILTVMSIQGYANLRNQWSIIGXXNNLPXEELLXWIKYSTTSDAVFAGAMPTMASIKLSTLHPI

SEQ ID NO: 7273 - protein, 58 aa, Homo sapiens
MPEPSGLGDEGRPLLLPGGREAVGSWVGAFAADSTPCGPGDLSVPRRDPFGLTALEPH

SEQ ID NO: 7274 - protein, 70 aa, Homo sapiens
MVGPNFRVGKKIGCGNFGELRLGKNLYTNEYVAIKLEPMKSRAPQLHLEYRFYKQLGSGDGIPQVYYFGP

SEQ ID NO: 7275 - protein, 51 aa, Homo sapiens
MDNPTFAEDEELQNMDKEDALICFEEHIRALEKEEEEEKQKSLLRERRRQR

SEQ ID NO: 7276 - protein, 72 aa, Homo sapiens
  UNSURE 62: Xaa=Cys or Phe
  UNSURE 65: Xaa=Cys or Phe
MDHRTLNLQIQVFPLPTRSGFLKIMSWIIASISNFLVSGSSMILTLDLCISYVCHVLKIIFXSSXSSHLSPT

SEQ ID NO: 7277 - protein, 69 aa, Homo sapiens
  UNSURE 10: Xaa=Asp or Glu or Gly
MRCRAWRGAXRQEQHVAAAILGALGEVGCPLPPSPRCQEEVADSITQGLTEPCPAGARTSHTFPAALPP

SEQ ID NO: 7278 - protein, 109 aa, Homo sapiens
MCFSLGTGKTLLAKAVATECKTTFFNISASTIVSKWRGDSEKLVRVLFELARYHAPSTIFLDELESVMSQRGTASGGEHEGSLRMKTELLVQMDGLARSEDLVFVLAAS

SEQ ID NO: 7279 - protein, 105 aa, Homo sapiens
MNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEA

SEQ ID NO: 7280 - protein, 83 aa, Homo sapiens [sequence omitted]

SEQ ID NO: 7281 - protein, 113 aa, Homo sapiens
MQLVYKNPKECFLIQPKERKENTTKTRKRRKKITDVLAKSEPKPGLPEDLQKLMKDYYSSRRLVIELEELNLPDSCFLKANDLTHSLSSYLKEICPKWVKLRKNHSEKKSVLM

SEQ ID NO: 7282 - protein, 71 aa, Homo sapiens
  UNSURE 48: Xaa=Asp or Val
MDLRTHVNAIALQGCEVAPGFGPRHPFAFRILRNRQEVAILEASCSEXMGRWLGLLLVEMGSRVTPEALHY

SEQ ID NO: 7283 - protein, 65 aa, Homo sapiens
  UNSURE 41: Xaa=Lys or Arg
  UNSURE 46: Xaa=Cys or Gly
MRLSDDTLLDIMRRFRAEMEKGLAKDTNPTAAVKMLPTFVXAIPDXSENGEFLSLDLGGSKFRVL

SEQ ID NO: 7284 - protein, 104 aa, Homo sapiens
MSELPFTIASKRIKYLGIQLTRDVKDLFKENYKPLLKEIKEDTNKWKNIPCSWVGRINIVKMAILPKVIYRFNAIPIKLPMTFFTELEKNYFKVHMESKKSPHR

SEQ ID NO: 7285 - protein, 70 aa, Homo sapiens
MCPSLEEAPSVKGTLPCSGQQQPFPFGASNIPLLLGRSRKVARGAPVLWPFLTWINPALSICDPLGSCGW

SEQ ID NO: 7286 - protein, 52 aa, Homo sapiens
MSNLKYNRLTSSSGISKPFLWLCGPRTVSVSFFCFCMCIYVYKLFKNVRNSQ

SEQ ID NO: 7287 - protein, 59 aa, Homo sapiens
  UNSURE 54: Xaa=Ala or Thr
MLKTRRITESLEHFLYPDEPSTSHLASTSHPGDQRIRLCRNHQGLRKKSLHNLXFRSPQ

SEQ ID NO: 7288 - protein, 53 aa, Homo sapiens
  UNSURE 22: Xaa=Gln or Arg
MKKKILPAVCKGLESQLASFIXVSSLQRTLKIGAEQGYNLQLSEKKIQPPPPK

SEQ ID NO: 7289 - protein, 69 aa, Homo sapiens
  UNSURE 59: Xaa=Ala or Ser
MYLDHGYLDLRKSSSLSGSDYCHYSLSHLDFKVGQVKRCKGSVTVTGRAESKISPFTFXLMQCLRNEHF

SEQ ID NO: 7290 - protein, 99 aa, Homo sapiens
  UNSURE 2: Xaa=Asp or Gly
MXDLGTMISQIEEIERHLAYLKWISQIEELSDNIQQYLMTNNVPEAASTLVSMAELDIKLQESSCTHLLGFMRATVKFWHKILKDKLTSDFEEILAQLH

SEQ ID NO: 7291 - protein, 115 aa, Homo sapiens
MAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDI

SEQ ID NO: 7292 - protein, 67 aa, Homo sapiens
MHWSPTQVDLQLMHSCKEGYVKDLKGNPGLHSPMLDLDNDTRPSVLGHLSQTASLKRGSSFQSGRDD

SEQ ID NO: 7293 - protein, 54 aa, Homo sapiens
MRHSICCSDYIFLPFIDFMILWLHGENGTGPAKFNIPHSVTLDSAGRVWVADRD

SEQ ID NO: 7294 - protein, 83 aa, Homo sapiens
MDGKQGGMDGSKPAGPRDFPGIRLLSNPLMGDAVSDWSPMHEAAIHGHQLSLRNLISQGWAVNIITADHVSPLHEACLGGHLS

SEQ ID NO: 7295 - protein, 55 aa, Homo sapiens
  UNSURE 31: Xaa=Lys or Leu or Met or Pro or Gln or Thr
  UNSURE 32: Xaa=Leu or Trp
  UNSURE 50: Xaa=Pro or Ser
MAIIPAFWEAEAGGSPEVRSSGLAWPTWRNXXSLLEMQKLAGRGGGHLWXSYLGG

SEQ ID NO: 7296 - protein, 76 aa, Homo sapiens
  UNSURE 63: Xaa=Arg or Ser
  UNSURE 64: Xaa=Phe or Leu or Val
MGTGFFETDRVKACIQSGCVAVQMGIFHSPAPAASPHPELSPSCPLLRQLPSPHPGPWGTEQXXTTDSLAAFSPNA

SEQ ID NO: 7297 - protein, 111 aa, Homo sapiens
  UNSURE 96: Xaa=Cys or Phe
  UNSURE 99: Xaa=Lys or Arg
  UNSURE 100: Xaa=His or Asn
MERKISRIHLVSEPSITHFLQVSWEKTLESGFVITLTDGHSAWTGTVSESEISQEADDMAMEKGKYVGELRKALLSGAGPADVYTFNFSKESCYFXFEXXLKDVSFRLGSF

SEQ ID NO: 7298 - protein, 86 aa, Homo sapiens
MQRLFQSDSEEKEAEEAVGGLRMGFSLLHFRLLVPQQVGKTDIMLAIEKLQAGALATDAVTAALVELEVYTHSYASWSCIQPSIHV

SEQ ID NO: 7299 - protein, 96 aa, Homo sapiens
MALSAQQIPRWFNSVKLRSLINAAQLTKRFTRPARTLLHGFSAQPQISSDNCFLQWGFKTYRTSSLWNSSQSTSSSSQENNSAQSSLLPSMNEQPQ

SEQ ID NO: 7300 - protein, 100 aa, Homo sapiens
MTGKTQTSNVTNKNDPKSINSRVFIGNLNTAIVKKVDIEAIFSKYGKIVGCSVHKGYAFVQYMSERHARAAVAGENARVIAGQPLGKSCSDMDLTLLFIY

SEQ ID NO: 7301 - protein, 65 aa, Homo sapiens
  UNSURE 40: Xaa= *  or Asp or Glu or Tyr
  UNSURE 41: Xaa=Pro or Thr
MIDDGWWRGVLQGPVRALPSQLCGAAAVGPPAPPRSCALXXHTTDQAFFGSWVVLGFFCFFFFFF

SEQ ID NO: 7302 - protein, 82 aa, Homo sapiens
  UNSURE 4: Xaa= *  or Trp
MRKXKKIVLKVVKQCCGTDGVEANYIKTEILPPFFKHFWQHRMALDRRNYRQLVDTTVELANKVGAAEIISRIVDDLKDEAQ

SEQ ID NO: 7303 - protein, 112 aa, Homo sapiens
  UNSURE 12: Xaa=Asp or Asn
  UNSURE 14: Xaa=Ala or Thr
  UNSURE 96: Xaa=Ala or Thr
MVMHNYESSGIXIXKGTELQIAVVSPLVLSEVKTLSVKGITPAVLPETVYPVIKEGSVCSLQNQLAENAKATAALKVDVSGPVASTATSTKIFPLXQKEKQNESTNGNSEVT

SEQ ID NO: 7304 - protein, 99 aa, Homo sapiens
MLPSTSVNSLVQGNGVLNSRDAARHTAGAKRYKYLRRLFRFRQMDFEFAAWQMLYLFTSPQRVYRNFHYRKQTKDQWARDDPAFLVLLSIWLCVSTIGF

SEQ ID NO: 7305 - protein, 66 aa, Homo sapiens
  UNSURE 27: Xaa= *  or Ile or Lys or Leu
MFIAAVFTIAKTWNQPKCPSMIDWIKXMWHIYTMEYSAAIKKDEFMSLAGTWMKLETVILSKLTQD

SEQ ID NO: 7306 - protein, 90 aa, Homo sapiens
MGGDNPEVGKKARNSSKFELRKSPVFSDEDSDLDFDISKLEQQSKSGKSSRNVNNKDFFDPVESDEDIASDHDDELGSNKMMKLLKKKQR

SEQ ID NO: 7307 - protein, 89 aa, Homo sapiens
MFYFISRRGLSEGRRRHGFTVRSKDSLPTHFTRNVQKAIDKYTCKSLSSFSSSGSHTPTGAHTSWSGSATQSSTTGSSTERGSVYSWRG

SEQ ID NO: 7308 - protein, 95 aa, Homo sapiens
MDPSADTWDLSSPLISLWINRFYIYLGFAVSISLWICVQIVIEMQGFATVLAEAVTSLDLPVAIINLKEYDPDDHLIEEVTSKNVCVFLVATYTG

SEQ ID NO: 7309 - protein, 69 aa, Homo sapiens
  UNSURE 32: Xaa= *  or Asp or Glu or Tyr
  UNSURE 33: Xaa=Leu or Met or Val
  UNSURE 46: Xaa=Asp or Glu or Val
MSSLPGCIGLDAATATVESEEIAELQQAVVEXXGISMEELRHFIDXELEKMDCVQQRKKQLAELETWVI

SEQ ID NO: 7310 - protein, 80 aa, Homo sapiens
MKIKMTAPVTSYVEPGSGPFSESTITISLYIPSEQQFDPPRPLESDVFIEDRAEMTVFVRSFDGFSSAQKNQEQLLTLAS

SEQ ID NO: 7311 - protein, 67 aa, Homo sapiens
  UNSURE 33: Xaa= *  or Gly or Arg
  UNSURE 41: Xaa=Cys or Trp
MAGPLSPSFRAALCRNLESPSSRLCGGVGSVIXREFSFRVXSSSVEEAVGRGVPSPSFLLLKIKSWP

SEQ ID NO: 7312 - protein, 79 aa, Homo sapiens
MKIRKNISEIRELENIEEHQSVDIATLEDEAQENKSKMKMVEEHMEQQKENMEHLKSLKIEAENKYDAIKFKINQLSEP

SEQ ID NO: 7313 - protein, 93 aa, Homo sapiens
  UNSURE 46: Xaa= *  or Arg
  UNSURE 47: Xaa=His or Gln
  UNSURE 48: Xaa=His or Asn
MSAAASSRERNTAGGSNFDGLRPNGKGVPMDQSSRGQDKPESLQPXXXKSKSEITDMVRSSTITVSDKAHILSMQKFGLRDTIVKSHLLQKEE

SEQ ID NO: 7314 - protein, 62 aa, Homo sapiens
  UNSURE 17: Xaa=Cys or Ser
MLGEMVDSRDGAVKPHXKPGPSDCTEVKKCLKNDDNMSQGHISELEDVPTGQTWDNWSIKVN

SEQ ID NO: 7315 - protein, 98 aa, Homo sapiens
  UNSURE 79: Xaa=His or Gln
MEADLSGFNIDAPRWDQRTFLGRVKHFLNITDPRTVFVSERELDWAKVMVEKSRMGVVPPGTQVEQLLYAKKLYDSAFXPDTGEKMNVIGRMSFQLPG

SEQ ID NO: 7316 - protein, 84 aa, Homo sapiens
MENMEQVFEQCQQFEEKRLRFFREVLLEVQKHLDLSNVAGYKAIYHDLEQSIRAADAVEDLRWFRANHGPGMAMNWPQFEVRGG

SEQ ID NO: 7317 - protein, 95 aa, Homo sapiens
  UNSURE 11: Xaa=Ala or Pro
MKHYLCGCCAXSTMSQSHFPFRRSLFRQQLYGIKTRDAILQLRRDGFRNLYRGILPPLMQKTTTLALMFGLYEDLSCLLHKHVSAPEFATSGVAA

SEQ ID NO: 7318 - protein, 87 aa, Homo sapiens
  UNSURE 74: Xaa=Asn or Ser
MRSSTKRIPSALCHLSPEPAQLPMTCVQSRGRDKQLSPLAFPLLLTAVSNLEESKVQDAFVHYEPGVSSSVLSXRAAWSRASPLALV

SEQ ID NO: 7319 - protein, 54 aa, Homo sapiens
MVSKSYSKGTLYSRGPGKLPFFFFETGSPSPRPHGLKRSSHLSLLSSLDYRHAP

SEQ ID NO: 7320 - protein, 52 aa, Homo sapiens
MCSSTQFYHKCSFMKPQPLSRYFTVPSSETPSCYPCRVNTYSLPHSEQLATT

SEQ ID NO: 7321 - protein, 96 aa, Homo sapiens
  UNSURE 20: Xaa=Arg or Thr
  UNSURE 74: Xaa=Ala or Asp or Gly or Val
MFCIYKHIQDSYFQQLGSKXISRLFRSQSQAWELLLGGIYFIVYVCFQDKVSLHRPGWSAVARSQFTATLTFWXQVTLPPQPPKLLGLRHPPPRPV

SEQ ID NO: 7322 - protein, 81 aa, Homo sapiens
MRLGIRRTVFKTENSILRKLYGDVPFIEERHRHRFEVNPNLIKQFEQNDLSFVGQDVDGDRMEIIELANHPYFVGVQFHPE

SEQ ID NO: 7323 - protein, 98 aa, Homo sapiens
  UNSURE 29: Xaa=Asp or Val
MELEEDVKIYLDENYERINVPVPQFGGGXPADIIHDFQRGLTAYHDISLDKCYVIELNTTIVPPSQLLGAPHEREEGDYLPQTYIIQEEMVVTEHVSD

SEQ ID NO: 7324 - protein, 67 aa, Homo sapiens [sequence omitted]

SEQ ID NO: 7325 - protein, 89 aa, Homo sapiens
MRLNQNTLLLGKKVVLVPYTSEHVPRYHEWMKSEELQRLTASEPLTLEQEYAMQCSWQEDADKCTFIVLDAEKWQAQPGATEESCMVGA

SEQ ID NO: 7326 - protein, 96 aa, Homo sapiens
  UNSURE 35: Xaa=His or Gln
  UNSURE 36: Xaa=Asn or Tyr
MDVIEKPENDPEWWKCRKINGMVGLVPKNYVTVMXXNPLTSGLEPSPPQCDYIRPSLTGKFAGNPWYYGKVTRHQAEMALNERGHEGDFLIRDSES

SEQ ID NO: 7327 - protein, 72 aa, Homo sapiens
MLTFLILIGCFFKWKKYLTGGQKTWVGILVPSFCNNVGLLCPSSALLPQKNLCKPMMSNRHSSYWSQLTELT

SEQ ID NO: 7328 - protein, 120 aa, Homo sapiens
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPG

SEQ ID NO: 7329 - protein, 55 aa, Homo sapiens
  UNSURE 46: Xaa=Ala or Ser or Thr
MDDDDAKLKAEIEAELDKLSISSLEKEDIESDAKSETQSDDSDTDXVELPESVLH

SEQ ID NO: 7330 - protein, 73 aa, Homo sapiens
  UNSURE 45: Xaa= *  or Ala or Gly or Ile or Leu or Pro or Arg or Ser or Thr or Val
MPFRNSKRSRFFSDEDDRQINTRSPKRNQRVAMVPQKFTATMSTXDKKASQKIGFRLRNLLKLPKAHKWCIYE

SEQ ID NO: 7331 - protein, 124 aa, Homo sapiens
MATEGMILTNHDHQIRVGVLTVSDSCFRNLAEDRSGINLKDLVQDPSLLGGTISAYKIVPDEIEEIKETLIDWCDEKELNLILTTGGTGFAPRDVTPEATKEVIEREAPGMALAMLMGSLNVTP

SEQ ID NO: 7332 - protein, 98 aa, Homo sapiens
MPLLLEAQSTPFQVTPSTMANIVKGLYTLRPEWVQMAPTLFSKFIPNILPPAVESELSEYAAQDQKFQRDLYRMVLQGVTSPGRELGMSWLIIARQHV

SEQ ID NO: 7333 - protein, 89 aa, Homo sapiens
  UNSURE 74: Xaa=Ile or Asn or Ser or Thr
MGPKDHMVTSSFCCQSDGCNSAFLSVPLTNLTENGLMCPACTASFRDKCMGPMTHCTGKENHCVSLSGHVQAGXFKPRFAMRGCATESM

SEQ ID NO: 7334 - protein, 83 aa, Homo sapiens
  UNSURE 4: Xaa=Phe or Ser
  UNSURE 6: Xaa=Glu or Gly
  UNSURE 17: Xaa=Ile or Lys or Arg or Thr
MSMXLXELETEGERQLXSLLQHQLDTSVSIEECMSKKESFAPGTMYKPFGKEAAGTMTLSQFQTLHEKDQETASLRELGLNET

SEQ ID NO: 7335 - protein, 93 aa, Homo sapiens
  UNSURE 14: Xaa=Arg or Ser
  UNSURE 33: Xaa=Ala or Gly
  UNSURE 37: Xaa=Leu or Trp
  UNSURE 38: Xaa=Asp or Gly
  UNSURE 40: Xaa= *  or Glu or Gly or Trp
  UNSURE 41: Xaa=Glu or Gly
  UNSURE 43: Xaa= *  or Tyr
  UNSURE 44: Xaa=Asp or Ile or Asn or Val
  UNSURE 62: Xaa= *  or Glu
  UNSURE 67: Xaa=Leu or Val
MEEIYAKFVSQKIXKTRWRPLPPGSLQTAETFXTGSXXNXXNXXSLWSIGDFGNLDSDGGFXGDHQXLCDIRHHGDVMDLQFFDQERIVAASS

SEQ ID NO: 7336 - protein, 88 aa, Homo sapiens
MDGGDDGNLIIKKRFVSEAELDERRKRRQEEWEKVRKPEDPEECPEEVYDPRSLYERLQEQKDRKQQEYEEQFKFKNMVRGLDEDKTN

SEQ ID NO: 7337 - protein, 57 aa, Homo sapiens
MLMLLWEGVLESDRHGPQMGEQLLKSQSADPFLNLEMDAGISNIQRSQSWLSNIGPT

SEQ ID NO: 7338 - protein, 61 aa, Homo sapiens
MFSVSKLIAQETIMESLDGLHLPESSRETTAMILMNVYCNKILKPVDGSCCQPRPPVTLIQ

SEQ ID NO: 7339 - protein, 69 aa, Homo sapiens
  UNSURE 11: Xaa=Leu or Pro or Gln or Arg
MISAHYNLRLXGSSDSPASASRVAGTTGVRHHAWLIFCIFGRDGVSPCWSGWSRTPDLVVCPPRPPKVP

SEQ ID NO: 7340 - protein, 61 aa, Homo sapiens
  UNSURE 46: Xaa=Arg or Ser
  UNSURE 47: Xaa=Phe or Ile or Leu or Val
MHVHLKRVHQQALCEQQGCLFHLGAGWLSLKKESANFGGIIISSYXXGIGGPGVDLTKYIL

SEQ ID NO: 7341 - protein, 95 aa, Homo sapiens
  UNSURE 8: Xaa=Phe or Tyr
MPMCNLVXYTHVWSPVCRPAAQRRRRNTPGWSGFQGLTRAPALFPRLIFQVIFEWAIFAYILSLDPLQKALLPSKRKNISYLQTVLREQSSFSRS

SEQ ID NO: 7342 - protein, 97 aa, Homo sapiens
MMNKLYIGNLSPAVTADDLRQLFGDRKLPLAGQVLLKSGYAFVDYPDQNWAIRAIETLSGKVELHGKIMEVDYSVSKKLRSRKIQIRNIPPHLQWEV

SEQ ID NO: 7343 - protein, 61 aa, Homo sapiens
MHKGWKNYCSQKSLNEASMDEYLGSLGLFRKLTAKDASCLFRAISEQLFCSQVHHLEIRKA

SEQ ID NO: 7344 - protein, 58 aa, Homo sapiens
MFIAALFTVAKIWNQPKCPSTDEWINKMWYIYTMEYYPDIKKNGILTFKATRMNRKTL

SEQ ID NO: 7345 - protein, 59 aa, Homo sapiens
  UNSURE 58: Xaa=His or Gln
MSYFGKFYLVGLDARKAADWLFSADVSRPPGSTVYTCMLNHHGGTESDLTVSRLAPSXQ

SEQ ID NO: 7346 - protein, 86 aa, Homo sapiens
  UNSURE 21: Xaa=Ala or Cys or Gly or Ser
  UNSURE 22: Xaa=Pro or Arg
  UNSURE 60: Xaa=Lys or Arg
MAPGTPKSLLLSASIKREGEXXTASPHSSATDDLHHSDRYQTFLRVRANRQTRLNARIGXMKRRKQDEGQREGSCMAEDDAVDIEH

SEQ ID NO: 7347 - protein, 53 aa, Homo sapiens
  UNSURE 39: Xaa=Asp or Glu
MRERGRERGNPGLKTVKFKLKGRDTNQGIFRERKREPAXLGQFGGVTYHTGNQ

SEQ ID NO: 7348 - protein, 111 aa, Homo sapiens
  UNSURE 99: Xaa=Lys or Thr
MDKFLDRYTLPRLNQEKVESLNRPITGSEIEAIINSLPTKKSPGPDGFTAKFYQRYKDGLVPFLLKLFQSIEKEGILPNSFFEASIILIPKPGRDTTKXENFRPISLMTSM

SEQ ID NO: 7349 - protein, 68 aa, Homo sapiens
MLEMEMTWLRLCDECSRWGMASAWGRGGKLLGAQVALHPRNCSKAKIFLFSILLMSLRTFHCNYFRGN

SEQ ID NO: 7350 - protein, 82 aa, Homo sapiens
  UNSURE 34: Xaa=Ser or Thr
  UNSURE 68: Xaa=Cys or Phe
  UNSURE 73: Xaa=Leu or Val
MHLCGGNGLLTQTDPKEQQRQLKKQKNRAAAQRXGRSTQTRQTPCTRCGQPLTPFLVSGSTYWPSHLXSIPPXSRPPPNSCK

SEQ ID NO: 7351 - protein, 56 aa, Homo sapiens
MNPFHDLHRPSMTCLDFLTCPKHPSLNNHSFNFRARIYHTGSCLIQNYYCYILPYQ

SEQ ID NO: 7352 - protein, 53 aa, Homo sapiens
  UNSURE 39: Xaa=Pro or Thr
  UNSURE 41: Xaa=Gly or Ser
MLLFVEQVASKGTGLNPNAKVWQEIAPGNTDATPVTHGXEXSWHEIAATSGAH

SEQ ID NO: 7353 - protein, 100 aa, Homo sapiens
  UNSURE 73: Xaa=Ile or Ser or Thr
  UNSURE 89: Xaa=His or Asn
  UNSURE 91: Xaa=Ile or Val
  UNSURE 95: Xaa=Asp or Glu
  UNSURE 97: Xaa=Gly or Arg
MAVLPKGMYRFNVIPIKLPMRFFTELEKFILQFIWNQKRALIVKVILSENNRANKARGITLPNFKLCYRATVXNIAWYWHKNRYIHQWXRXEIPXIXHTF

SEQ ID NO: 7354 - protein, 91 aa, Homo sapiens
  UNSURE 25: Xaa=Cys or Gly
MNTCPSVYPSIPEHLHPSQQKPEPXPHRAPKLLSKGEQRLDAARKTSMSACQGKAQHSHLLPHHGPPCSRQGVPSRRGACTKASCSGRRAV

SEQ ID NO: 7355 - protein, 81 aa, Homo sapiens
MATLARLQARSSTVGNQYYFRNSVVDPFRKKENDAAVKIQSWFRGCQVRAYIRHLNRIVTIIQKWWRSFLGRKQYQLTVQV

SEQ ID NO: 7356 - protein, 62 aa, Homo sapiens
  UNSURE 13: Xaa=Ser or Thr
MFEPACRGGSKRXSTFPIRPRSGLAPPGEMETQKRVNRVALLRARMPTSVAGAVPSSLNYQI

SEQ ID NO: 7357 - protein, 103 aa, Homo sapiens
  UNSURE 20: Xaa=Gly or Arg
  UNSURE 22: Xaa=Phe or Ser
MAFSQILTGRRFISGTSQVXCXCSGSCYCPVRNQYLEKEQRRQYLLRLKNSQLEKTYGEMAKIVDVPTKQLRAANPIDSMLCHFCHNVSFPCTRNGCVDMEHF

SEQ ID NO: 7358 - protein, 149 aa, Homo sapiens
  UNSURE 141: Xaa=Ser or Thr
MSKSLGNVLDPRDIISGVEMQLLQEKLRSGNLDPAELAIVAAAQKKDFPHGIPECGTDALRFTLCSHGVQAGDLHLSVSEVQSCRHFCNKIWNALRFILNALGEKFVPQPAEELSPSSPMDAWILSRLALAAQECERGFLXRELSLVTH

SEQ ID NO: 7359 - protein, 64 aa, Homo sapiens
  UNSURE 43: Xaa=Ala or Glu or Ile or Lys or Thr or Val
MYLPATFSQLWPGPRSSMFCPSVKGLLSLLRRHNWLLLRTLEXRLDRLALSGPSTYTPCPLSSQ

SEQ ID NO: 7360 - protein, 76 aa, Homo sapiens
  UNSURE 23: Xaa=Cys or Phe or Ile or Ser
  UNSURE 27: Xaa=Asp or Glu
  UNSURE 68: Xaa=His or Gln
  UNSURE 70: Xaa=Phe or Val
MSLGPRAIHCRRSLRELEFSVEXHPQXSISETVILRGEPEKLGQALTEVYAKANSFTVSSVAAPSWLXRXIIGKKG

SEQ ID NO: 7361 - protein, 78 aa, Homo sapiens
MENFVQSSGEDGIVVFSLGSLFQNVTEEKANIIASALAQIPQKVLWRYKGKKPSTLGANTRLYDWIPQNDLLGHPKTK

SEQ ID NO: 7362 - protein, 90 aa, Homo sapiens [sequence omitted]

SEQ ID NO: 7363 - protein, 68 aa, Homo sapiens
  UNSURE 56: Xaa=Ala or Pro
  UNSURE 61: Xaa=Ile or Val
  UNSURE 63: Xaa=Glu or Gly
MNLPFVSITVSARCNKVMLNKTWYLYLHMAYQLSITNLKIQNLKCSLEHLSIILSXKSFQXLXHFAFS

SEQ ID NO: 7364 - protein, 52 aa, Homo sapiens
MVVDEQQRLTAQLTLQRQKIQELTTNAKETHTKLALAEARVQEEEQKATRLE

SEQ ID NO: 7365 - protein, 72 aa, Homo sapiens
MEDTDIEDSLYKDVDYGTEVLQIEHSYCRQDINKEHLWQKVSKLHSKITLLELKEQQTLGRLKSLEALIRQH

SEQ ID NO: 7366 - protein, 89 aa, Homo sapiens
MLSRPKPGESEVDLLHFQSQFLAAGAAPAVQLVKKGNRGGGDANSDRPPLQDHRDVVMLDNLPDLPPALVPSPPKRARPSPGHCLPEDE

SEQ ID NO: 7367 - protein, 73 aa, Homo sapiens
MANDPLEGFHEVNLASPTSPDLLGVYESGTQEQTTSPSVIYRPHPSALSSVPIQANALDVSELPTQPVYSSPS

SEQ ID NO: 7368 - protein, 52 aa, Homo sapiens
METWKGTTESRNGNPNIPWEAGFDFVCWWWCKNEGCDLFSSACVIPSYFFFF

SEQ ID NO: 7369 - protein, 95 aa, Homo sapiens
MVDYVANYMEGIEGRQVYPDVEPGYLRPLIPAAAPQEPDTFEDIINDVEKIIMPGVTHWHSPYFFAYFPTASSYPAMLADMLCGAIGCIGFSWGC

SEQ ID NO: 7370 - protein, 74 aa, Homo sapiens
MGKLSVQTLDSFIVKRIHTGERPYNKCDKCNKAFGQWSVLNQHQRLHTREICYYQCNKCGKFTVRIQLFHHIRI

SEQ ID NO: 7371 - protein, 76 aa, Homo sapiens
  UNSURE 42: Xaa=Leu or Val
  UNSURE 56: Xaa= *  or Gly or Leu or Val
MVVVTGREPDSRRQDGAMSSSDAEDDFLEPATPTATQAGHAXPPAATGSFLRLFPXTSEGLTSLHACPHCGATKTP

SEQ ID NO: 7372 - protein, 68 aa, Homo sapiens
  UNSURE 45: Xaa=Lys or Met or Arg
  UNSURE 62: Xaa=Ser or Tyr
  UNSURE 63: Xaa=Ala or Pro or Thr
MSHRARPPQFFFSEFHVTQNIPFCFGASYREAQASLEWNVQFLSXQKVKDYLLFKIRENEKXXALFPS

SEQ ID NO: 7373 - protein, 65 aa, Homo sapiens
MQMDNRLPPKKVPGFCSFRYGLSFLVHCCNVIITAQRACLNLTMVVMVNSTDPHGLPNTSTKKLL

SEQ ID NO: 7374 - protein, 93 aa, Homo sapiens
  UNSURE 35: Xaa=Cys or Phe or His or Leu or Pro or Arg or Ser or Tyr
MFGGTPRQQDRNIPRGSDIIVDLEVTLEEVYAGNXVEVVRNKPVARQAPGKRKCNCRQEMRTTQLGPGRFQMTQEVVCDECPNVKLVNEERTL

SEQ ID NO: 7375 - protein, 55 aa, Homo sapiens
MQEITEQQDIAQEISEAFSQRVGFGDDFDEDELMAELEELEQEELNKKMTNIRLP

SEQ ID NO: 7376 - protein, 61 aa, Homo sapiens
  UNSURE 25: Xaa=Ile or Val
  UNSURE 43: Xaa=Asp or Asn
MFIAALFTVAETWNQSKCLSIIDWXKKMWYIYTMEYYAAIKKXKIMSFAGTWMKVEAIILS

SEQ ID NO: 7377 - protein, 83 aa, Homo sapiens
  UNSURE 24: Xaa=Lys or Asn
MQWIRGGSGMLITGDSIVSAEAVXWDHVTMANRELAFKAGDVIKVLDASNKDWWWGQIDDEEGWFPASFVRLWVNQEDEVEEG

SEQ ID NO: 7378 - protein, 53 aa, Homo sapiens
  UNSURE 13: Xaa=Ile or Leu
  UNSURE 14: Xaa=Pro or Gln
MLNCCFGQLLFQXXSFSSPKESVPRRHLSEGTNSYATRLLNNHQVPPQSEPVS

SEQ ID NO: 7379 - protein, 53 aa, Homo sapiens
  UNSURE 29: Xaa=Ser or Thr
  UNSURE 43: Xaa=Glu or Gly
  UNSURE 44: Xaa=His or Gln
  UNSURE 45: Xaa=Phe or Leu
MSPRLVSNSWAQAISPTSASQNIGITGVXTTLGPYLVLRISWXXXGNLFSRGV

SEQ ID NO: 7380 - protein, 112 aa, Homo sapiens
  UNSURE 39: Xaa=Glu or Gln
  UNSURE 40: Xaa=Asp or Glu or His or Gln
  UNSURE 41: Xaa=Cys or Phe or Ser
  UNSURE 42: Xaa=Glu or Val
  UNSURE 44: Xaa=Asp or His or Asn
  UNSURE 45: Xaa=Leu or Arg
MDCSCQPAPAVSPPSLCAEAQRSTLPSSWVLGCIQEGLXXXXNXXPKGGRPGMLQTIDSQIGHSKGSRREARFPTQCLPGDPRVSPAVLLTPGGCKRSLWGGNVYLSGRLFA

SEQ ID NO: 7381 - protein, 62 aa, Homo sapiens
  UNSURE 31: Xaa=Glu or Lys
MSISQKSGFLNGCFAQGLMQTNKMSNLHLRXIYNTNILSFYLYTRERMHELIYSFNKRLLTP

SEQ ID NO: 7382 - protein, 73 aa, Homo sapiens
  UNSURE 39: Xaa=His or Gln
MEAENAGSYSLQQAQAFYTFPFQQLMAEAPNMAVVNEQXMPEEVPAPAPAQEPVQEAPKGRKRKPRTTEPKQP

SEQ ID NO: 7383 - protein, 63 aa, Homo sapiens
  UNSURE 29: Xaa=Gly or Ser
  UNSURE 39: Xaa=His or Gln
  UNSURE 40: Xaa=Ala or Thr
  UNSURE 54: Xaa=Ala or Pro
  UNSURE 56: Xaa=Lys or Arg
MEFSGPIMVHYSLKLPGSSNPTMSAFPSXWDYRSHTVTXXGVQWHNLCSLQPPXAXLKQFSCL

SEQ ID NO: 7384 - protein, 60 aa, Homo sapiens
  UNSURE 51: Xaa=Phe or Ser
MFSASFRSSFRAGLVVTKSLSICLSVKYFISPSPMKLSLAGYEILGLKILXFKNIEYWPQ

SEQ ID NO: 7385 - protein, 71 aa, Homo sapiens
  UNSURE 34: Xaa=Leu or Trp
MGNCHTVGPNEALVVSGGCCGSDYKQYVFGGWAXGLVVYLRHSEDFPRDYDVAAPLRGRRDGRGGSFNCDG

SEQ ID NO: 7386 - protein, 103 aa, Homo sapiens
  UNSURE 16: Xaa=Asp or Val
  UNSURE 85: Xaa=Asn or Thr
  UNSURE 94: Xaa=Pro or Gln or Arg
  UNSURE 103: Xaa=Asp or Glu
MAAAALGSSSGSASPXVAELCQNTPETFLEASKLLLTYADNILRNPNDEKYRSIRIGNTAFSTRLLPVRGAVECLFEMGFEEGEXISSFLKKLXWSSCKKIRX

SEQ ID NO: 7387 - protein, 51 aa, Homo sapiens
  UNSURE 29: Xaa=Ala or Glu
MRPNTKHEIDSCAHSLKVVSYSILNFVHXQSLCILTIKGQGCRHRYAVLHC

SEQ ID NO: 7388 - protein, 108 aa, Homo sapiens
  UNSURE 32: Xaa=Ala or Glu or Gly or Ile or Lys or Leu or Pro or Gln or Arg or Thr or Val
MDHLESFIAECDRRTELAKKRLAETQEEISAXVSAKAEKVHELNEEIGKLLAKAEQLGAEGNVDESQKILMEVEKVRAKKKEAEEEYRNSMPASSFQQQKLRVCEVCS

SEQ ID NO: 7389 - protein, 58 aa, Homo sapiens
  UNSURE 40: Xaa=His or Leu or Pro or Gln
MEYHSSLVLIKATSFLGIVVSVKCMRKALIGVLVGVLVSXQKTAETLFDVICANALTS

SEQ ID NO: 7390 - protein, 110 aa, Homo sapiens
  UNSURE 5: Xaa=Ala or Asp or Glu or Gly or Val
  UNSURE 43: Xaa=Asp or Gly
  UNSURE 52: Xaa=Asp or Phe or Val or Tyr
  UNSURE 70: Xaa=Asn or Ser
  UNSURE 78: Xaa= *  or Tyr
  UNSURE 79: Xaa= *  or Glu or Gln
  UNSURE 81: Xaa=Glu or Gly
  UNSURE 95: Xaa=Ile or Asn or Ser or Thr
MVSKXGCLTLGMMPTFQARNGLAGFSYLLLHLVCFNTYQISFXLAEYTADVXGVGTLRLLDAVKTCGLIXSVKFYQAXXSXLYGKVQEIPQKETXPFYPGHLWGSKTLCL

SEQ ID NO: 7391 - protein, 51 aa, Homo sapiens
  UNSURE 22: Xaa=Ala or Cys or Asp or Phe or Gly or His or Ile or Leu or Asn or Pro or Arg or Ser or Thr or Val or Tyr
MAPEHLNDVNAKPTEKSDVYSXAVVLWAIFANKEPYESKALLTFHCRPLSI

SEQ ID NO: 7392 - protein, 81 aa, Homo sapiens
MIYFRQFSQLSPAEQNVAAILGVSESFIGKKASGQAIGKLNAFKKVIQYQHAEYVTHTSFNLSPRWTRTLSTGYICLLFFI

SEQ ID NO: 7393 - protein, 63 aa, Homo sapiens
MVKQFAVSSGSEKLFSSKSNAQFKMYKTPIFLNEVLVKLPTDPSSDEPVFHISHIDRVYTLRT

SEQ ID NO: 7394 - protein, 94 aa, Homo sapiens
MAVPTELDGGSVKETAAEEESRVLAPGAAPFGNFPHYSRFHPPEQRLRLLPPELLRQLFPESPENGPILGLDVGCNSGDLSVALYKHFLSLPDG

SEQ ID NO: 7395 - protein, 67 aa, Homo sapiens
MLFIRLRFLLFIYFNFLFFHYYTLSFRVHVHNVQVSDICIHVTCWCTAPTNSSSSIRYISQCYPSPL

SEQ ID NO: 7396 - protein, 57 aa, Homo sapiens
MLLRTLPYTKNMKIFFHIFFHKCLFTYRLFITLALILWYSDIEESTFPPLMRYCPNT

SEQ ID NO: 7397 - protein, 131 aa, Homo sapiens
  UNSURE 18: Xaa= *  or Gly
  UNSURE 19: Xaa=His or Leu
  UNSURE 81: Xaa=Arg or Ser
  UNSURE 82: Xaa=Phe or Ile
MKVAGACPGQWVPAEAAXXTLRASAVFPSRDFFCGCYSADCRYLCFADILFCFWFLHPICFFLSQKRFVKGLRQYGKNFFXXRKELLPNKETGELITFYYYWKKTPEAASSRAHRRHRSRPCSGGLRLAPR

SEQ ID NO: 7398 - protein, 53 aa, Homo sapiens
MSAFEKPQIIAHIQKGFNYTVFDCKWVPCSAKFVTMGNFARGTGVIQLYEIRH

SEQ ID NO: 7399 - protein, 53 aa, Homo sapiens
MKQILVKMHSKHSENSLLLTKTEPKHVTENQKSKTLNVPKEHEDNIFTPKPTP

SEQ ID NO: 7400 - protein, 54 aa, Homo sapiens
  UNSURE 2: Xaa=Arg or Ser
MXSSVRRKGKPGKGGGKGSSRGGRGGRSHASKSHGSGGGGGGGGGGGGGNRKAS

SEQ ID NO: 7401 - protein, 75 aa, Homo sapiens
  UNSURE 29: Xaa=Ile or Leu or Val
  UNSURE 35: Xaa=Asp or Glu
  UNSURE 68: Xaa=Met or Arg
MWAAEQNQVLSLWQLQFLFNKHIENLSSXHIKPFXLITSLCGRYCSSPIFGRAQWLMPVVPALWKAGXVDHLRLG

SEQ ID NO: 7402 - protein, 148 aa, Homo sapiens
  UNSURE 29: Xaa= *  or Tyr
  UNSURE 117: Xaa=Glu or Gly
MYLPDVDQKESDGGADLTLGLREALELIXSYSRSERSHYYDSDRRYHRSSPYRERTRYSRPYTDNRARESSDSEEEYKKTYSRRTSSHSSSYRDLRTSSYSKSDRDCKTETSYLEMXRRGKYSSKLERESKRTSENEAIKRCCSPPGG

SEQ ID NO: 7403 - protein, 73 aa, Homo sapiens [sequence omitted]

SEQ ID NO: 7404 - protein, 57 aa, Homo sapiens
  UNSURE 52: Xaa=Ala or Gly
MSQRTRSLFMDAHLTCEKPTPCLQMKDCISFILLPTGDSLPLTPFLLLPAVXFYFFS

SEQ ID NO: 7405 - protein, 94 aa, Homo sapiens
  UNSURE 89: Xaa=Lys or Asn
  UNSURE 90: Xaa=Ala or Ser or Thr
MTISVGKTNINSYKTILPSPSKAVKRGVDLVAETGSIIIKVEVHRAIITEKIKTHVTSIQYCNLKIDFFHNNYIQIIYLTHKTKEKNNXXFSSQ

SEQ ID NO: 7406 - protein, 58 aa, Homo sapiens
MVAVPAGADPSTVAKVAIESAVQQKQQHPPTYVQNVVRRTLLCHLHQLYKCRASLTGL

SEQ ID NO: 7407 - protein, 115 aa, Homo sapiens
  UNSURE 25: Xaa=Glu or Gly
  UNSURE 26: Xaa=Arg or Ser
  UNSURE 110: Xaa=Glu or Gly
  UNSURE 114: Xaa=Ala or Gly
MAPTIQTQAQREDGHRPNSHRTLPXXSGVVCRVKYCNSLPDIPFDPKFITYPFDQNRFVQYKATSLEKQHKHDLLTEPDLGVTIDLINPDTYRIDPNVLLDPADEKLLEXEIQXP

SEQ ID NO: 7408 - protein, 106 aa, Homo sapiens
  UNSURE 88: Xaa=Cys or Phe or Ile or Ser
MITESSLDVAEEEIIDDDDDDITLTVEASCHDGDETIETIEAAEALLNMDSPGPMLDEKRINNNIFSSPEDDMVVAPVTHVSVTLDGXPEVMETQQVQEKYADSPG

SEQ ID NO: 7409 - protein, 78 aa, Homo sapiens
  UNSURE 74: Xaa=Asp or Gly
METGRWKKINTEGDVPPSMSGSCAVCVDRVLYLFGGHHSRGNTNKFYMLDSRSTDRVLQWERIDCQGIPPSSKXKLGV

SEQ ID NO: 7410 - protein, 58 aa, Homo sapiens [sequence omitted]

SEQ ID NO: 7411 - protein, 106 aa, Homo sapiens
  UNSURE 45: Xaa=Ala or Pro or Ser or Thr
MRKKLSLDEESSLFKQKAQQKRVFDTVRIANDTRGRSISFPALLXIPGSNRSSVIMTAKPFESGLQQTEDKSLLNQGSSSEEVAGSSQKMGQPGPSGDSDLATALH

SEQ ID NO: 7412 - protein, 57 aa, Homo sapiens
  UNSURE 2: Xaa=Phe or Ser
  UNSURE 24: Xaa=Glu or Gly
  UNSURE 44: Xaa=Gly or Arg
  UNSURE 46: Xaa=Ala or Ser
  UNSURE 47: Xaa=Arg or Thr
  UNSURE 48: Xaa=Arg or Trp
  UNSURE 56: Xaa=Lys or Asn
MXPNDYEKVVKRQREERQRQRELXRQKEIEEREKRRKDRHEASXFXXXPKIQILMXM

SEQ ID NO: 7413 - protein, 132 aa, Homo sapiens
  UNSURE 43: Xaa=Pro or Thr
  UNSURE 104: Xaa=Asp or Glu or Ile or Lys or Met or Asn or Val
MSSSRCLDPECGGNISGEALTPKAVQAQCGGCFSGESSRLGQXRGSVLLAQELPQQLTSPGYPEPYGKGQESSTDIKAPEGFAVRLVFQDFDLEPSQDCAGDSXTISFVGSDPSQFCGQQGSPLGRPPGQRE

SEQ ID NO: 7414 - protein, 68 aa, Homo sapiens
  UNSURE 29: Xaa=Asp or Gly or Asn or Ser
  UNSURE 30: Xaa=Asp or His
  UNSURE 32: Xaa=Cys or Phe
  UNSURE 33: Xaa= *  or Leu or Ser or Trp
  UNSURE 34: Xaa=Ala or Pro
  UNSURE 37: Xaa=Arg or Ser
MESTLGAGIVIAEALQNQLAWLENVWLWXXLXXXIPXILFLFYFPAAYYASRRVGIAVLWISLITEWL

SEQ ID NO: 7415 - protein, 62 aa, Homo sapiens
  UNSURE 12: Xaa=Glu or Lys
  UNSURE 14: Xaa= *  or Cys or Phe or Gly or Ile or Leu or Met or Arg or Ser or Val or Trp
  UNSURE 59: Xaa=Ala or Thr
MATGADVRDILXLXGPEGDAASGTISKKDIINPDKKKSKKSSETLTFKRPRACTGKSMXCST

SEQ ID NO: 7416 - protein, 120 aa, Homo sapiens
  UNSURE 98: Xaa=Asn or Ser
MAAAEVADTQLMLGVGLIEKDTNGEVLWVWCYPSTTATLRNLLLRKCCLTDENKLLHPFVFGQYRRTWFYITTIEVPDSSILKKVTHFSIVLTAKDFXPEKYAAFTRILCRMYLKHGSPV

SEQ ID NO: 7417 - protein, 122 aa, Homo sapiens
  UNSURE 104: Xaa=Ile or Arg or Thr
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNIXVQWYAGELLCKVLSYLKL

SEQ ID NO: 7418 - protein, 128 aa, Homo sapiens
  UNSURE 20: Xaa=Ala or Cys or Asp or Phe or Gly or Ser or Val or Tyr
  UNSURE 128: Xaa=Asp or Ile or Asn or Val
MDLGAITKYSALHAKPNGLXLQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRX

SEQ ID NO: 7419 - protein, 102 aa, Homo sapiens
  UNSURE 42: Xaa=Pro or Arg
  UNSURE 68: Xaa=Ile or Met
  UNSURE 69: Xaa=Ala or Pro or Ser or Thr
  UNSURE 79: Xaa=Leu or Pro
  UNSURE 90: Xaa= *  or Glu or Lys or Gln
  UNSURE 95: Xaa=Lys or Asn or Arg or Ser or Thr
MSPVSPAVSSSCAPLASTPPWPLKTCSRGSLTSPTLEPGISXSWLWTPPGTSSSWEPGTTSSDSALPXXLFFRPQSGPXVRTRAAPAKAXGRLRXSVRTTCE

SEQ ID NO: 7420 - protein, 60 aa, Homo sapiens [sequence omitted]

SEQ ID NO: 7421 - protein, 72 aa, Homo sapiens
  UNSURE 33: Xaa=Leu or Arg
MSVWWSSQRKTPGAGELCMDMQSRAAHLLLLTXPVPVRVCTHPTESCSVAQAGVQWHDLGSLQPLPPEFTPF

SEQ ID NO: 7422 - protein, 62 aa, Homo sapiens [sequence omitted]

SEQ ID NO: 7423 - protein, 87 aa, Homo sapiens
MIEDKGPRVADYFVVAGLTDVSKPLEEEIHFNDACHKVAKPKEPITDVSVIIKSLGEEVPQDYICIDVTPTGLSADLNNGVLWGTDL

SEQ ID NO: 7424 - protein, 114 aa, Homo sapiens
  UNSURE 2: Xaa=Ala or Glu
  UNSURE 21: Xaa=Arg or Ser
  UNSURE 23: Xaa=Leu or Met
  UNSURE 36: Xaa=Ile or Met
  UNSURE 37: Xaa=His or Asn
  UNSURE 44: Xaa=Ile or Asn
  UNSURE 53: Xaa=Pro or Ser
  UNSURE 58: Xaa=Ala or Pro
  UNSURE 76: Xaa=His or Asn
  UNSURE 91: Xaa=Ala or Asp
  UNSURE 112: Xaa=Lys or Gln
MXKNHRNKKSIHFPLCTIPSXMXKSCTLPLQRTWDXXPSFVHWXQARLQSPPXSHLVXLSVIRSTLVLSQCLCSRXPYFSAMMTPKCKSIXAGNSGMPKRNCKVLPSSEKMXVH

SEQ ID NO: 7425 - protein, 69 aa, Homo sapiens
  UNSURE 31: Xaa=Ala or Gly
  UNSURE 32: Xaa=Glu or Gly
MEGQRLMGADVKQARGPVGWCRQLAQQSSGXXFRGVLYQVFHDTICEKEAPKSSLLRKQTQPPKKQSSP

SEQ ID NO: 7426 - protein, 135 aa, Homo sapiens
MAGAGSAAVSGAGTPVAGPTGRDLFAEGLLEFLRPAVQQLDSHVHAVRESQVELREQIDNLATELCRINEDQKVALDLDPYVKKLLNARRRVVLVNNILQNAQERLRRLNHSVAKETARRRAMLDSGIYPLAPRY

SEQ ID NO: 7427 - protein, 100 aa, Homo sapiens
  UNSURE 48: Xaa=Leu or Arg
MNGDLEEEGGREATDAPEQVEEILDHSEQQARPARVNGGTDEENGEEXQQVNNERQLVLDKERKSQGAGSGQDEADVDPQRPPRPEVKITSPEENENNQQ

SEQ ID NO: 7428 - protein, 65 aa, Homo sapiens
MASWGGEKRGGAEGSPKLAVYATRKTRSVRSQEDQWYLGYRGTSGPRASPTAGGKIASAARQARR

SEQ ID NO: 7429 - protein, 100 aa, Homo sapiens
  UNSURE 7: Xaa=Glu or Lys
  UNSURE 10: Xaa=Ser or Trp
MLKRAQXMKXKKLKKKIDSTVRLALFKNNENKVSLPKSPKMVQPRRDGYFEGIEEDPIHKDTTANEKLERNREYTYQWLHTQVGVHETASSRNMKCNHFL

SEQ ID NO: 7430 - protein, 68 aa, Homo sapiens
  UNSURE 7: Xaa=His or Leu or Gln or Arg
  UNSURE 61: Xaa= *  or Phe or Leu or Tyr
  UNSURE 62: Xaa= *  or Ala or Gly or Pro or Arg or Ser or Thr
MTRKDWXCADLGVRVSGRGHSKCRGPEAGTSLGQNLAGQQQEPGRVETSALRLGWNIQVLXXMQWDTD

SEQ ID NO: 7431 - protein, 58 aa, Homo sapiens
  UNSURE 39: Xaa=Leu or Met
MHFSFTSFFWNALFAESYGFMRNTHAGTHTQRADKRHPXSIRSSNSIKNIIKKSTPSH

SEQ ID NO: 7432 - protein, 65 aa, Homo sapiens
MKIPVWHKTCFLKSESFSPDNLSVSLPCRPSQVPSQGQGKSFLLLQLIHEDKAIQNEAIFQPSLQ

SEQ ID NO: 7433 - protein, 139 aa, Homo sapiens
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGLQRLPLISVALVQGWALGGGA

SEQ ID NO: 7434 - protein, 58 aa, Homo sapiens
  UNSURE 25: Xaa=Leu or Val
MPISSGGSVCRVRVACCFANMVFNXHNPKSFLCCPHFKNKEVRYGELALGLNHISHTA

SEQ ID NO: 7435 - protein, 83 aa, Homo sapiens
  UNSURE 74: Xaa=Glu or Gln
MQAVCAGTRAPATDEVAGVHRSLLRSSRGFQGRLTRFLGRRFMTAEFLLEDPSSGSLIPQESSWKTRACEGSAXLLASQTASR

SEQ ID NO: 7436 - protein, 67 aa, Homo sapiens
MLLHFLQGNRGKPASGCLGCVSTHHIEAVLQLCQPWPKQAVFEPPWTTPEGQHQTPGILSDTILGVS

SEQ ID NO: 7437 - protein, 62 aa, Homo sapiens [sequence omitted]

SEQ ID NO: 7438 - protein, 54 aa, Homo sapiens
  UNSURE 19: Xaa=Ala or Asp or Glu or Gly or Val
  UNSURE 36: Xaa=Arg or Thr
  UNSURE 53: Xaa=Ala or Ile or Thr or Val
  UNSURE 54: Xaa=Asp or Gly
MASVKVAVRVRPMNRREKXLEAKFIIQMEKSKTTIXNLKIPEGGTGDSGRERXX

SEQ ID NO: 7439 - protein, 51 aa, Homo sapiens
  UNSURE 4: Xaa= *  or Leu
MSLXIESALAHTTRKKNTWPVASEPHIPGDSRFSLRKPFRMMGIHHQLRVA

SEQ ID NO: 7440 - protein, 58 aa, Homo sapiens
MESKPSRIPRRISVQPSSSLSARMMSGSRGSSLNDTYHSRDSSFRLDSEYQSTSASAT

SEQ ID NO: 7441 - protein, 62 aa, Homo sapiens
MAVESGVISTLIPQDPPEQELILVKVEDNFSWDEKFKQNGSTQSCQELFRQQFRKFCYQETP

SEQ ID NO: 7442 - protein, 120 aa, Homo sapiens
  UNSURE 19: Xaa= *  or Ile or Lys or Leu or Pro or Gln or Arg or Ser or Thr
  UNSURE 38: Xaa=Gln or Arg
  UNSURE 40: Xaa=Ala or Thr
  UNSURE 43: Xaa=Pro or Arg
  UNSURE 47: Xaa=Gly or Arg
  UNSURE 89: Xaa=Ala or Thr
  UNSURE 95: Xaa= *  or Ala or Glu or Gly or Lys or Leu or Met or Pro or Gln or Arg or Ser or Thr or Val or Trp
  UNSURE 96: Xaa=Leu or Pro
  UNSURE 99: Xaa=Asp or Asn
  UNSURE 107: Xaa= *  or Arg
  UNSURE 109: Xaa= *  or Glu
  UNSURE 115: Xaa=Cys or Gly or Ser
MATHCPLYCVGADLMMNRXGEHVWSESEDCLPFLQLAXIXSPXAARXRSTKSWKKSSSLSDLYWGFRMQMTMRLKSTVLTWKKRSQRRXTPRWGXXAVXLGAPLRRXVXPHSNLXGVTAP

SEQ ID NO: 7443 - protein, 65 aa, Homo sapiens
  UNSURE 38: Xaa=His or Gln
  UNSURE 54: Xaa=Ala or Ser or Thr
MISSWEQKNNCVMPEDVKNFYLMTNGFHMTWSVKLDEXIIPLGSMAINSISKLXQLTQSSMYSLP

SEQ ID NO: 7444 - protein, 90 aa, Homo sapiens
  UNSURE 38: Xaa=Asp or Glu
  UNSURE 39: Xaa= *  or Cys or Phe or Ile or Lys or Leu or Met or Asn or Arg or Ser or Thr or Trp or Tyr
  UNSURE 45: Xaa=Ile or Val
MEPDSVIEDKTIELMISNGTSSVIVSRKRPSEGNYQKXXDLCIKXFSTLRGQGSRALARSQWHALELPSLQNYELKFSTLAILTGSGTHR

SEQ ID NO: 7445 - protein, 65 aa, Homo sapiens
MSKPGSPGSVIPAQAHGKIFTKPDPQWDSTVSASEAENGVHLKTELQQKQLSNNNQALSKNHPPQ

SEQ ID NO: 7446 - protein, 109 aa, Homo sapiens
  UNSURE 37: Xaa=Ile or Met or Arg or Ser or Thr
MACGEISGEHREEERRTETRPGAPAGPLQTEAGSGEXEGQVADEGWSLSPLVSAESRGHVPPGRAPACSRGAPWQGGHWKLNAEEASGSGALGLSPPVLGWSFAMLRRL

SEQ ID NO: 7447 - protein, 67 aa, Homo sapiens
  UNSURE 27: Xaa=Phe or Leu
MGPPPHMAAALSASSEHSSAPAVWNSXCCNSPSRSPNCQSPCFPLSPNSPLRPPALAQSFLTHSSAA

SEQ ID NO: 7448 - protein, 54 aa, Homo sapiens
  UNSURE 15: Xaa=Cys or Tyr
  UNSURE 35: Xaa= *  or Gly or Arg
MSRFRGCSSSGVRFXSAREGGLGLRAGECVAVCPXAPSPAKPPVPRWGATLTGT

SEQ ID NO: 7449 - protein, 66 aa, Homo sapiens
  UNSURE 18: Xaa=Ala or Thr
  UNSURE 25: Xaa=Phe or Ile
  UNSURE 26: Xaa=Pro or Ser
  UNSURE 27: Xaa= *  or Glu
  UNSURE 39: Xaa=Asn or Ser
  UNSURE 57: Xaa=Ala or Pro or Ser
MLQIRNFLSTDMMLKGNXHWSILGXXXSVDLRCSTSKYXRAIPKIRKNSEIRSTSGXRHFGEGMLN

SEQ ID NO: 7450 - protein, 68 aa, Homo sapiens
  UNSURE 33: Xaa=Leu or Val
  UNSURE 44: Xaa=Phe or Leu
MCQYINYILITFIEVRYIWQIISERELHSPIFXFVMIYCRVHLXDLPQLKTHFQENIHHTRKKERGRK

SEQ ID NO: 7451 - protein, 51 aa, Homo sapiens
  UNSURE 9: Xaa=Glu or Val
  UNSURE 10: Xaa=Ala or Gly
  UNSURE 20: Xaa=Ala or Pro or Thr
  UNSURE 21: Xaa=Ile or Leu
  UNSURE 26: Xaa=Gly or Val
  UNSURE 32: Xaa=Cys or Phe
  UNSURE 35: Xaa=Ala or Pro
  UNSURE 40: Xaa=Arg or Thr
  UNSURE 44: Xaa= *  or Cys
  UNSURE 45: Xaa=Ala or Cys or Asp or Phe or Gly or Ser or Val or Tyr
MGSPAAPEXXLGYVREFTRXXLRRAXQPQTSXACXGSSLXSRCXXGGQPLR

SEQ ID NO: 7452 - protein, 59 aa, Homo sapiens
  UNSURE 23: Xaa=Arg or Thr
  UNSURE 42: Xaa=Ala or Thr
MVLGNWLAICRKLKLDPFLTPYXKINSRWIKDLNVRPKTIKXLEENLGITIQDIGMGKD

SEQ ID NO: 7453 - protein, 51 aa, Homo sapiens
  UNSURE 16: Xaa=Glu or Lys
  UNSURE 29: Xaa=Ala or Asp
  UNSURE 39: Xaa= *  or Cys
  UNSURE 40: Xaa=Lys or Thr
MCRKQHIVQFGFGQGXSRSQGWKGELKMXCGPGVVARAXXCQHFGRQRRPI

SEQ ID NO: 7454 - protein, 61 aa, Homo sapiens
  UNSURE 39: Xaa=Glu or Val
MMFMGFIRLGVWYNFFRAWNGGFSGNLEGEGFILGGVFXVGSGKQGILLEHREKEFGDKVN

SEQ ID NO: 7455 - protein, 63 aa, Homo sapiens
  UNSURE 27: Xaa=His or Gln
  UNSURE 28: Xaa=Pro or Arg
MLDQRIIWRGRKCRASSCKASHSCWSXXMFIREKQPVLPGQPFERAEPTLFLDSVSFHAIRPS

SEQ ID NO: 7456 - protein, 97 aa, Homo sapiens
  UNSURE 62: Xaa=Ile or Thr
MILLSDKIQSSKREVQCNFTEKNYTLIPADIKKDVTILDLSYNQITLNGTDTRVLQTYFLLXELYLIENKVTILHNNGFGNLSSLEILNICRNSIYV

SEQ ID NO: 7457 - protein, 65 aa, Homo sapiens [sequence omitted]

SEQ ID NO: 7458 - protein, 58 aa, Homo sapiens
MQQLERQVIDAERQAEKAFQQVQVMEDKLKAANIQTSESETRLYNKCQDLESLIQEKD

SEQ ID NO: 7459 - protein, 131 aa, Homo sapiens
  UNSURE 123: Xaa=Ala or Pro
MHLQRDGEEPFPAFKSWQEDSESGEAQLSPQAGRMNHHPLEEDCPPVLSHRSLDFGQSQRFLHDPEKLDSSSKALSFTRIRRSSFSSKDEKREDRTPYQLVKKLQKKIRQFEEQFERERNSKXSYSDIAAK

SEQ ID NO: 7460 - protein, 72 aa, Homo sapiens
MLERLKAPWSAALQRKYFDLGIWTAPISPMALTMLNGLLIKDSSPPMLLHQVNKTAQLDTFNYQSCFMQSVF

SEQ ID NO: 7461 - protein, 57 aa, Homo sapiens
MIERNTIRNDKGNVTTDPTEIETAIRNYCKHFYAYKLENFKEMDKFMEKYTLPQLSH

SEQ ID NO: 7462 - protein, 118 aa, Homo sapiens
  UNSURE 80: Xaa= *  or Ala or Cys or Phe or Gly or Ile or Leu or Met or Arg or Ser or Thr or Val or Trp
  UNSURE 93: Xaa=Pro or Gln
MLLQVVREGKFSGFLDPPAASSCLGLPRSWRLRLAYLRAVPSWDLLLPSPTSERLTRSVESWGKHSLPCILAPPFSLQIXLSRQECQGIIGGXDSSLAIPLPSYNTDPQSSPATLPTL

SEQ ID NO: 7463 - protein, 130 aa, Homo sapiens
  UNSURE 27: Xaa= *  or Lys
MGVPAFFRWLSRKYPSIIVNCVEEKPXECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFKGIKRRHGSSS

SEQ ID NO: 7464 - protein, 56 aa, Homo sapiens
  UNSURE 46: Xaa=Cys or Ser
  UNSURE 50: Xaa=His or Tyr
MISFPMVVFLYPFLKWWRDPCRRELPTFHWFLLELAIFTLIEEGPXSTIXTGSFTR

SEQ ID NO: 7465 - protein, 53 aa, Homo sapiens
  UNSURE 27: Xaa=Phe or Tyr
  UNSURE 32: Xaa=Glu or Gly
  UNSURE 45: Xaa=Ala or Asp or Glu or Gly or Val
  UNSURE 47: Xaa=Ile or Lys
MLLLFRPKSPLYREAPCSASLTRALSXMLGAXGKLLDSMSRTPLXPXQVKGRA

SEQ ID NO: 7466 - protein, 77 aa, Homo sapiens
MALSGGLRCCRRVLSWVPVLVIVLVVLWSYYAYVFELCLVTVLSPAEKVIYLILYHAIFVFFTWTYWKSIFTLPQQP

SEQ ID NO: 7467 - protein, 70 aa, Homo sapiens
  UNSURE 22: Xaa=Ile or Val
MYLQEIRKQTFQMRVMISLKKXSFFLSNNVLYFTKSSILSMSRDKQLLEGTQFILPGFSLLLNHKNDSPQ

SEQ ID NO: 7468 - protein, 81 aa, Homo sapiens
MHDVIKKVKKKGEWKVLVVDQLSMRMLSSCCKMTDIMTEGITIVEDINKRREPLPSLEAVYLITPSEKSVHSLISDFKDPP

SEQ ID NO: 7469 - protein, 74 aa, Homo sapiens
  UNSURE 52: Xaa=Gly or Arg
MDNTLSCVHLGYLGPLYVINYHLSFLAWLTLDPSPHLKISKMLWILLFKKIXPKSQHSPWLPVLLGSFFFFFFF

SEQ ID NO: 7470 - protein, 69 aa, Homo sapiens
MNKNSTDVKGCSMYVALFPCNECAKLIIQAGIKEVIFMSDKYHDSDEATAARLLFNMAGVTFRKFIPKR

SEQ ID NO: 7471 - protein, 54 aa, Homo sapiens
MNVTLQPTDTGSAWAKQQRKKDCGRGSGMLRCRPEFKALGLASQEASSTGLDTR

SEQ ID NO: 7472 - protein, 53 aa, Homo sapiens
  UNSURE 20: Xaa=Ala or Thr
MHSQEGGHLVGVKKTKVCTXPSSGHAASGKDSSSRLAVTDPTRPGATTKITKP

SEQ ID NO: 7473 - protein, 83 aa, Homo sapiens
  UNSURE 3: Xaa=Asp or Glu
  UNSURE 11: Xaa=Asp or Glu
  UNSURE 12: Xaa=Glu or Lys
  UNSURE 20: Xaa=Lys or Thr
  UNSURE 26: Xaa=Ala or Glu
  UNSURE 36: Xaa=Glu or Val
  UNSURE 45: Xaa=Arg or Ser
MAXTDLFMECXXEELEPWQXISDVIXDSVVEDYNSXDKTTTVSVXQQPVSAPVPIAAHASVAGHLSTSTTVSSSGAQNSDSTK

SEQ ID NO: 7474 - protein, 57 aa, Homo sapiens
MMLKAANGILMELRTPMSNSSLLHSFFFTYKKGLNGGLFCNQEHFLGVKVLIINSTR

SEQ ID NO: 7475 - protein, 126 aa, Homo sapiens
  UNSURE 82: Xaa=His or Gln or Arg
  UNSURE 91: Xaa=Ile or Arg or Ser
MGTKMADLDSPPKLSGVQQPSEGVGGGRCSEISAELIRSLTELQELEAVYERLCGEEKVVERELDALLEQQNTIESKMVTLXRMGPNLQLXEGDAKQLAGMITFTCNLAENVSSKVRQLDLAKKHS

SEQ ID NO: 7476 - protein, 56 aa, Homo sapiens [sequence omitted]

SEQ ID NO: 7477 - protein, 55 aa, Homo sapiens [sequence omitted]

SEQ ID NO: 7478 - protein, 56 aa, Homo sapiens
  UNSURE 20: Xaa=Pro or Arg
  UNSURE 42: Xaa=His or Pro or Gln or Arg
  UNSURE 43: Xaa= *  or Gln or Arg
MKRQRHPRLRPQSAQSSFPXSPGPSPDVQLATLAQRVKEVLXXCAIGCHPERPGQD

SEQ ID NO: 7479 - protein, 75 aa, Homo sapiens
MTILNKDVLYLDNGHPEYTDLIATHCICVKKFSCTTYTFTKSTGFPLPFPRTDIYMNYKVGPSAFLWSLKTHRHI

SEQ ID NO: 7480 - protein, 57 aa, Homo sapiens
MVKRHLLGREDNLSLDITKLKRQIFEASQAHLSIVPGAEALDQVAENLSGLNPRTWI

SEQ ID NO: 7481 - protein, 57 aa, Homo sapiens
MKNISPLFEAFVKQRYEQIGNANQRGCSRECALFCGNPQNAWAYKPNLNSHRRNPAG

SEQ ID NO: 7482 - protein, 51 aa, Homo sapiens
  UNSURE 2: Xaa=Asp or Glu
  UNSURE 3: Xaa=Phe or Ser
  UNSURE 6: Xaa=Glu or Lys
  UNSURE 9: Xaa=Pro or Arg
  UNSURE 12: Xaa=Ala or Glu
  UNSURE 13: Xaa=His or Pro
MXXSGXPPXLPXXRHQEENSKKRFSRDREATCPGNPLKPAGNMFAPSSPTP

SEQ ID NO: 7483 - protein, 62 aa, Homo sapiens
MLREYTTAKFNSLPSMKIIKNCFSNSIIHQNCSFFFLGTYGFLFPSLQNLMLENCISYTRWL

SEQ ID NO: 7484 - protein, 80 aa, Homo sapiens
MHPFLAAHGPAFHKGYKHSTINIVDIYPMMCHILGLKPHPNNGTFGHTKCLLVDQWCINLPEAIAIVIGSLLVLTMLTCR

SEQ ID NO: 7485 - protein, 75 aa, Homo sapiens
  UNSURE 14: Xaa=Leu or Pro
MVAPGYVVTVLTWXGTNPTLSSILLNSHTDVVPVFKEHWSHDPFEAFKDSEGYIYARGAQDMKCVSIQYLEAVRR

SEQ ID NO: 7486 - protein, 101 aa, Homo sapiens
MDLPGVSIADEGETGMFSLCTIRGHQLLEEVTQGDMSAADTFLSDLPRDDIYVSDVEDDGDDTSLDSDLDPEELAGVRGHQGLRDQKRMRLTEVQDDKEDG

SEQ ID NO: 7487 - protein, 99 aa, Homo sapiens
  UNSURE 60: Xaa=Ala or Cys or Asp or Phe or Gly or His or Ile or Leu or Asn or Pro or Arg or Ser or Thr or Val or Tyr
  UNSURE 86: Xaa=Lys or Arg
MDDLMLFFLGALCRESGVPSLGKQERMRAYAAEMPPLLPSPCPPPSHLPKPASPCPYPLXLLTFPVGVPHLPGTRLQCQGLGHSLXRAERGVGGGVSPG

SEQ ID NO: 7488 - protein, 82 aa, Homo sapiens
MKTGELEKETAPLRKDADSSISVLEIHSQKAQIEEPDPPEMETSLDSSEMAKDLSSKTALSSTESCTMKGEEKSPKTKKDKR

SEQ ID NO: 7489 - protein, 117 aa, Homo sapiens
  UNSURE 106: Xaa=Asp or Glu
  UNSURE 116: Xaa=Pro or Thr
MTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISVRLQSVFKGGFXILRTLYLHSXG

SEQ ID NO: 7490 - protein, 52 aa, Homo sapiens
MTEEPIKEILGAPKAHMAATMEKSPKSEVVITTVPLVSEIQLMAATGGTSSP

SEQ ID NO: 7491 - protein, 95 aa, Homo sapiens
  UNSURE 71: Xaa=Asp or His
  UNSURE 72: Xaa=Gly or Arg
MEKGLASLKSEMREVEGELERKELEFDTNMDAVQMVITEAQKVDTRAKNAGVTIQDTLNTLDGLLHLMGAXXGEAPTDPALDGPAGTTQINKLAY

SEQ ID NO: 7492 - protein, 73 aa, Homo sapiens
  UNSURE 71: Xaa=Asp or His
MLFFCFFKFLYFFETESALLPRLECSGAILAHCSLHLPGSSDSPASATRIAGITGVCHHTQLNFFCIFSRXGV

SEQ ID NO: 7493 - protein, 92 aa, Homo sapiens
MISITEWQKIGVGITGFGIFFILFGTLLYFDSVLLAFGNLLFLTGLSLIIGLRKTFWFFFQRHKLKGTSFLLGGVVIVLLRWPLLGMFLELR

SEQ ID NO: 7494 - protein, 99 aa, Homo sapiens
MEAEESEKAATEQEPLEGTEQTLDAEEEQEESEEAACGSKKRVVPGIVYLGHIPPRFRPLHVRNLLSAYGEVGRVFFQAEDRFVRRKKKAAAAAGGKKR

SEQ ID NO: 7495 - protein, 63 aa, Homo sapiens
MAVSNPASSLNPGTRPNPRKSTNPRMNPNPGISPDLKMTSSPKMTPNSKTSLNRAVTPKSHND

SEQ ID NO: 7496 - protein, 90 aa, Homo sapiens [sequence omitted]

SEQ ID NO: 7497 - protein, 87 aa, Homo sapiens
MGEHEQVKPLETSSSKVKAKTIVMIPDSQKLLRCELESLKSQLQAQTKAFEFLNHSVTMLEKESCLQQIKIQQLEEVLSPRGRQGEK

SEQ ID NO: 7498 - protein, 71 aa, Homo sapiens
  UNSURE 55: Xaa=Ala or Glu
MSLVEAISLWNEGVLAADKKDWKGALDAFSAVQDPHSRICFNIGCMYTILKNMTXAEKAFTRSINRDKHLA

SEQ ID NO: 7499 - protein, 58 aa, Homo sapiens
MKVFVCCASTSHSGEKPVPTLPQFTMGPNVKINVLEDFEGENPQVPKLEKSISGDQPR

SEQ ID NO: 7500 - protein, 51 aa, Homo sapiens
MFLCKEVKWSNLWAVKINLLTIAYTIKLDWGIYYYISMKYKLNRSRVRNSA

SEQ ID NO: 7501 - protein, 111 aa, Homo sapiens
MLIRANGTHHKILPMFPLYREPTKPGLEPSVCQAPLSAFSAPSHRGVTQVHTARHVPALPFMAPNPQAPQSFPETAETPSCVPSPVRPCHAPAQTPSVAPTYSSNLDWERT

SEQ ID NO: 7502 - protein, 63 aa, Homo sapiens
MGLEMASNTLPPQIMLLQISSWMVSPDDFYPGAELLATGHTLSTTRLVSSMTDILHSLPPTPI

SEQ ID NO: 7503 - protein, 65 aa, Homo sapiens
MYLKSFKERIASCFFSRQPLHPAPRSPSRPPISEQTSLQNFLWDSSLPTANSLFTSFLWFKPTAH

SEQ ID NO: 7504 - protein, 57 aa, Homo sapiens
MYVGGSMYVSSTAACWTLRTGKDQSKPCLLSSGNQNMFGVVGATQTLLSPLTHFLPP

SEQ ID NO: 7505 - protein, 86 aa, Homo sapiens
  UNSURE 55: Xaa=Phe or Leu
  UNSURE 56: Xaa=Ala or Pro
  UNSURE 65: Xaa=Glu or Lys
MQDAHVILNDITEECRPPSSLITRVSYFAVFDGHGGIRASKFAAQNLHQNLIRKXXKGDVISVEXTVKRCLLDTFKHTDEESLNKL

SEQ ID NO: 7506 - protein, 99 aa, Homo sapiens
MESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEQP

SEQ ID NO: 7507 - protein, 64 aa, Homo sapiens
MKCISLYLEDEAQTPTPLSPPGLGMSPAARPRSFPGGLGEVGAGTISVPSTLTPSTSETTLSPT

SEQ ID NO: 7508 - protein, 51 aa, Homo sapiens [sequence omitted]

SEQ ID NO: 7509 - protein, 120 aa, Homo sapiens
  UNSURE 75: Xaa= *  or Trp
  UNSURE 76: Xaa=Pro or Arg or Thr
  UNSURE 80: Xaa=Ala or Asp
MRKDPSGAGLWLHSGGPVLPYVRESVRRNPASAATPSTAVGLFPAPTECFARVSCSGVEALGRRDWLGGGPRAHXXATEXSAPKESLGCHDCHAIKKCRKWEVFRMTHQVLFPRVWALSW

SEQ ID NO: 7510 - protein, 53 aa, Homo sapiens
  UNSURE 19: Xaa=Glu or Gly
MGPKAPVTGYVRFLNERRXQIRTRHPDLPFPEITKMLGAEWSKLQPTEKQRYQ

SEQ ID NO: 7511 - protein, 59 aa, Homo sapiens
  UNSURE 9: Xaa=Asp or Asn
  UNSURE 15: Xaa=Ile or Met
  UNSURE 16: Xaa=Asp or Asn
  UNSURE 18: Xaa=Phe or Leu
  UNSURE 19: Xaa=Asp or Asn
  UNSURE 50: Xaa=Lys or Arg
MGFPGPKGXDVSSFXXFXXKYLTGRLLFSIWSKEMVKTQSPLQSMEEYMXIKLHVGREL

SEQ ID NO: 7512 - protein, 93 aa, Homo sapiens
  UNSURE 3: Xaa=Glu or Gly or Lys or Arg
  UNSURE 10: Xaa= *  or Cys
  UNSURE 13: Xaa=Lys or Asn or Arg or Ser
  UNSURE 16: Xaa=Asp or Glu
  UNSURE 81: Xaa=Ile or Ser or Thr
MNXYASPFNXQLXYLXLSRFECVHRDGRVITLSYQEQELQDFLLSQMSQHQVHAVQQLAKVMGWQVLSFSNHVGLGPIESXGNASAITVAPQV

SEQ ID NO: 7513 - protein, 88 aa, Homo sapiens
MSLAVFLPSVFWNSLSRIWVLVLFKCLVEFSSKAMGSWTFSLLGVLVCFHTADKDIPQTETGQFTKERGLIGLNSSTWLGKLTIMVEG

SEQ ID NO: 7514 - protein, 60 aa, Homo sapiens
  UNSURE 27: Xaa=Pro or Gln
MESRDHNNPQEGPTSSSGRRAAVEDNXLLIKAVQNEDVDLVQQLLEGGANVNFQEEKGAG

SEQ ID NO: 7515 - protein, 58 aa, Homo sapiens
MPGSLPLNAEACWPKDVGIVALEIYFPSQYVDQAELEKYDGVDAGKYTIGLGQAKMGF

SEQ ID NO: 7516 - protein, 72 aa, Homo sapiens
  UNSURE 63: Xaa= *  or Leu or Trp
MESRSVTQAGVQWCISAYCKLRLPGSRHSPASASHVAGTTGARHHARLIFCTFFSIDGVSPCXPGWSRSPDL

SEQ ID NO: 7517 - protein, 65 aa, Homo sapiens
MFCQRKDTGQKKTLDKKDGRRMSFQKPKGTIEYTVESRDSLNSIALKFDTTPNELVQLNKLFSRA

SEQ ID NO: 7518 - protein, 79 aa, Homo sapiens
MRLESPDENFAVVQEHAIHHIDGPLRRFLLLEVHEPVALGPLFVTGHFAGEDVAERREDVVQRLVVDGLAQVLDEDVAH

SEQ ID NO: 7519 - protein, 54 aa, Homo sapiens
MLIFLSFFLFDMESRSLAQAGLQWHNLGSLQPLPPGFKRFSCLSLPSSWDYRRA

SEQ ID NO: 7520 - protein, 54 aa, Homo sapiens
MYLKCLVPDTQGTLCKWSDSYSSGSSVDSGKPSKVIMGGGRKYMYPKNKTDVEY

SEQ ID NO: 7521 - protein, 62 aa, Homo sapiens
MLILGKMIRWEDYVLRLWRKYSNKLQILNSIFPGIGCPVPRIPAEANPLADHVSATRILCGA

SEQ ID NO: 7522 - protein, 54 aa, Homo sapiens
MSSLQALCSGLPLRPLPENRGRQAGVPHAPVRTPSLSPVEKQLALRNALRYFPP

SEQ ID NO: 7523 - protein, 96 aa, Homo sapiens
MFFKYTWNNFLHTQVEICIALILASPFENTENATITDQDSTGDNLLLKHLFQKCQLIERILEAWEMNEKKQAEGGRRHGYMGHLTRIANCIVHTLT

SEQ ID NO: 7524 - protein, 59 aa, Homo sapiens
  UNSURE 45: Xaa=Ser or Thr
MAILPKVIYRFNAIPIKLPMPFFTELEKTTLKFIWNQKRARIAKXILSQKDKAGGITLP

SEQ ID NO: 7525 - protein, 60 aa, Homo sapiens [sequence omitted]

SEQ ID NO: 7526 - protein, 58 aa, Homo sapiens
  UNSURE 2: Xaa=Lys or Arg
MXCHQQQLQRMKENAKHRNQYKFILLENLTSRYEVPCVLDLKMGTRQHGDDASEEKAA

SEQ ID NO: 7527 - protein, 60 aa, Homo sapiens
MVQGGFPEKIRQRYADLPGELHIIELEKDKNGLGLSLAGNKDRSRMSIFVVGINPEGPTA

SEQ ID NO: 7528 - protein, 51 aa, Homo sapiens [sequence omitted]

SEQ ID NO: 7529 - protein, 138 aa, Homo sapiens
  UNSURE 16: Xaa=Lys or Asn
  UNSURE 17: Xaa=Gly or Ile or Ser or Val
  UNSURE 29: Xaa=Lys or Asn
  UNSURE 30: Xaa=Ile or Leu
  UNSURE 32: Xaa=Asp or Phe or His or Ile or Leu or Asn or Val or Tyr
  UNSURE 39: Xaa=Arg or Ser
  UNSURE 42: Xaa=Lys or Arg
  UNSURE 44: Xaa=Ile or Lys or Met or Asn or Arg or Ser or Thr
  UNSURE 74: Xaa=Ile or Ser
MKLKLYLCILGPWGCXXKVPLIGFLKRIXXYXLTVLKPXSLXSXSAGLVPSEDSKKESVSCLSPRFWWWLGSLXVTWLIHASLQSLSPFSHAIFSCVSVFSFAYKDTSHIELGPALITSSQLPLQGTNFQIMSHSHVA

SEQ ID NO: 7530 - protein, 73 aa, Homo sapiens
  UNSURE 2: Xaa=Lys or Met or Arg or Thr
  UNSURE 27: Xaa=Pro or Thr
  UNSURE 47: Xaa=Asp or Glu
MXGIAPEEGGVDAKDTSATSQSVNGSXQAEQPSLESTSKEAFFSRVXTFSSLKWAGKPFELSPLVCAKYGWVT

SEQ ID NO: 7531 - protein, 84 aa, Homo sapiens
MLQQFNALAQLRRIDQLTIDPQGNPVVNFTLWKYYVLFRLSHFSMQKINGTEVTQNDMIMAERLFGILAHVASSELPQYRLISI

SEQ ID NO: 7532 - protein, 53 aa, Homo sapiens
  UNSURE 52: Xaa=Ala or Pro or Thr
MFPSNTDTDQGRLNPTNFSSDASQQGAFQELMAKISTHNTNKLRKSLLTILXQ

SEQ ID NO: 7533 - protein, 51 aa, Homo sapiens
MGTQDPGNMGTGVPASEQISCAKEDPQVYCPEETGGTKDVQVTDCKSPEDS

SEQ ID NO: 7534 - protein, 99 aa, Homo sapiens
  UNSURE 23: Xaa=Asp or Glu
  UNSURE 27: Xaa=Lys or Asn
  UNSURE 28: Xaa=Leu or Gln
  UNSURE 96: Xaa= *  or Leu
MGKDFITKTPKAMVTKTKIDKWXLKWXXKSFCTARETIIRVNRQPTEWEKIFAIHPYDKGLISRIYKELKQIYKKKQPYRKEGKGYEQTFLKRRHXCNQ

SEQ ID NO: 7535 - protein, 82 aa, Homo sapiens [sequence omitted]

SEQ ID NO: 7536 - protein, 54 aa, Homo sapiens
  UNSURE 37: Xaa= *  or Cys
MAQGTLIRVTPEQPTHAVCVLGTLTQLDICSSAPEDXTSFKHQRLPRGGRGYCP

SEQ ID NO: 7537 - protein, 52 aa, Homo sapiens
  UNSURE 12: Xaa=Cys or Phe or Ser or Tyr
MNPRFPLLRWGXREGTTSALDIPGDARTRWAVRAGALERWPWRRRPLVTDAG

SEQ ID NO: 7538 - protein, 58 aa, Homo sapiens
  UNSURE 28: Xaa= *  or Gly or Leu or Arg or Val
  UNSURE 44: Xaa=Ala or Ser
MFYLAMQVIYVYIQPAGNLRSKEVGLEXRRKLESLRLEPSCAAXIFSGMAVRIFWLKS

SEQ ID NO: 7539 - protein, 107 aa, Homo sapiens
  UNSURE 49: Xaa=Glu or Val
  UNSURE 101: Xaa= *  or Tyr
MKEEGVKLLREAMGIYISTLKTEFTQGMILPTMNGESVDPVGQPALKTXERKAKPAPSKTQARPVGVKIPTCKITLKETFLTSPEELYRVFTTQGAGAGLXPCSCNI

SEQ ID NO: 7540 - protein, 62 aa, Homo sapiens
  UNSURE 55: Xaa=Leu or Val
MTSHPPAAMLHFITGWQGFKEQRWGQAPMHEHLSSLCLYHLCSLPMDQSKSHSGXQVNEKAR

SEQ ID NO: 7541 - protein, 83 aa, Homo sapiens
  UNSURE 17: Xaa=Ala or Asp
MAQALGEDLVQPPELQXDSSSLGSDSELSGPGPYRQADRYGFIGGSSAEPGPGHPPADLIRQREMKWVEMTSHWEKTMSRRYK

SEQ ID NO: 7542 - protein, 115 aa, Homo sapiens
  UNSURE 108: Xaa=His or Asn
MPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNLXLTPTQSS

SEQ ID NO: 7543 - protein, 71 aa, Homo sapiens
MHASNSLNFGFSYLKHFSGIFPFLMLWGGNRMANHCEPDTSAQSTLCVTSQMGDFTNGVTECYYFQILTRS

SEQ ID NO: 7544 - protein, 87 aa, Homo sapiens
  UNSURE 36: Xaa=Ser or Thr
  UNSURE 59: Xaa=Asp or Glu
  UNSURE 60: Xaa=Ala or Asp or Gly or Val
  UNSURE 69: Xaa=His or Gln or Arg
MKGFLSGHAENLLRGVYETCTTMTMSLLKWVRQTPXPSRPSDSDVSLEEDREAVRREAXXRPRHSWKKXRQSPLHLRFGQMSATVRP

SEQ ID NO: 7545 - protein, 91 aa, Homo sapiens
MSLLGPKVLLFLAAFIITSDWIPLGVNSQRGDDVTQATPETFTEDPNLVNDPATDETVLAVLADIAPSTDDLECWDEKFTCTRLYSVHRPV

SEQ ID NO: 7546 - protein, 61 aa, Homo sapiens [sequence omitted]

SEQ ID NO: 7547 - protein, 102 aa, Homo sapiens
  UNSURE 19: Xaa=Glu or Lys
MGQFTAAMVGRISCLGVWXTAKSGKLQPASEASVVTGPNNNKNNRNNNNNNKTCHVCTGIYKHAHRTKPSGQGFKESFWAAHPRGEAYPLAWCHCSPAPSPP

SEQ ID NO: 7548 - protein, 51 aa, Homo sapiens
MFMAYFSFNLPGLKHFSYLRSPSSWDYRHTPSHPANFCIFCRVRVSPFSPG

SEQ ID NO: 7549 - protein, 78 aa, Homo sapiens
  UNSURE 49: Xaa=Ala or Glu or Val
  UNSURE 51: Xaa=Lys or Asn
  UNSURE 52: Xaa= *  or Cys or Arg or Ser or Trp
  UNSURE 62: Xaa=His or Gln
  UNSURE 64: Xaa=Ala or Pro
  UNSURE 65: Xaa=Cys or Ser
MCDWKDVLSGGEKQRIGMARMFYHRPKYALLDECTSAVSIDVEGKIFQXAXXRGHCLLSITXRXXLWKYTHTCYSSMG

SEQ ID NO: 7550 - protein, 57 aa, Homo sapiens
  UNSURE 29: Xaa= *  or Arg
MRSRHCTPVWATEQDSVSKKEIDVHSGTXQKKYPHTCWVIVTVLFLSRNPKVSRLVL

SEQ ID NO: 7551 - protein, 67 aa, Homo sapiens
MLLLNENLKAEIQKNEAQGSCILFLFCFESQNMRSKSIFPFLILHFFPQQIRKKIVVLLLGLNSQKA

SEQ ID NO: 7552 - protein, 102 aa, Homo sapiens
  UNSURE 80: Xaa=His or Asn or Arg or Ser
MSNCRAGENAGMGRFTKVGEQERTVDTLPSPQHPVAHCCSQLEERWQRLQSQVISELDACKECTQGVQREVSMVEGRVSXMEKTCSKLDSISGNLQRIKEGL

SEQ ID NO: 7553 - protein, 65 aa, Homo sapiens
  UNSURE 12: Xaa=Leu or Pro
  UNSURE 13: Xaa=Lys or Asn
  UNSURE 17: Xaa=Phe or Val
  UNSURE 19: Xaa=Cys or Phe
MPFFLMIPIIVXXNFFXNXFYYTLSSRVHVHNMQVCYICVHVPCWCAAPINLSFTLGISPNAIPS

SEQ ID NO: 7554 - protein, 55 aa, Homo sapiens
MCHHARLIFVFLVEMGFLHVGQTCLGLPTSGDLPASASQSAGITGMSHRACPFFF

SEQ ID NO: 7555 - protein, 55 aa, Homo sapiens
MKCLVCINTLWRINRIQFFRERYFQIHVILRALNTMHSIVFLLFCFKENDCLDPV

SEQ ID NO: 7556 - protein, 87 aa, Homo sapiens
MRLCLIMYCSFGTLSHLTYLLLLSPIKYPLDLDFLYPIFSTVYKRYIVTVNFCISCSESFLLSDLIALFLIRELQLLQHTVSVVQPP

SEQ ID NO: 7557 - protein, 56 aa, Homo sapiens
  UNSURE 2: Xaa=Ala or Leu or Pro or Val
  UNSURE 3: Xaa=Asp or Glu
  UNSURE 30: Xaa=His or Tyr
MXXPKLSSASGPNNSFTKGAAFYPGHTEVXSVMSMLFYTLITAFLIGIQAEPHSES

SEQ ID NO: 7558 - protein, 91 aa, Homo sapiens [sequence omitted]

SEQ ID NO: 7559 - protein, 53 aa, Homo sapiens [sequence omitted]

SEQ ID NO: 7560 - protein, 51 aa, Homo sapiens
  UNSURE 29: Xaa=Leu or Pro or Gln
MCPQVLRSASPIRKGKRFLQMRIAWQSVXPLPKMTPVTQVKSEVQQPVHPK

SEQ ID NO: 7561 - protein, 64 aa, Homo sapiens
  UNSURE 30: Xaa=Ile or Lys or Met or Asn or Arg or Ser or Thr
  UNSURE 60: Xaa=Ala or Pro or Thr
MRFSPVQPLLSPVHRLLQPKRNECIQGSEXASMVITESPAALQLRYLQTLTTIAAEKNSXIVFP

SEQ ID NO: 7562 - protein, 64 aa, Homo sapiens
  UNSURE 17: Xaa=Ala or Glu or Gly or Leu or Pro or Gln or Arg or Val
MYESSVWGLSVCICEFXREGLSPSVCRCQDGDGQRRSSWAALVAPRGCGVGHFSPRGLGSTVQH

SEQ ID NO: 7563 - protein, 91 aa, Homo sapiens
  UNSURE 67: Xaa=Cys or Phe
  UNSURE 79: Xaa=Lys or Gln
  UNSURE 82: Xaa= *  or Cys or Gly
  UNSURE 83: Xaa=Phe or Ile or Leu
  UNSURE 88: Xaa=Cys or Gly
MLRKQSEIFLKRDRVSLKCNGSITAHNFLGSGDPPSSAIQVAGTTGVRHYAWLIFYFFFSREGVSPXCPGWSRTLGLKXSTXXGLPKXWEL

SEQ ID NO: 7564 - protein, 79 aa, Homo sapiens
MYRLSLIAGPGSYPVLRWGVWDIPSSLVQVTYHQPNLTTNLDLPLFFSCSISATHSCVKPPSVIIGISSFLSFPYQTLV

SEQ ID NO: 7565 - protein, 77 aa, Homo sapiens
  UNSURE 29: Xaa=Ala or Gly
  UNSURE 31: Xaa=Ala or Asp or Val
  UNSURE 62: Xaa=Asp or Phe or Val or Tyr
  UNSURE 72: Xaa= *  or Cys
MVSGKKLPLAWRRPFHLPPRSASLTPSPXLXVLPRNRKEQGSCRTGVLGKVSRAGSWEGCPXCFLSSCGSIXPACLP

SEQ ID NO: 7566 - protein, 92 aa, Homo sapiens
  UNSURE 84: Xaa= *  or Ala or Glu or Gly or Leu or Ser or Val
MTLPKTYTIANQFPLNKLTELLRHDMAAAGFTEALTFALCSQEDIADKLGVDISATKAVHISNPKTAEFQVARTTLLPGLLKTXAANRKMPP

SEQ ID NO: 7567 - protein, 69 aa, Homo sapiens
MGTWQLKTDGSRTKETFALEAQPNSPGHRHRWHLEHGLPQSGGRACVVQRAQPGTKKEMRPLSSMSPCP

SEQ ID NO: 7568 - protein, 66 aa, Homo sapiens
  UNSURE 62: Xaa=Ile or Ser or Thr
MLQWTLRVLGMGGIRDLLSKSESQLFSFLLYPPLRYLCDKVVPGNRVTIMGIYSIKKFGLTXSRGL

SEQ ID NO: 7569 - protein, 104 aa, Homo sapiens
  UNSURE 52: Xaa=His or Gln
MAASSQLRLTEQHFIELDENRQRLLQKCKELMKRARQVCNLGAEQTLPQEYXTVFQDLPNTLDEIDALLTEERSRASCFTGLNPTIVQEYTKREEEIEQLTEEH

SEQ ID NO: 7570 - protein, 122 aa, Homo sapiens
MLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLV

SEQ ID NO: 7571 - protein, 83 aa, Homo sapiens
  UNSURE 74: Xaa=Asp or Glu
  UNSURE 76: Xaa=His or Gln
  UNSURE 80: Xaa=Lys or Gln
MQVADVPEKPRVPAFACQVAGCCQVFDALDDYEHHYHTLHGNVCSFCKRAFPSGHLLDAHILEWHDSLFQILSXRXDMYXCLV

SEQ ID NO: 7572 - protein, 66 aa, Homo sapiens
  UNSURE 41: Xaa=Ile or Asn
  UNSURE 46: Xaa=Leu or Val
  UNSURE 51: Xaa=Pro or Ser
  UNSURE 52: Xaa=Asp or Glu
MDATIAPHRIPPEMPQYGEENHIFELMQVLTTWVSALHPQXMLEQXLIHQXXDPIPFMIQHLHRDS

SEQ ID NO: 7573 - protein, 65 aa, Homo sapiens
  UNSURE 5: Xaa=Asp or Glu
  UNSURE 50: Xaa=Ser or Tyr
  UNSURE 65: Xaa=Phe or Leu or Val
MSTQXGLSMHAHPQAYTPFIYLHARKRRGEIGDADSRFNDRYAHKSAQLXFLYFVCCIFQDVYYX

SEQ ID NO: 7574 - protein, 59 aa, Homo sapiens
MSMTPEQLQAWRWEREIDERNRPLSDEELDAMFPEGYKVLPPPAGYVPIRTPARKLTAT

SEQ ID NO: 7575 - protein, 88 aa, Homo sapiens
  UNSURE 7: Xaa=Asp or Glu or Gly or Lys or Asn or Arg or Ser
  UNSURE 8: Xaa=Pro or Ser
MTAGEWXXVLSKYEDQITIFTDYLEEYPDTDELVWILGKQHLLKTEKSKLLSDISARLWFTYRRKFSPIGGTGPSSDAGWGCMLRCEQ

SEQ ID NO: 7576 - protein, 67 aa, Homo sapiens
MSDPEMGWVPEPPTMTLGASRVELRVSCHGLLDRDTLTKPHPCVLLKLYSDEQWVEVERTEVLRSCS

SEQ ID NO: 7577 - protein, 62 aa, Homo sapiens
MGPSLLQDARLWTSVSPAPGKWPLAEQVSCPGRSSPVPACGTPAPCSGSCCTSSWRLRLLPT

SEQ ID NO: 7578 - protein, 52 aa, Homo sapiens
METQSSDFPPSLTQPAPDQSSTIQLHPATSPAVSPTTSPAVSLVVSPAASPA

SEQ ID NO: 7579 - protein, 111 aa, Homo sapiens
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYL

SEQ ID NO: 7580 - protein, 98 aa, Homo sapiens
MAAEVLPIARWQYCGAPDGSQRAVLVQFSNGKLQSPGNMRFTLYENKDSTNPRKRNQRILAAETDRLSYVGNNFGTGALKCNTLCRHFVGILNKTSGL

SEQ ID NO: 7581 - protein, 65 aa, Homo sapiens
  UNSURE 40: Xaa=Glu or Val
MVFLHYLPEQLCLSMLGSWRGHPGQLTTLFISKSMIKWQXAKSIRCQCRKDPLNGVPLCIWASSV

SEQ ID NO: 7582 - protein, 81 aa, Homo sapiens
MHLLDLESMGKSSDGKSYVITGSWNPKSPHFQVVNEETPKDKVLFMTTAVDLVITEVQEPVRFLLETKVRVCSPNERLFWP

SEQ ID NO: 7583 - protein, 80 aa, Homo sapiens
MDPLIANNSGVNKRQITDLVDQSIQINAHCFVVTADNRYILICGFWDKSFRVYSTETGKLTQIVFGHWDVVTCLARSESY

SEQ ID NO: 7584 - protein, 64 aa, Homo sapiens
MIQALAGFFTYFVILAENGFRPVDLLGIRLHWEDKYLNDLEDSYGQQWTYEQRKVVEFTCQTAS

SEQ ID NO: 7585 - protein, 52 aa, Homo sapiens [sequence omitted]

SEQ ID NO: 7586 - protein, 65 aa, Homo sapiens
MGSAKSVPVTPARPPPHNKHLARVADPRSPSAGILRTPIQVESSPQPGLPAGEQLEGLKHAQDSD

SEQ ID NO: 7587 - protein, 68 aa, Homo sapiens
MSLGLEMKYRFPVHRQRSAVHPMNSYRSELNPELCLWRVRYISKYFFLFSHFPHHYHHHCRHHHCHHP

SEQ ID NO: 7588 - protein, 56 aa, Homo sapiens
MPYKEASHCVCSFLAFNLPPRKDTVNKVPSWKQTAAFTRHQTFWHLDLALSSLQNR

SEQ ID NO: 7589 - protein, 85 aa, Homo sapiens
  UNSURE 12: Xaa=His or Gln
  UNSURE 13: Xaa=Ile or Leu
MGGAGGAAPAPXXPAPGAGLPAALPRCVTHGPWLNVQPQPQEELKEEQTAMVPPAIPLRRCRYCLVLQPLRARHCRECRRCVRRY

SEQ ID NO: 7590 - protein, 89 aa, Homo sapiens
  UNSURE 50: Xaa=Glu or Lys or Gln
MANSGCKDVTGPDEESFLYFAYGSNLLTERIHLRNPSAAFFCVARLQDFXLDFGNSQGKTSQTWHGGIATIFQSPGDEVWGVVWKMNKS

SEQ ID NO: 7591 - protein, 93 aa, Homo sapiens
MTAKMETTFYDDALNASFLPSESGPYGYSNPKILKQSMTLNLADPVGSLKPHLRAKNSDLLTSPDVGLLKLASPELERLIIQSSNGHITTTPT

SEQ ID NO: 7592 - protein, 93 aa, Homo sapiens
  UNSURE 87: Xaa=His or Gln
  UNSURE 88: Xaa=Ala or Asp
MEKLKQKLHTDDELNWLDHGRTLREQGVEEHETLLLRRKFFYSDQNVDSRDPVQLNLLYVQARDDILNGSHPVSFDKACEFAGFQCXXPVWAP

SEQ ID NO: 7593 - protein, 77 aa, Homo sapiens
  UNSURE 49: Xaa=Gly or Arg
MCRPGLVTYSQVKPTLGAPGRATELRPQKSSRRAPLALTFPWCEVPEIXMQERDYGPEAQLHLEALGVPKPWATSPS

SEQ ID NO: 7594 - protein, 71 aa, Homo sapiens
MSTQDVFSYFKEYPPAHIEWLDDTSCNVVWLDEMTATRALINMSSLPAQDKIRSRDASEDKSAEKRKKDKQ

SEQ ID NO: 7595 - protein, 116 aa, Homo sapiens
  UNSURE 35: Xaa=Lys or Arg
  UNSURE 91: Xaa=Ile or Lys
  UNSURE 100: Xaa=Ala or Cys or Asp or Gly or His or Asn or Pro or Arg or Ser or Thr or Tyr
MEEEGGGRSCGTTRELQKLKQQAMEYYRENDVPRXLERAAQLHLLPPACRRLRAPGRKDTITEKPIAPAEPVEPVLSGSMAIGAVSLAVAXACAMLLNKXLYLNIALLKHNQEQPT

SEQ ID NO: 7596 - protein, 75 aa, Homo sapiens
MAIKAANLMTPGKKQKKSLFLCKGHPRRSLPVQGALVAIRRGTKGNIFSSQAFFSGCFILFFFFISPPPPSPAFF

SEQ ID NO: 7597 - protein, 99 aa, Homo sapiens
  UNSURE 70: Xaa=Ile or Lys or Met or Asn
MKSDLVEYFTLEMLHLGNNRIEVLEEGSFMNLTRLQKLYLNGNHLTKLSKGIVLGLHNLEYLYLEYNAIXEILPGTFNPMPKLKVLYLNNNLLQVLPPL

SEQ ID NO: 7598 - protein, 70 aa, Homo sapiens
MTVTHIFTSDGLHAEVTGVGYNQFGEVIVDGDVVHGFYNPAVSRIVEAGCVCNDAVIRNNTLMGKPTEGA

SEQ ID NO: 7599 - protein, 78 aa, Homo sapiens
  UNSURE 3: Xaa=Leu or Val
  UNSURE 21: Xaa=Ala or Ser
  UNSURE 47: Xaa= *  or Cys or Lys or Asn or Arg or Ser or Trp or Tyr
  UNSURE 52: Xaa= *  or Lys or Leu or Met
  UNSURE 69: Xaa=Ala or Gly
  UNSURE 77: Xaa=Cys or Phe
MSXGFIGAGQLAFALAKGFTXAGVLAAHKIMASSPDMDLATVSALRXMGVKXTPHNKETVQHSDVLFLXVKPHIIPXI

SEQ ID NO: 7600 - protein, 66 aa, Homo sapiens
MHRKFVVHLFAEEWGQYVDLPKGFAVSERCKVRLVPLQIQLTTLGNLTPSSTVFFCCDMQERFRPD

SEQ ID NO: 7601 - protein, 108 aa, Homo sapiens
MAASQVLGEKINILSGETVKAGDRDPLGNDCPEQDRLPQRSWRQKCASYVLALRPWSFSASLTPVALGSALAYRSHGVLDPRLLVGCAVAVLAVHVAGNLVNTYYDFS

SEQ ID NO: 7602 - protein, 103 aa, Homo sapiens
MEKLQLGPEILQRENPRLIYARLSGFGQSGSFCRLAGHDINYLALSGVLSKIGRSGENPYAPLNLLADFAGGGLMCALGIIMALFDRTRTGKGQVIDANMVEG

SEQ ID NO: 7603 - protein, 138 aa, Homo sapiens
MSDDAGDTLATGDKAEVTEMPNSDSLPEDAEVHCDSAAVSHEPTPADPRGEGHENAAVQGAGAAAIGPPVQPQDANALEPPLNGDVTEDTLAECIDSVSLEAEPRSEIPLQEQNYLAVDSPPSGGGWAGWGSWGKSLL

SEQ ID NO: 7604 - protein, 54 aa, Homo sapiens
  UNSURE 18: Xaa= *  or Phe or Leu or Tyr
MFHERSQTQTAIYCMIAXIRNVQNRHIYIEKRQISGCRRLGEGEWEVTTNRYRK

SEQ ID NO: 7605 - protein, 65 aa, Homo sapiens
  UNSURE 7: Xaa=Gly or Arg or Trp
  UNSURE 10: Xaa=Lys or Thr
  UNSURE 14: Xaa= *  or Leu or Ser or Trp
  UNSURE 61: Xaa=His or Pro or Gln or Arg
MGLVARXTKXLRGXGLLSHPVTSGKGTEAWRLSFWVGEHIKLLGGWHSWTGHGSPTALPSXRPRS

SEQ ID NO: 7606 - protein, 55 aa, Homo sapiens
  UNSURE 29: Xaa=Leu or Met or Val
  UNSURE 32: Xaa=Ile or Asn
MESRDPAQPMSPGEATQSGARPADRYGLXKHXREFLDFFWDIANLSRRRDLRPRT

SEQ ID NO: 7607 - protein, 65 aa, Homo sapiens
  UNSURE 47: Xaa=Gly or Val
MEPKAVRTTTRYAIRCGPKQFTSYLTDMAVLVLEVITKLDGLPIGRXQINGLAQLSPTHQINGFF

SEQ ID NO: 7608 - protein, 73 aa, Homo sapiens
MAAMRWRWWQRLLPWRLLQARGFPQNSAPSLGLRARTYSQGDCSYSRTALYDLLGVPSTATQAQIKAAYYRQC

SEQ ID NO: 7609 - protein, 62 aa, Homo sapiens
  UNSURE 51: Xaa=Asp or Gly
MSDNGVCVLAFKCPGLLRYTAYRCKQLSDTSIIAVASHCPLLQKVHVGNQXKLTDEGLKQLG

SEQ ID NO: 7610 - protein, 54 aa, Homo sapiens
MAKGLRVNLGELVESMRLCFLSVHFRLRWGDSCPSSPHRETFPAGPVNGPLYHP

SEQ ID NO: 7611 - protein, 110 aa, Homo sapiens
  UNSURE 85: Xaa=His or Leu or Pro or Gln
  UNSURE 86: Xaa=Ala or Cys or Gly or Pro or Arg or Ser or Thr
  UNSURE 91: Xaa=any one of the twenty amino acids
  UNSURE 92: Xaa=Leu or Val
MAHFILFVFTVSTIFHVQQRLAKIQAMWELPVQIPVLASTSKALGPSQLRGMWTINAIGRLGNQVGEYATLYALAKMNGRPAFIXXQMHSXXAPIFRITLPVLHSATASR

SEQ ID NO: 7612 - protein, 104 aa, Homo sapiens
  UNSURE 19: Xaa=Gly or Val
  UNSURE 20: Xaa=His or Leu or Pro
  UNSURE 21: Xaa=Ser or Thr
  UNSURE 84: Xaa=Ile or Met
  UNSURE 85: Xaa=Asp or Tyr
  UNSURE 103: Xaa=Glu or Gly
MMVCFTYQPIVSGIGGFLXXXDFKNEAADPAGIQLTREMKDLFKENYKTLLKEIREDTSKWKNIPCSWIGRIIIMKMAILPKVXXRFNAIPIKLPFTFFTELXK

SEQ ID NO: 7613 - protein, 74 aa, Homo sapiens
  UNSURE 11: Xaa=Arg or Trp
  UNSURE 32: Xaa=His or Pro or Ser or Tyr
MRLWIPEEHCXGFPPESATCCNLRGSRTAAGXCWTVPVHVPGHGAGEPAHHPAMSPDSHLHTSMYFFLSNLSLP

SEQ ID NO: 7614 - protein, 76 aa, Homo sapiens
  UNSURE 3: Xaa=Ala or Gly
  UNSURE 4: Xaa=Ile or Met
  UNSURE 5: Xaa=Asp or Asn
  UNSURE 9: Xaa=Phe or Val
  UNSURE 46: Xaa=Cys or Phe or His or Ile or Leu or Asn or Pro or Arg or Ser or Thr or Tyr
MMXXXWGRXNLQSVTEQSSLDDFLATAELAGTEFVAEKLNIKFVPXEARTGLLSFEESQRIKKLHEENKQFLCIPR

SEQ ID NO: 7615 - protein, 57 aa, Homo sapiens
  UNSURE 40: Xaa=Cys or Phe or Tyr
MDYLQVGVTSQKTMKLIPASRHRATQKVVIGDHDGVVMCXGMKKGEAAAVFKTLPRP

SEQ ID NO: 7616 - protein, 55 aa, Homo sapiens
  UNSURE 7: Xaa=Lys or Arg
  UNSURE 12: Xaa=Lys or Gln
  UNSURE 23: Xaa=Cys or Phe
MAFPCRXSLTAXDSGLPPGGREXLSTAAVVPPGAKVPAGGEVPAGGDARGSHRRL

SEQ ID NO: 7617 - protein, 69 aa, Homo sapiens
  UNSURE 32: Xaa=His or Gln
  UNSURE 58: Xaa=Ala or Glu or Gly or Val
  UNSURE 63: Xaa=Asn or Ser or Thr or Tyr
MPHWGKVHASPICRGLLAPAARHKTSILGIAXQGKSLSQEVWKEHWSFCIRDLGRARXSAGQXLLRQPL

SEQ ID NO: 7618 - protein, 56 aa, Homo sapiens
MHMYMYIGKPHMYIVCCTLHMYKECLQIKENLSLFINLRTVAKGFKEFISTLFFLC

SEQ ID NO: 7619 - protein, 68 aa, Homo sapiens
  UNSURE 64: Xaa=Leu or Pro
MIYVTDKGQKKHFQQVFQMLKIMGYDWAERCQHVPFGVVQGMKTRRGDVTFLEDVLNEIQLRMXQNMA

SEQ ID NO: 7620 - protein, 100 aa, Homo sapiens
  UNSURE 81: Xaa= *  or Trp
  UNSURE 95: Xaa=Asn or Thr
MCGRTSCHLPRDVLTRACAYQDRRGQQRLPEWRDPDKYCPSYNKSPQSNSPVLLSRLHFEKDADSSERIIAPMRWGLVPSXFKESDPSKLQFNTXNCRSD

SEQ ID NO: 7621 - protein, 73 aa, Homo sapiens
  UNSURE 26: Xaa=His or Ile or Leu or Asn or Pro or Arg or Ser or Thr
  UNSURE 44: Xaa=Asp or Tyr
  UNSURE 47: Xaa=Leu or Arg
  UNSURE 55: Xaa=Gly or Arg or Ser
  UNSURE 56: Xaa=Glu or Gln
MLMSHLEEPKVTEDEEPPTEQDKRKXMLALKDPVHTVSLQQFIXEKXKAQQEMLXXQGFQSLMETVDTEIVTQ

SEQ ID NO: 7622 - protein, 109 aa, Homo sapiens
  UNSURE 60: Xaa=Cys or Trp
  UNSURE 90: Xaa= *  or Trp
MQKIEENRDCQLEKQIKEETLEQRDFTTKSEKFQEEEFQNDIEKAIDTHNQNDLTFRVSXRCSGTIGKAFTAQVCLHPKVESVAQAGMHXHNLAHCNLHLPGSGDSFAS

SEQ ID NO: 7623 - protein, 82 aa, Homo sapiens
  UNSURE 73: Xaa=Lys or Asn
  UNSURE 74: Xaa=Ala or Pro or Ser or Thr
MYQHISPDLSRRFPPRSEVTRLYGSVCDLRTNKLPGSPGLSKSMFDLTNSSQRFIQRHDSLSSVPSSSSSRKXXQGSNRSLD

SEQ ID NO: 7624 - protein, 128 aa, Homo sapiens
  UNSURE 108: Xaa=His or Gln
  UNSURE 115: Xaa=His or Gln
MSTGQLYRMEDIGRFHSQQPGSLTPSSPTVGEIIYNNTRNTLGWIGGILMGSFQGTIAGQGTGATSISELCKGQELEPSGAGLTVAPPQAVSLQGSHPALAATAFSLXCPRGVQXLMISISEHLFIHA

SEQ ID NO: 7625 - protein, 91 aa, Homo sapiens
MRNNMTASMFDLSMKDKTRSPFAKLKDKMKGRKNDGTFSDTSSAIIPSTHMPDANSEFSSGEIQMKSKPKKPFLLGPQRLSSAHSMSDLSG

SEQ ID NO: 7626 - protein, 71 aa, Homo sapiens
MKNIYESLDEVTIKDTLEGDNMYTCSHCGKKVRAEKRACFKKLPRILSFNTMRYTFNMVTMMKEKVNTHFS

SEQ ID NO: 7627 - protein, 69 aa, Homo sapiens
MALQTHQIQRGFCLGSLSNVNRNATVEMTRRHIGRGVRLYYIGGEVFAECLSDSAIFVQSPNCNQRYGW

SEQ ID NO: 7628 - protein, 58 aa, Homo sapiens
  UNSURE 17: Xaa=Lys or Asn
MRAPRNSSLLSYSPASXPQQYKSQFFPKSRQKSQTLILIRVVSSVLKKILEAKEYAHR

SEQ ID NO: 7629 - protein, 65 aa, Homo sapiens
  UNSURE 21: Xaa=Glu or Gln
MSDPQTSMAATAAVSPSDYLXPAASTTQDSQPSPLALLAATCSKIGPPAVEAAVTPPAPPQPTPR

SEQ ID NO: 7630 - protein, 53 aa, Homo sapiens
  UNSURE 50: Xaa=Asp or Gly
MSDPITLNVGGKLYTTSLATLTSFPDSMLGAMFSGKMPTKRDSQGNCFIXRDG

SEQ ID NO: 7631 - protein, 88 aa, Homo sapiens
  UNSURE 70: Xaa=Ala or Asp or Glu or Gly or Val
MNDKSHCKLFTDGDAALEFADFYDFRSSYPDHKEGEDPNKAEELPSEKNLEYDDETMELILPSGARVGHXSLMRYYKQRFGLSRAVAV

SEQ ID NO: 7632 - protein, 76 aa, Homo sapiens
  UNSURE 30: Xaa=Ala or Gly or Pro or Arg
MNGSRTLTHSISDGQLQGGQSNSELFQQEXQTAPAQVPQGFNVFGMSSSSGASNSAPHLGFHLGSKGTSSLSQQTP

SEQ ID NO: 7633 - protein, 70 aa, Homo sapiens
MAALGAGEMEYRFMLKQGERREEQSAYDEKASTIQQKFYWPNWKQESRGDQEGLDNVVGWKAENTNQLKR

SEQ ID NO: 7634 - protein, 79 aa, Homo sapiens
  UNSURE 4: Xaa=Leu or Trp
MCSXAPGTMGLWPACCRVALPGQSPGTEQAICGQAERMTGSLTSVHGTRSFGASRGCCWPGLEGKVTIRLSSCLSISAS

SEQ ID NO: 7635 - protein, 102 aa, Homo sapiens
MSVTLHTDVGDIKIEVFCERTPKTCENFLALCASNYYNGCIFHRNIKGFMVQTGDPTGTGRGGNSIWGKKFEDEYSEYLKHNVRGVVSMANNGRTPMDLSSS

SEQ ID NO: 7636 - protein, 73 aa, Homo sapiens
MQDLRMLMPHSKADTKMDRKDKLFVINEVCEMKNCNKCIYFEAKKKQDLYMWLSNSPHGPSAKFLVQNIHTLA

SEQ ID NO: 7637 - protein, 63 aa, Homo sapiens
MMDFLQTIFYYYYTLSSRVHVQNMQVCYIGIHVPWWFAAPINPSSTLGITPNFPLLPNPLTGP

SEQ ID NO: 7638 - protein, 93 aa, Homo sapiens
MLSTNILLVNLLVAMFGYTVGTVQENNDQVWKFQRYFLVQEYCSRLNIPFPFIVFAYFYMVVKKCFKCCCKEKNMESSVCCFKNEDNETLAWE

SEQ ID NO: 7639 - protein, 103 aa, Homo sapiens
  UNSURE 14: Xaa= *  or Glu or Leu or Val
MDDSGELGGLETMXTLTELGDELTLGDIDEMLQFVSNQVGEFPDLFSEQLCSSFPGSGGSGSSSGSSGSSSSSSNGRGSSSGLWTLQCNGHSPRSHYLPSLPQ

SEQ ID NO: 7640 - protein, 86 aa, Homo sapiens
  UNSURE 15: Xaa=Ala or Thr
  UNSURE 33: Xaa=Lys or Thr
  UNSURE 73: Xaa=Ala or Asp or Glu or Gly or Val
  UNSURE 74: Xaa=Ala or Pro or Ser
MAIRAKRLEESRAAXLRELQEKQALMEQQRREXRALQEWRERAQRMRKRKEELSKLLPPRRSMVASKIPSATXXIDNRKVPLNPPG

SEQ ID NO: 7641 - protein, 89 aa, Homo sapiens
  UNSURE 67: Xaa=Ala or Asp
  UNSURE 71: Xaa=Asp or Glu
  UNSURE 84: Xaa=Asn or Ser
MRYHCILPRMAVMNRISHMVTRMEDHLELSYTDDRNVKWINYFGRQLGSFFQSKCEDAIRFIHSISXYSRXMKLYIHKRDLYTXIHSSY

SEQ ID NO: 7642 - protein, 106 aa, Homo sapiens
MLETASKLLLSGTADGADLRTVDPETQARLEALLEAAGIGKLSTADGKAFADPEVLRRLTSSVSCALDEAAAALTRMRAESTANAGQSDNRSLAEACSEGDVNAVR

SEQ ID NO: 7643 - protein, 62 aa, Homo sapiens
  UNSURE 48: Xaa=Leu or Met or Pro or Ser or Thr
  UNSURE 53: Xaa=Ala or Thr
MVSPKDLPLVLLQDIKVPSSMTGSHAGNPHIERNDLPRHGSPQFFTGXTCASXNPSQCLAAF

SEQ ID NO: 7644 - protein, 53 aa, Homo sapiens [sequence omitted]

SEQ ID NO: 7645 - protein, 70 aa, Homo sapiens
  UNSURE 17: Xaa= *  or Gly or Arg
  UNSURE 27: Xaa=Asp or Glu
MRYHLTPVRMAIIKKSXNNRCWRGCGXIGTLLHCWWDCKLVQPLWKSVWRFLRDLELEIPFDPAIPLLGI

SEQ ID NO: 7646 - protein, 55 aa, Homo sapiens
MDGFQRHFDSQVIIYGKQVIINLINQKGSEKPLEQTFATMVSSLGSGMMRYIAFD

SEQ ID NO: 7647 - protein, 54 aa, Homo sapiens
MMAALPEDTVVFEKPVKTIHWNGSFQEAAFPGETFPVSVECEDGDRFPAHHVIV

SEQ ID NO: 7648 - protein, 89 aa, Homo sapiens
  UNSURE 6: Xaa=Asp or Gly
  UNSURE 67: Xaa=Ala or Gly
MHPCDXTYCGPFPESEPEVKAVANFLRKHRKHIRAYLSFHAYAQMLLYPYSYKYATIPNFRCVESAXYKAVDALQSVYGVRYRYGPAST

SEQ ID NO: 7649 - protein, 80 aa, Homo sapiens
  UNSURE 22: Xaa=Asn or Thr
  UNSURE 25: Xaa= *  or Lys
MRQHRQFMDRTHYLLTFSSSEXLAXGYCYGHGSQPEQRSRTSLFQTIIVPLIPSIVDRAPKGRTFGDVLQPAKPEYRVGE

SEQ ID NO: 7650 - protein, 52 aa, Homo sapiens
  UNSURE 19: Xaa=Gly or Arg
  UNSURE 21: Xaa=Asn or Thr
  UNSURE 22: Xaa=Phe or Leu
  UNSURE 24: Xaa=Asp or Gly
MVPTMRVVVMIKQDKACKXLXXRXLQKVRKTWFQLGVMARVCGLTLWEAGAG

SEQ ID NO: 7651 - protein, 79 aa, Homo sapiens
  UNSURE 17: Xaa=Gly or Arg
  UNSURE 19: Xaa= *  or Tyr
MPRRGLVAGPDLEYFQXRXFTPAEVAQHNRPEDLWVSYLGRVYDLTSLAQEYKGNLLLKPIVEVAGQDISHWFDPKTRV

SEQ ID NO: 7652 - protein, 74 aa, Homo sapiens
MADKTPGGSQKASSKTRSSDVHSSGSSDAHMDASGPSDSDMPSRTRPKSPRKHNYRNESARESLCDSPHQNLSR

SEQ ID NO: 7653 - protein, 103 aa, Homo sapiens
MNPDLRRERDSASFNPELLTHILDGSPEKTRRRREIENMILNDPDFQHEDLNFLTRSQRYEVAVRKSAIMVKKMREFGIADPYEIMWFKNFVHRGRPEPLDLH

SEQ ID NO: 7654 - protein, 85 aa, Homo sapiens
  UNSURE 82: Xaa= *  or Tyr
  UNSURE 84: Xaa=Ala or Pro or Ser or Thr
  UNSURE 85: Xaa=Lys or Asn
MSHFLALDFILLLFYLKTRIRIPHLAVRPLYYQLSFLASFSFPTPRSPSTSVSLEWNEQELWLSIGNLYKLVPHASPCPCSXPXX

SEQ ID NO: 7655 - protein, 66 aa, Homo sapiens
  UNSURE 54: Xaa=His or Pro
MVVDKDFPEDRRPRKVSPVKVTALGGGKLEATFTFMREDRCIQKKILMRKTEEXGKYSAYGGRKLM

SEQ ID NO: 7656 - protein, 73 aa, Homo sapiens
  UNSURE 57: Xaa=Glu or Gly
MLRPTVCERELCVFAFQTLGVMNEAADEIATGAQVVDLLVSMCRSALESPRKVVIFXPYPSVVDPNDPQMLAF

SEQ ID NO: 7657 - protein, 97 aa, Homo sapiens
  UNSURE 9: Xaa= *  or Arg
  UNSURE 30: Xaa=His or Tyr
  UNSURE 37: Xaa=Arg or Ser
  UNSURE 38: Xaa= *  or Lys or Leu or Met or Pro or Gln or Arg or Ser or Thr or Trp
  UNSURE 42: Xaa=Lys or Thr
  UNSURE 43: Xaa=Ala or Pro
  UNSURE 44: Xaa=Ala or Gly
  UNSURE 57: Xaa=Phe or Leu
  UNSURE 73: Xaa=Ala or Pro
MNFCKKPRXCHALLLPPWAGLEVGMRPSQXTAGAKAXXLASXXXWMGVGTSESHQDXGSGTVAGWAQNCPHCXPTHRWSPQIELGGLFLQPLGSSHS

SEQ ID NO: 7658 - protein, 74 aa, Homo sapiens
  UNSURE 39: Xaa=Ile or Leu
MCLTVLLHKCWSKVGVFPDSRYPMTTVDYERAVQVRAKXETHTCKPQKKKDSQKSSILSWRLFSPFHWSHEKAL

SEQ ID NO: 7659 - protein, 81 aa, Homo sapiens
  UNSURE 4: Xaa=Pro or Thr
  UNSURE 7: Xaa=Ser or Trp
  UNSURE 11: Xaa=Asp or Glu
  UNSURE 12: Xaa=Leu or Val
  UNSURE 67: Xaa=Gly or Arg
MAGXGGXRDRXXTDLGHLPDPTGIFSLDKTIGLGTYGRIYLGLHEKTGAFTAVKVMNARKTPLPEIXRRVRVNKYQKSVGC

SEQ ID NO: 7660 - protein, 80 aa, Homo sapiens
  UNSURE 2: Xaa=Phe or Tyr
  UNSURE 7: Xaa=Arg or Ser
MXLFIRXKRSSASVDNTPAGSPQGSGGEDEDDPDEGDDDSLSEGSTSEQQDELQEESEMSEKKSCSSSPTQSEISTSLPQ

SEQ ID NO: 7661 - protein, 59 aa, Homo sapiens
MIKKFDKKDEESGSGSNPFQHLEKSAVLQEARIFNETPINPRRCLHILTKILYLLNQGN

SEQ ID NO: 7662 - protein, 51 aa, Homo sapiens
  UNSURE 15: Xaa=His or Gln or Arg
  UNSURE 21: Xaa= *  or Gly
  UNSURE 26: Xaa=Ile or Asn or Ser
  UNSURE 27: Xaa=Asp or His or Tyr
MKIQEELQRSGGLDXLVLSPXEWPVXXNTIMHIATAEALTTDYWCLDDLYR

SEQ ID NO: 7663 - protein, 74 aa, Homo sapiens
  UNSURE 39: Xaa=Ala or Pro or Ser or Thr
  UNSURE 54: Xaa=Ala or Ser
MASDCRVFLGKKDHLSMSTRAIRPTEEGGLHVHMEFPGXDGCNQVDAEYLKVGXEGHFRVPALGYLDVRIVDTD

SEQ ID NO: 7664 - protein, 141 aa, Homo sapiens
  UNSURE 119: Xaa=Ala or Glu
  UNSURE 131: Xaa=Ala or Pro or Ser
MDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVXKNERLTIPSSCXRSFAELLHQC

SEQ ID NO: 7665 - protein, 83 aa, Homo sapiens
  UNSURE 60: Xaa=Asp or Glu
  UNSURE 65: Xaa= *  or Tyr
  UNSURE 66: Xaa=Leu or Met or Val
  UNSURE 68: Xaa=Ser or Tyr
  UNSURE 71: Xaa=Asp or Asn or Tyr
MDINTAGIDMPMFSALLHYLYTGEFGMEDSRFQNVDILVQLSEEFGTPNSLDVDMRGLFXYMCYXXSXLVXLQTLNWLKLLVE

SEQ ID NO: 7666 - protein, 60 aa, Homo sapiens
  UNSURE 50: Xaa=Cys or Phe or Tyr
  UNSURE 53: Xaa=His or Leu or Pro or Gln or Arg
  UNSURE 54: Xaa=Ala or Ser
MVRTDGHTLSEKRNYQVTNSMFGASRKKFVEGVDSDYHDENMYYSQSSMXPHXXEKDMLA

SEQ ID NO: 7667 - protein, 65 aa, Homo sapiens [sequence omitted]

SEQ ID NO: 7668 - protein, 71 aa, Homo sapiens
MKNKAKTRVLGHSSAQRVPGDGRPLSPHPLTLENWVFSQYSSNSFLKAVEPLYSKVHCRCSNSPFLFPLPP

SEQ ID NO: 7669 - protein, 61 aa, Homo sapiens
MDCASISVKFTSMATMHDLSQFWASRGEVTNWWPVGQTSLPLFYLAFMVFGSFFPLISCQP

SEQ ID NO: 7670 - protein, 102 aa, Homo sapiens
MKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAF

SEQ ID NO: 7671 - protein, 110 aa, Homo sapiens
  UNSURE 5: Xaa=Asp or Asn
  UNSURE 76: Xaa=Glu or Lys or Met or Val
MRQTXRDVITALTHRPWSLSHTGDGKPRYDTFWKHFIFVMMDILLDWSMHNILWYLCGISAFPMQKDFVSPAYLKXWSAKGIQVVGWTVNTFDERVTTNPILVPAISLTA

SEQ ID NO: 7672 - protein, 83 aa, Homo sapiens
MKRRLDDQESPVYAAQQRRIPGSTEAFPHQHRVLAPAPPVYEAVSETMQSATGIQYSVTPSYQVSAMPQSSGSHGPAIAAVHS

SEQ ID NO: 7673 - protein, 76 aa, Homo sapiens
  UNSURE 54: Xaa=Lys or Asn
MEAYTKLTDNIFLEILYSTDPKLKDAREILKQIEYRNLFKYVGETQPTGQIKIXREDYESLPKEVASAKPKVLLDV

SEQ ID NO: 7674 - protein, 79 aa, Homo sapiens
  UNSURE 15: Xaa= *  or Trp
  UNSURE 16: Xaa=Lys or Arg
MMIIPKKASTLFIRXXHEYAFSFELPQTPLATSFEGRHGSVRYWVKAELHRPWLLPVKLKKEFTVFEHIDINTPSLLSP

SEQ ID NO: 7675 - protein, 113 aa, Homo sapiens
MGLGAVPGRQAAFREGLEQAVRYAKALGCPRIHLMAGRVPQGADRIAVKAEMEAVFLENLRHAAGVLAQEDLVGLLEPINTRITDPQYFLDTPSRRQHLTEGRKTQPPITNGQ

SEQ ID NO: 7676 - protein, 101 aa, Homo sapiens
MVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLR

SEQ ID NO: 7677 - protein, 106 aa, Homo sapiens
MSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEIS

SEQ ID NO: 7678 - protein, 63 aa, Homo sapiens
MTLTAKVCSFTPEASETTSPLGGRNKSRGATLRAVALTARVRGFILEVSETKNPPIPDTTAPS

SEQ ID NO: 7679 - protein, 57 aa, Homo sapiens
MVGRHLFPPPPSSFSLCDFSPKFLGLLKISYPSLPLYCLFATSSKKINFHFRPLTPE

SEQ ID NO: 7680 - protein, 78 aa, Homo sapiens
MEHYRKAGSVELPAPSPMPQLPPDTLEMRVRDGSKIRNLLGLALGRLEGGSARHVVFSGSGRAAGKAVSCAEIVKRRV

SEQ ID NO: 7681 - protein, 52 aa, Homo sapiens
MARSRWSLSLRSCWVHLQKGCHFTLGRLHSGQAEALLTSQPRRPGRGAPHFP

SEQ ID NO: 7682 - protein, 74 aa, Homo sapiens
MHHGLTPLLLGVHEQKQQVVKFLIKKKANLNALDRYGRTALILAVCCGSASIVSLLLEQNIDVSSQDLSGQTAP

SEQ ID NO: 7683 - protein, 101 aa, Homo sapiens
  UNSURE 96: Xaa=Ala or Cys or Phe or Gly or Ser or Val
MAARRITQETFDAVLQEKAKRYHMDASGEAVSETLQFKAQDLLRAVPRSRAEMYDDVHSDGRYSLSGSVAHSRDAGREGLRSDVFPGPSFRSSNPXISDDS

SEQ ID NO: 7684 - protein, 106 aa, Homo sapiens
MEKLPSGMEISFAPATSHEAPAMMDSHISSSDAATEMLSQPNHPSGEVKAENNIEMVGESQAAKVIVSVEDAVPTIFCGKIKGLSGCPPKTSPSKEKTPCFRAMTS

SEQ ID NO: 7685 - protein, 101 aa, Homo sapiens
  UNSURE 92: Xaa=His or Asn or Pro or Thr
MDFVLLNFAEMNKLWVRMQHQGHSRDREKRERERQELRILVGTNLVRLSQLEGVNVERYKQIVLTGILEQVVNCRDALAQEYLMECIIQVFXDEFHLQTLN

SEQ ID NO: 7686 - protein, 54 aa, Homo sapiens [sequence omitted]

SEQ ID NO: 7687 - protein, 83 aa, Homo sapiens
MKVTLSALDTSESSFTPLVVIELAQDVKEETKEWLKNRIIAKKKDGGAQLLFRPLLNKYEQETLENQNLYLVGASKIRMLLGA

SEQ ID NO: 7688 - protein, 85 aa, Homo sapiens
MVKKLVMAQKRGETRALCLGVTMVVCAVITYYILVTTVLPLYQKSVWTQESKCHLIETNIRDQEELKGKKVPQYPCLWVNVSAAG

SEQ ID NO: 7689 - protein, 119 aa, Homo sapiens
MNERAIAGALIADFLSGLVHWGADTWGSVELPIVGKAFIRPFREHHIDPTAITRHDFIETNGDNCLVTLLPLLNMAYKFRTHSPEALEQLYPWECFVFCLIIFGTFTNQIHKWSHTYFG

SEQ ID NO: 7690 - protein, 100 aa, Homo sapiens
  UNSURE 26: Xaa= *  or Cys or Trp
  UNSURE 49: Xaa= *  or Glu or Lys or Gln
MQTFTMVLEEIWTSLFMWFFYALIPXLLTDEVAILPAPQNLSVLSTNMXHLLMWSPVIAPGETVYYSVEYQGEYESLYTSHIWIPSSWCSLTEGPECDVT

SEQ ID NO: 7691 - protein, 59 aa, Homo sapiens
MASMHISSLCYRKSPVCSKVLKPITSSLGISPYIQTYLISHSWLITKYCHICLLSVLPA

SEQ ID NO: 7692 - protein, 75 aa, Homo sapiens
  UNSURE 4: Xaa=Ser or Thr
  UNSURE 5: Xaa=Lys or Thr
  UNSURE 10: Xaa=Lys or Pro or Gln or Thr
  UNSURE 16: Xaa=Ala or Glu or Val
  UNSURE 22: Xaa= *  or Cys or Trp
  UNSURE 23: Xaa=Arg or Trp
  UNSURE 27: Xaa=Lys or Gln
  UNSURE 47: Xaa=Lys or Arg or Thr
  UNSURE 49: Xaa=Ala or Asp
  UNSURE 63: Xaa=Asn or Thr
MKRXXELITXNHSQEXTSILRXXKCRXCIASSGCFMEYLENQVIKDXDXSVDAQNICHVWHMXVEALPEWISCLI

SEQ ID NO: 7693 - protein, 63 aa, Homo sapiens [sequence omitted]

SEQ ID NO: 7694 - protein, 53 aa, Homo sapiens
  UNSURE 23: Xaa=Cys or Ser or Trp
  UNSURE 31: Xaa= *  or Gly or Leu or Val
MRRNSSLSFQMERPLEEQVQSKXSSSQGRTXTGGSDVLQMQNSEHHGQSIKTH

SEQ ID NO: 7695 - protein, 62 aa, Homo sapiens
  UNSURE 23: Xaa=Asp or Glu
MMPRVAPVALPAVCSVGLGREEXSWLARGATADSPGRVDGPAGVPLAPLACCDWGHSLALRQ

SEQ ID NO: 7696 - protein, 71 aa, Homo sapiens
  UNSURE 3: Xaa=Ile or Met
  UNSURE 65: Xaa=Leu or Pro or Arg
  UNSURE 66: Xaa=Glu or Lys or Gln
  UNSURE 68: Xaa=Ile or Val
MLXRLKDKIPNVRIQAVLALSRLQDPKDDECPVVNAYATLIENDSNPEVRRAVLSCIAPSAKTLXXIXGRT

SEQ ID NO: 7697 - protein, 85 aa, Homo sapiens
  UNSURE 67: Xaa=Asp or His or Asn or Tyr
  UNSURE 79: Xaa=Ala or Pro or Ser or Thr
MGENEASLPNTSLQGKKMAYQKVHADQRAPGHSQYLDNDDLQATALDLEWDMEKELEESGFDQFQLXSAENQNLGHSEXIDLNLD

SEQ ID NO: 7698 - protein, 126 aa, Homo sapiens
  UNSURE 12: Xaa=Phe or Ser
  UNSURE 15: Xaa=Glu or Gly or Lys or Arg
MGVGGMMGQGSXRRXRERNRRLQKPTWRWVTVRGSLHYHEELGKEVTHSRQISSNSSWRQLPTLQLWFSTTERRKGREMECAGLRRLSFWSICRSLHHGPVAPLFLHELLVGSPSRIAPPSRKRMW

SEQ ID NO: 7699 - protein, 65 aa, Homo sapiens
MEEELRYAPLSFRNPMMSKLRNYRKDLAKLHREVRSTPLTATPGGRGDMKYGIYAVENEHMNRLL

SEQ ID NO: 7700 - protein, 99 aa, Homo sapiens
MNGRVDYLVTEEEINLTRGPSGLGFNIVGGTDQQYVSNDSGIYVSRIKENGAAALDGRLQEGDKILSVNGQDLKNLLHQDAVDLFRNAGYAVSLRVQHR

SEQ ID NO: 7701 - protein, 79 aa, Homo sapiens
  UNSURE 13: Xaa=Ala or Val
  UNSURE 14: Xaa=Ile or Met
  UNSURE 19: Xaa=Ile or Met
  UNSURE 73: Xaa=Arg or Thr
MDSAQREALDDIXXQVMEXINANAKTRGRIIDFKEIQYGYRRVNPMYGAEYILDLLLLYKKHKGKKMTVPVRXHAYLQP

SEQ ID NO: 7702 - protein, 62 aa, Homo sapiens
  UNSURE 23: Xaa=Arg or Ser
  UNSURE 48: Xaa=Phe or Tyr
  UNSURE 51: Xaa=Asp or Gly
MKTFKDEELFPLQVVMKKLDLIXELRERVQTQCDCCFLYWHRAVFPIXLDXVYEMLLMQQIH

SEQ ID NO: 7703 - protein, 93 aa, Homo sapiens
  UNSURE 35: Xaa=Asp or Glu
MTYEAQFFGFTPQTCMLRIYIAFQDYLFEVMQAVXQVILKKLDGIPDCDISPVQIRKCTEKFLCFMKGHFDNLFSKMEQLFLQLILRIPSNIL

SEQ ID NO: 7704 - protein, 117 aa, Homo sapiens
MMDASKELQVLHIDFLNQDNAVSHHTWEFQTSSPVFRRGQVFHLRLVLNQPLQSYHQLKLEFSTGPNPSIAKHTLVVLDPRTPSDHYNWQATLQNESGKEVTVAVTSSPNAILGKYQ

SEQ ID NO: 7705 - protein, 88 aa, Homo sapiens
MVVDIQRRHLRVGLKGQPAIIDGELYNEVKVEESSWLIEDGKVVTVHLEKINKMEWWSRLVSSDLRSTPRRLTLKNSKLSDLDSETRS

SEQ ID NO: 7706 - protein, 128 aa, Homo sapiens
  UNSURE 76: Xaa=Ala or Val
MKLSEIPLTLHSVSELVRLCLRRSDVQEESEGSDTDDNKDSAAFEDNEVQDEFLEKLETSEFFELTSEEKLQILTXLCHRILMTYSVQDHMETRQQMSAELWKERLAVLKEENDKKRAEKQKRKEMEA

SEQ ID NO: 7707 - protein, 65 aa, Homo sapiens
  UNSURE 56: Xaa=Asp or Glu
  UNSURE 57: Xaa=Ala or Pro or Ser or Thr
MDVNIFLSREYDQEFYSIFPKTFFRDKSFLPNIHLVWNISALTVNHSDIIQGVSRXXPWIVCFLI

SEQ ID NO: 7708 - protein, 64 aa, Homo sapiens
  UNSURE 30: Xaa=Gly or Arg
  UNSURE 31: Xaa=Leu or Val
MAPSRLTATSTSWFKRFSGLSFPSSWDYRXXPPHLANFVFLVEMGFLHVGQAGLKLPTSSDLPA

SEQ ID NO: 7709 - protein, 78 aa, Homo sapiens
MLKDLFKENYKPLLSEIKEDTNKWKNIPCSWIGRINIMKMPILPKVIYRFNAIPIKLPMTFFTELEKTKVHMEPKKSP

SEQ ID NO: 7710 - protein, 52 aa, Homo sapiens
  UNSURE 21: Xaa=Ile or Leu
  UNSURE 23: Xaa=Ala or Ser
  UNSURE 24: Xaa=Lys or Thr
  UNSURE 25: Xaa=Pro or Thr
  UNSURE 26: Xaa=Asp or His
  UNSURE 28: Xaa=Phe or Leu or Val
  UNSURE 40: Xaa=Cys or Phe or Tyr
MQSDGLGCHFRQSIYTTPHPXLXXXXPXFPSFLLYQVKTXSEACLMVRKPAH

SEQ ID NO: 7711 - protein, 84 aa, Homo sapiens
  UNSURE 65: Xaa=Asp or His or Tyr
  UNSURE 66: Xaa=Ala or Asp
MSVLEPDSRGPPPISLTHTGIHTPQKTSQMRPDSGSRGMCFCPCKGFGEGGNIVEAGKSPQTCAXXPPALRFHSAFSECPCCTQ

SEQ ID NO: 7712 - protein, 113 aa, Homo sapiens
  UNSURE 4: Xaa=Ile or Leu
  UNSURE 8: Xaa=Met or Arg
  UNSURE 72: Xaa= *  or Ala or Asp or Glu or Phe or Ile or Lys or Leu or Met or Asn or Ser or Thr or Val or Tyr
MNLXPHVXNLLREQSRTRPISPKEIERMVGIIHRKFSSIQMQLKQSTCEAVMILRSRFLDARRKRRNFSKQXTEILNEYFYSHLSNPYPSEEAKEELAKKCSITVSQVSNWFG

SEQ ID NO: 7713 - protein, 85 aa, Homo sapiens
  UNSURE 47: Xaa= *  or Glu or Gly or Leu or Val
MWVFGYGSLIWKVDFPYQDKLVGYITNYSRRFWQGSTNHRGVPGKPXRVVTLVEDPAGCVWGVAYRLPVGKEEEVKAYLDFREKG

SEQ ID NO: 7714 - protein, 62 aa, Homo sapiens
  UNSURE 55: Xaa= *  or Cys or Phe or His or Ile or Lys or Leu or Met or Asn or Pro or Gln or Arg or Ser or Thr or Trp or Tyr
MEMMEGGELFHRISQHRHFTEKQASQVTKQIALALRHCHLLNIAHRDLKPENLLXKDNSLDA

SEQ ID NO: 7715 - protein, 69 aa, Homo sapiens
  UNSURE 13: Xaa=Ala or Pro
  UNSURE 35: Xaa=Leu or Pro or Gln
MSWFNASQLSSFXKQALSQAQKSIDRVLDIQEEEXSIWAETIPYGEPGISSPVSGGWDTSTWGLKSNTE

SEQ ID NO: 7716 - protein, 62 aa, Homo sapiens
  UNSURE 39: Xaa=Gly or Val
MFNGQFLFDRPMHVKMDDKSVPHKEYRSHDGKTPQLPRXLGGIGMGLGPGGQPISASQLNIG

SEQ ID NO: 7717 - protein, 62 aa, Homo sapiens
  UNSURE 45: Xaa= *  or Lys or Ser or Thr
MFKYLISHFGGFLFFYFLDGVSRYRPGWSAVARTRLTATSASWGXSNSPSSASQVAGITGMH

SEQ ID NO: 7718 - protein, 111 aa, Homo sapiens
  UNSURE 81: Xaa=Ile or Lys or Leu or Pro or Gln or Arg or Thr
  UNSURE 98: Xaa=Ile or Val
MFCSGFQTCAREVLQYLAKHENTRDLKSSQLVTHLHRVVSELLQGGTSRKPSDPAPKVMDFKEKPSSPAKGSEGPGKNCVXVIQRTFAHSSGEQSGSXTDTDSGYGGDRRR

SEQ ID NO: 7719 - protein, 54 aa, Homo sapiens
  UNSURE 9: Xaa=Asp or Glu
MTNSTGVSXLLSHACLGVTTPWPSPMAPVPHSAQAPMPSQQLAFSSGQMSLLAL

SEQ ID NO: 7720 - protein, 107 aa, Homo sapiens
  UNSURE 75: Xaa= *  or Glu or Lys or Gln
  UNSURE 76: Xaa=His or Gln or Arg
  UNSURE 92: Xaa=Leu or Ser or Trp
  UNSURE 98: Xaa=Ile or Val
MLSYKLPHLILVACFSFLYPKRTSMHFFFCSPGNSNFLNMNEGASRGGSCLWSQHFGRLRRADHLRSGVRDRHGXXGETLSLLENAKIIWVXWHSPVXPATREAEAG

SEQ ID NO: 7721 - protein, 91 aa, Homo sapiens
  UNSURE 21: Xaa=Ala or Phe or Leu or Pro or Ser or Val
  UNSURE 69: Xaa=Asp or Glu
MRRQLRSRRAPSFPYSYRYRXDDPDEANQNYLADEEEEAEEEARVTVVPKSEEEEEEEEKEEEEEEEKXEEEGQGQPTGNAWWQKLQIMSE

SEQ ID NO: 7722 - protein, 94 aa, Homo sapiens
  UNSURE 4: Xaa=His or Asn or Pro or Thr
  UNSURE 88: Xaa=Asp or Gly
MTKXFRSFRSECEAEVGWNLTYSRAGVSVWVQAVEMDRTLHKIKCRMECCDVPAETLYDVLHDIEYRKKWDSNVIETFDIARLTVNAXVGYYSW

SEQ ID NO: 7723 - protein, 70 aa, Homo sapiens
  UNSURE 7: Xaa= *  or Leu
  UNSURE 8: Xaa=Ile or Met
  UNSURE 10: Xaa=Pro or Arg
  UNSURE 13: Xaa=Gly or Arg
  UNSURE 19: Xaa=Asp or Glu
  UNSURE 48: Xaa=Arg or Thr
  UNSURE 56: Xaa=Glu or Ile or Lys or Leu or Gln or Val
  UNSURE 66: Xaa=Asp or Glu
MFNRRLXXNXKRXLHELKXKYEYSIQNAAWKDIDLENLEKGLRDIKAXIGKSNMSXIRVPEGEEMXWSRG

SEQ ID NO: 7724 - protein, 91 aa, Homo sapiens
  UNSURE 20: Xaa=Asp or Val
  UNSURE 22: Xaa=Phe or Leu
  UNSURE 23: Xaa=Arg or Ser
  UNSURE 25: Xaa=Asp or Glu
  UNSURE 28: Xaa=Phe or Ser or Tyr
MTQRSIAGPICNLKFVTLLXGXXSXLPXLGAGVQLQDNGYNGLLIAINPQVPENQNLISNIKEMITEASFYLFNATKRRVFFRNIKILIPA

SEQ ID NO: 7725 - protein, 87 aa, Homo sapiens
MGTVHARSLEPLPSSGPDFGGLGEEAEFVEVEPEAKQEILENKDVVVQHVHFDGLGRTKDDIIICEIGDVFKAKNLIEVMRKSHEAR

SEQ ID NO: 7726 - protein, 54 aa, Homo sapiens
  UNSURE 33: Xaa=Ala or Thr
MGQALRRHWQWEDDQYRRLNLAFKAFIKHWKMXKHGPIQRVGFRTPTIIIKEPR

SEQ ID NO: 7727 - protein, 74 aa, Homo sapiens
MKMAILPKGIYRFNAIPIKLPSTFFTELEKTNLKFIWNQKTVHIAKTILSKKKKAGGITLSNFKLYYKSTVKKK

SEQ ID NO: 7728 - protein, 55 aa, Homo sapiens
MDRRVITPYQDGPDISYLEVEDGDIFLKEEINMEQNHSETMFKKAKTKAKKKPRK

SEQ ID NO: 7729 - protein, 99 aa, Homo sapiens
  UNSURE 66: Xaa=Leu or Met or Val
  UNSURE 86: Xaa=Ala or Asp or Gly or Val
  UNSURE 99: Xaa=Ala or Glu
MSRLLEPPTMEVLGMTDSEEDLDPMEDFDSLECMEGSDALALRLACIGDEMDVSLRAPRLAQLSEXAMHSLGLAFIYDQTEDIRDXLRSFMDGFTTLKX

SEQ ID NO: 7730 - protein, 94 aa, Homo sapiens
  UNSURE 87: Xaa=His or Asn
MKRPSSVKSLRSERLIRTSLDLELDLQATRTWHSQLTQEISVLKELKEQLEQAKSHGEKELPQWLREDERFRLLLRMLEKRMDRAEXKGELQTD

SEQ ID NO: 7731 - protein, 95 aa, Homo sapiens
  UNSURE 11: Xaa=Glu or Gly or Gln or Arg
  UNSURE 19: Xaa=Asp or Asn
  UNSURE 56: Xaa=Pro or Arg
MVTIAGVPSPXASRVGFQXIAPKPLPSQQVSSTVVQQPIQQPQQPTQQSVVIVSQXAQQGQTYAPAIHQIVLANPAALPAGQTVQLTGQANITPS

SEQ ID NO: 7732 - protein, 52 aa, Homo sapiens
  UNSURE 17: Xaa=Glu or Gly
  UNSURE 27: Xaa=Ala or Asp
  UNSURE 30: Xaa=Ala or Ser
  UNSURE 34: Xaa=Ala or Pro
  UNSURE 39: Xaa=Ala or Thr
  UNSURE 43: Xaa=Glu or Lys
  UNSURE 44: Xaa=Cys or Trp
  UNSURE 45: Xaa=Ala or Val
  UNSURE 46: Xaa=Cys or Trp
  UNSURE 47: Xaa=Gly or Val
  UNSURE 49: Xaa=Lys or Thr
MKVKEKKKTANLENFLXKNYLKLSDPXQQXPPQXPFQVXPGLXXXXXFXPVP

SEQ ID NO: 7733 - protein, 76 aa, Homo sapiens
  UNSURE 42: Xaa=Gly or Arg or Trp
MIKTALIDKATKPQPGREIINTICRFLIAKQGGPNSGNPLNXFYQCFVPEIRKYLARVGLPFNVFLILDNAPGHPA

SEQ ID NO: 7734 - protein, 80 aa, Homo sapiens
MQVDLILWTIHFQLGSSLTFNLKHQKTRLTAASAYRGLFFSCNKKNRSGQRPSSQGLSFFLSHQPYHVGLSSLCLLPHDG

SEQ ID NO: 7735 - protein, 71 aa, Homo sapiens
MKTGLSQCFNLTRAVSWSTPRSLLVPYDSPHQMTLAKSRFLCGQGWLADWWKVGWTKGGHVSSQHQFCTSS

SEQ ID NO: 7736 - protein, 59 aa, Homo sapiens
  UNSURE 10: Xaa=Ala or Cys or Asp or Phe or Gly or His or Ile or Leu or Asn or Pro or Arg or Ser or Thr or Val or Tyr
  UNSURE 47: Xaa=Ser or Thr
MAPELEGGSXGVFGVAFLARVALVFYGVFQDRTLHVRYTDIDYQVFXDAARFVTEGRSP

SEQ ID NO: 7737 - protein, 130 aa, Homo sapiens
MPPTQAESVIRSIIREIGQECAAHGEIVSETLIAFMVKAVVLDPSNGFNMDRTLMKSDVQNLVKLCMTRLLDTKNPSLDTIKMQVYFDMNYTNRVEFLEEHHRVLESRLGSVTREITDNRACAKEELESL

SEQ ID NO: 7738 - protein, 95 aa, Homo sapiens
  UNSURE 41: Xaa=Gly or Arg
  UNSURE 50: Xaa=Asp or His
  UNSURE 84: Xaa=Ala or Glu
MAVVIRLLGLPFIAGPVDIRHFFTGLTIPDGGVHIIGGEIXEAFIIFATXEDARRAISRSGGFIKDSSVELFLSSKAEMQKTIXMKRTDRVGRGR

SEQ ID NO: 7739 - protein, 82 aa, Homo sapiens
MAQKKYLQAKLTQFLREDRIQLWKPPYTDENKKVGLALKDLAKQYSDRLECCENEVEKVIEEIRCKAIERGTGNDNYRTTGK

SEQ ID NO: 7740 - protein, 62 aa, Homo sapiens
MHTCSLPCLLFAQLLEFCSFPPDVPHNCAPIVSVRPPNIVAAFEGCSVATALFPPLCISTGN

SEQ ID NO: 7741 - protein, 55 aa, Homo sapiens
MAGTRGLMLLGPGPVAGPRDVGTCRGRQMEIQKHKDNKKLPQGIIIVFRLQTHTS

SEQ ID NO: 7742 - protein, 123 aa, Homo sapiens
  UNSURE 26: Xaa=Gly or Trp
  UNSURE 101: Xaa= *  or Arg
  UNSURE 115: Xaa=Ile or Leu or Val
MAPARCFSARLRTVFQGVGHWALSTXAGLKPSRLLPQRASPRLLSVSRADLAKHQELPGKKLLSEKKLKRYFVDYRRVLVCGGNGGAGASCFHSEPRKEFXGPDGGDGGNGGHVXLRVDQQVK

SEQ ID NO: 7743 - protein, 114 aa, Homo sapiens
MYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEK

SEQ ID NO: 7744 - protein, 133 aa, Homo sapiens
  UNSURE 34: Xaa=Asn or Ser
  UNSURE 36: Xaa=Glu or Lys
  UNSURE 70: Xaa=Met or Val
MDAETKKRAEEKALAIKERIGYPDDIVSNDNKLXNXYLELNYKEDEYFENIIQNLKFSQSKQLKKLREKXDKDEWISGAAVVNAFYSSGRNQIVFPAGILQPPFFSAQQSNSLNYGGIGMVIGHEITHGFDDN

SEQ ID NO: 7745 - protein, 60 aa, Homo sapiens
MVLLAAAVCTKAGKAIVSRQFVEMTRTRIEGLLAAFPKLMNTGKQHTFVETESVRYVYQR

SEQ ID NO: 7746 - protein, 128 aa, Homo sapiens
  UNSURE 23: Xaa=Asn or Thr
  UNSURE 27: Xaa=Lys or Asn
MHCWQGWNMKKEKNFIYLRQKTXTTLXQSGCVEDKTISDQESFREVITAMDVMQFSKEEVWEVSRLLAGILHLGNIEFITAGGAQVSFKTALGRSAELLGLDPTQLTDALTQRSMFLRGEEILTPLNV

SEQ ID NO: 7747 - protein, 62 aa, Homo sapiens
  UNSURE 51: Xaa=Glu or Gln
MVQKSVSKTLPSTWSDPSVNISLDNLLPGMQPSKPQQPSLNTMIQQQNMQXPMNVMTQSFGA

SEQ ID NO: 7748 - protein, 129 aa, Homo sapiens
  UNSURE 103: Xaa=Asp or Gly or His or Arg
  UNSURE 118: Xaa=Ala or Glu or Gly
MAVARVDAALPPGEGSVVNWSGQGLQKLGPNLPCEADIHTLILDKNQIIKLENLEKCKRLIQLSVANNRLVRMMGVAKLTLLRVLNLPHNSIGCVEGLKELVXLEWLNLAGNNLKAMXQINSCTALQHL

SEQ ID NO: 7749 - protein, 99 aa, Homo sapiens
  UNSURE 5: Xaa=Asp or Glu or His or Gln
  UNSURE 11: Xaa=Ala or Pro or Thr
  UNSURE 21: Xaa=Leu or Ser
  UNSURE 23: Xaa=Asn or Thr
  UNSURE 31: Xaa=Lys or Thr
  UNSURE 60: Xaa=Pro or Arg
  UNSURE 84: Xaa=Ser or Thr
MVVSXVDIAKXDPAAASHPLXLXGDATVAQXNPGSVADNNLCSQYEEKVRPCIDLIDSLXALGVEQDLALPAIAVIGDQSSGKXSVLEALSGVALPRGS

SEQ ID NO: 7750 - protein, 80 aa, Homo sapiens
MFLAKALLEGADRGLGEALGGLFGGGGQRREGGGRNIGGIVGGIVNFISEAAAAQYTPEPPPTQQHFTSVEASESEEVRL

SEQ ID NO: 7751 - protein, 51 aa, Homo sapiens
MSMKIKVLKQFCSRPIKLEYARLVKLAQEDTPPETDYRLHHVVVYFIQNQP

SEQ ID NO: 7752 - protein, 76 aa, Homo sapiens
  UNSURE 71: Xaa=Phe or Ile or Val
MARRLLGADSATVFNIQEPEEETANQEYKVSSCEQRLISEIEYRLERSPVDESGDEVQYGDVPVENGMAPXFEMKP

SEQ ID NO: 7753 - protein, 122 aa, Homo sapiens
MQRADSEQPSKRPRCDDSPRTPSNTPSAEADWSPGLELHPDYKTWGPEQVCSFLRRGGFEEPVLLKNIRENEITGALLPCLDESRFENLGVSSLGERKKLLSYIQRLVQIHVDTMKVINDPI

SEQ ID NO: 7754 - protein, 91 aa, Homo sapiens
  UNSURE 16: Xaa=Asp or Gly
  UNSURE 20: Xaa=Ala or Pro
  UNSURE 24: Xaa=Ala or Gly or Arg or Thr
  UNSURE 40: Xaa=Gly or Val
  UNSURE 75: Xaa=Asp or Ile or Asn or Val
  UNSURE 91: Xaa=Ala or Pro
MSEAGILYSRLSHMAXAGRXPTPXAPGLWKWSPRSHRMPXHPKNTSRNAAPNRCSFVCLEASRFHPHNTLPLNSXNSYQMAAAPTAPQSPX

SEQ ID NO: 7755 - protein, 72 aa, Homo sapiens
MIISIDAEKAFNKIQQCFMLKTLNNLGIDGTNLKIIRAIYDKPTANIILNGQKLEAFPLKTGIRQGCHLSPL

SEQ ID NO: 7756 - protein, 90 aa, Homo sapiens
  UNSURE 85: Xaa=Ile or Lys or Met or Asn or Arg or Ser or Thr
MVMVANKKSQDQMTEDLSLFLGNNTIRFTVWLHGVLDKLRSVTTEPSSLKSSDTNIFDSNVPSNKSNFSRGDERRHEAAVPPLAXPSARP

SEQ ID NO: 7757 - protein, 62 aa, Homo sapiens
  UNSURE 2: Xaa=Ala or Asp
  UNSURE 38: Xaa=Asn or Ser or Thr or Tyr
MXNQVLGYKDLAAIPKDKAILDIERPDLMIYEPHFTYXLLEHVELPRSRERSLSPKSTSPPT

SEQ ID NO: 7758 - protein, 91 aa, Homo sapiens
  UNSURE 33: Xaa=His or Gln
MISDRNSRRSKGIAYVEFVDVSSVPLAIGLTGXRVLGVPIIVQASQVIFLLVKSLIIGGVESLLLHGIVLLCSVTAAHYVESDVFRTFFFF

SEQ ID NO: 7759 - protein, 76 aa, Homo sapiens
  UNSURE 49: Xaa=Asp or Glu or Gly or Val
  UNSURE 55: Xaa=Leu or Gln
MDTDIYVNPKTYNRAQDIQGIKIITYCSPLYFANSEIFRQKVIAKTGMXPQKVLXAKQKIPQEAGEAENEAHTTEE

SEQ ID NO: 7760 - protein, 111 aa, Homo sapiens
  UNSURE 111: Xaa=Lys or Arg
MGKILPEYLSNWTMGKVRREGVKVMPNAIVQSVGVSSGKLLIKLKDGRKVETDHIVAAVGLEPNVELAKTGGLEIDSDFGGFRVNAELQARSNIWVAGDAACFYDIKLGRX

SEQ ID NO: 7761 - protein, 54 aa, Homo sapiens
MSSVINTLSCCNLRFISLEQLILMASKMWDVLYSTNGRLSISSTFSVPLSSRAT

SEQ ID NO: 7762 - protein, 83 aa, Homo sapiens
  UNSURE 28: Xaa=Pro or Thr
  UNSURE 77: Xaa=Ala or Pro or Ser or Thr
MMNTLYKLHDRLAQLAGDHECGSSSQRXLSVQEAAAYLKDLGPEYEGIFNTSLQWILENGKDVGIRCVGFGPEEELXNITDVQ

SEQ ID NO: 7763 - protein, 53 aa, Homo sapiens
  UNSURE 28: Xaa=Cys or Gly
  UNSURE 30: Xaa= *  or Glu
  UNSURE 48: Xaa=Cys or Gly or Arg or Ser
MLSCLKQHPCCDLYLLPPLPDICTVHFXPXFRTCSNVIFSDRTFLTRXLRIVS

SEQ ID NO: 7764 - protein, 82 aa, Homo sapiens [sequence omitted]

SEQ ID NO: 7765 - protein, 66 aa, Homo sapiens
  UNSURE 18: Xaa=Met or Arg
  UNSURE 37: Xaa=Cys or Asp or Gly or Tyr
  UNSURE 52: Xaa= *  or Glu or Gly or Leu or Val or Trp
  UNSURE 58: Xaa= *  or Glu or Leu or Val
MLSPGRRRAGALPHVRGXAAGQSLEPVSVSSGVWLFXQAFPAVKETARSKLXELKEPXTEASPSSE

SEQ ID NO: 7766 - protein, 64 aa, Homo sapiens
  UNSURE 33: Xaa=Leu or Met or Val
MLRSMLTSPWQSEEEGSWLREYPVTLMQFFRYXYHNVPDLASMWMSPDFLCALAATVFPFNIRP

SEQ ID NO: 7767 - protein, 97 aa, Homo sapiens
  UNSURE 60: Xaa=His or Gln
  UNSURE 72: Xaa=Asp or Glu
  UNSURE 75: Xaa=Pro or Gln
  UNSURE 83: Xaa=Lys or Gln
MAHKIGPPMLFFFLSLFNYLLRLSKAKGNCEIKSVKYNNIFKRKWIPLFLFATEKAPRRXRLCRISKQTMMXWRXVQPFKERXVKQPGERPGGEESE

SEQ ID NO: 7768 - protein, 67 aa, Homo sapiens
MADGAREVGNMTGTTEINSDQGLEKDNSELGSETRYPLLLPKGVVLKLKPVADRFPKKAWRQKRSSV

SEQ ID NO: 7769 - protein, 56 aa, Homo sapiens
  UNSURE 15: Xaa=Leu or Met
MGFPADKDWEDIRKXPEYPTLQKDFRRTTYANSSLIKYMEKHKVKPDSKVFLLLQK

SEQ ID NO: 7770 - protein, 69 aa, Homo sapiens
  UNSURE 9: Xaa=Ile or Arg
  UNSURE 20: Xaa=Lys or Asn
  UNSURE 21: Xaa=Gly or Trp
MGDTIHCKXTTAGGVSIGWXXRGVCRGAWAAPRWALPSEVCERGTRMYQVEKHWAEPQEANRRGESGRP

SEQ ID NO: 7771 - protein, 61 aa, Homo sapiens
  UNSURE 13: Xaa=Met or Val
MCHIACFFTVHVXTKKREDGASMLNMPGPQVAFSYWHSCQHSSMQASSLLIYVCSSTFQAT

SEQ ID NO: 7772 - protein, 95 aa, Homo sapiens
MAANLSRNGPALQEAYVRVVTEKSPTDWALFTYEGNSNDIRVAGTGEGGLEEMVEELNSGKVMYAFCRVKDPNSGLPKFVLINWTGEGVNDVRTG

SEQ ID NO: 7773 - protein, 69 aa, Homo sapiens
MTRENVAHNALRQEGLVKGKDDTWKWGTSFQGSSSSVWETSHLHFRQLRYHETSGPQEALSRLRELCRR

SEQ ID NO: 7774 - protein, 54 aa, Homo sapiens
  UNSURE 50: Xaa=Ile or Lys or Arg or Thr
MVERHAGLKSSVCEEFEIGAGWCATVGNGRGRVCAVITALFPLTSNLESXIKIY

SEQ ID NO: 7775 - protein, 75 aa, Homo sapiens
  UNSURE 50: Xaa= *  or Glu or Lys
  UNSURE 55: Xaa=Leu or Met or Val
MAEPASVAAESLAGSRARAARTVLGQVVLPGEELLLPEQEDAEGPGGAVXRPLSXNARACSRVRVVCGPGLRRCG

SEQ ID NO: 7776 - protein, 53 aa, Homo sapiens
  UNSURE 6: Xaa=His or Arg
  UNSURE 25: Xaa= *  or Asp or Glu or His or Lys or Asn or Gln or Tyr
  UNSURE 41: Xaa=His or Gln
MTDLSXHAWPVNYFYKVEMSFFCVXYLSCFFRYKILCVCMXVCVHTTHILSAS

SEQ ID NO: 7777 - protein, 80 aa, Homo sapiens
  UNSURE 53: Xaa=Ala or Cys or Phe or Gly or Ile or Leu or Pro or Arg or Ser or Thr or Val
  UNSURE 58: Xaa=Ala or Pro or Ser
MIKWRTLGSQQRGIKAWIMITSVFHVTLKAAGLEPSWPCSLLGTAGLMSTSIXICFCXAGRPWRPLLALELYILSYSIRI

SEQ ID NO: 7778 - protein, 82 aa, Homo sapiens
  UNSURE 9: Xaa= *  or Tyr
  UNSURE 20: Xaa=Ala or Gly
  UNSURE 22: Xaa=Glu or Gly
  UNSURE 26: Xaa=Ala or Gly or Leu or Ser or Val or Trp
  UNSURE 49: Xaa=Phe or Val
MLWCLWRMXSAAGSVMGTDXAXRLLXSTSGADTINAGKSQSFNIFMTSXSFASISIFSCSRLTFKTKHLSLTCCFNYLSILP

SEQ ID NO: 7779 - protein, 62 aa, Homo sapiens
  UNSURE 4: Xaa=Phe or Ile
  UNSURE 8: Xaa=Leu or Pro or Gln
  UNSURE 9: Xaa=Phe or Ile or Val
  UNSURE 10: Xaa=Phe or Leu
MVPXPFSXXXKGNSAFFVCECVSVCKCVCVQSPQHRTPTHAPTHMQTRTYSCMDSCSRSTHR

SEQ ID NO: 7780 - protein, 52 aa, Homo sapiens [sequence omitted]

SEQ ID NO: 7781 - protein, 68 aa, Homo sapiens
  UNSURE 13: Xaa=Pro or Thr
  UNSURE 53: Xaa=Ala or Pro
  UNSURE 61: Xaa=Asp or Glu
MVAGRRSSDRREXLPLLSCDPKQGIDTCGRLRCRILIPTGFEHFGDLQCRHPXDIVKVAIXWPGAYPK

SEQ ID NO: 7782 - protein, 60 aa, Homo sapiens
  UNSURE 16: Xaa=Cys or Phe or Leu or Trp
MVYITIFSSVVSSITXMLRNSCLSEIRYSPVFSFGICLFIYYLSFPLRVSRLSLWGKSGH

SEQ ID NO: 7783 - protein, 53 aa, Homo sapiens
  UNSURE 14: Xaa=Lys or Arg
  UNSURE 19: Xaa=Lys or Gln
MTRGCWEGRALLRXHGILXHQGNTVVPGSSGCSWGESGLSFRRPGKGASCHRL

SEQ ID NO: 7784 - protein, 83 aa, Homo sapiens
MLIVYIVMGLAGGYWTKQPLPPFFFLRRSLSLSRLECIGAISSHCNLCRPGSSDFLASASQVAGITGACHCARLIFVFLVETG

SEQ ID NO: 7785 - protein, 87 aa, Homo sapiens
  UNSURE 2: Xaa=Lys or Met or Arg or Thr
  UNSURE 55: Xaa=Ala or Asp or Gly or Val
  UNSURE 73: Xaa=Ala or Asp
  UNSURE 74: Xaa=Lys or Thr
MXMDRDLGDEYGWKQVHGDVFRPSSHPLIFSSLIGSGCQIFAVSLIVIIVAMIEXLYTERGSMLSTAIFVYAXXSPSEWLFWRKSVC

SEQ ID NO: 7786 - protein, 55 aa, Homo sapiens
  UNSURE 5: Xaa= *  or Cys or Trp
  UNSURE 6: Xaa=His or Asn
MYGLXXDYHSEANQYVRQLTSVPVFLCVFVCVVRKPVIYSQQISSTQSIVINYRP

SEQ ID NO: 7787 - protein, 78 aa, Homo sapiens
  UNSURE 5: Xaa=Phe or Val
  UNSURE 54: Xaa= *  or Leu or Ser or Trp
  UNSURE 60: Xaa=Asp or Gly
  UNSURE 66: Xaa=Asp or Val
  UNSURE 74: Xaa=Asp or His or Asn or Tyr
MASFXAIEDLQVEADFPVYFEELRKVLVKVDEYHSVHQKLSADMADHSNLIRSXLVGAEXARLMRXMKTMKSRXMELY

SEQ ID NO: 7788 - protein, 85 aa, Homo sapiens
  UNSURE 3: Xaa=Asp or Glu
  UNSURE 5: Xaa=Cys or Gly
  UNSURE 6: Xaa=Lys or Gln
  UNSURE 7: Xaa=Pro or Thr
  UNSURE 8: Xaa=Leu or Pro or Gln
  UNSURE 10: Xaa=Lys or Asn
  UNSURE 13: Xaa=Asp or Glu or Val
  UNSURE 14: Xaa=His or Asn or Tyr
  UNSURE 43: Xaa=Ala or Asp
  UNSURE 67: Xaa=Asp or Glu
  UNSURE 68: Xaa=Pro or Gln
  UNSURE 72: Xaa=Lys or Leu or Met or Gln
  UNSURE 75: Xaa=Leu or Met
MKXGXXXXAXINXXAFYNSQKFEVLYCGKVTVTHKKAPSSLIXDCMEKFSLHEQQRLKIQGEQRGPXXGEDXADXEVVVPGSPGR

SEQ ID NO: 7789 - protein, 94 aa, Homo sapiens
  UNSURE 5: Xaa=Cys or Gly
  UNSURE 13: Xaa=Ala or Pro
  UNSURE 62: Xaa=Phe or Leu
  UNSURE 66: Xaa=Ile or Lys or Met or Asn or Arg or Ser or Thr
  UNSURE 86: Xaa=Leu or Met
  UNSURE 88: Xaa=Lys or Gln
MPSQXNSELVRGXLAAPGGGERYSRSAGMYMQSGSDFNCGVMRGCGLAPSLSKRDEGSSPSXALNXYPSYLSQLDSWGDPKAAYRXEXPVGRPL

SEQ ID NO: 7790 - protein, 67 aa, Homo sapiens
  UNSURE 22: Xaa=Ala or Glu or Gly or Val
  UNSURE 43: Xaa=His or Leu or Gln or Arg
  UNSURE 51: Xaa=Ala or Asp or Gly or Ile or Asn or Ser or Thr or Val
  UNSURE 64: Xaa=Phe or Ile or Val
MCDLVLCNIITCVNSSEHYSQXYRVVPSQEFLMLPFYSQTTSXFYPHHHQXPMKPLVWSPSPFXPLH

SEQ ID NO: 7791 - protein, 58 aa, Homo sapiens
  UNSURE 24: Xaa=Arg or Ser
MGKKQNRKTENSKNQRTSSSPKEXSSSPAAEQSWMENDFDELREEGFRRSNFSELKEE

SEQ ID NO: 7792 - protein, 67 aa, Homo sapiens
  UNSURE 62: Xaa=Leu or Val
MTIGHCLHWVHFVPVSASTDAGAQAPLSKDNPFHKQTSCLCILYLFREREVSLCQRLQASPXQLRTP

SEQ ID NO: 7793 - protein, 147 aa, Homo sapiens
  UNSURE 38: Xaa= *  or Tyr
  UNSURE 42: Xaa=Met or Val
  UNSURE 44: Xaa=Pro or Thr
  UNSURE 46: Xaa=His or Leu or Gln or Arg
  UNSURE 49: Xaa=Phe or Ile or Leu
  UNSURE 53: Xaa=His or Asn or Tyr
  UNSURE 70: Xaa=Glu or Lys or Gln
MSSNRPVEIVEDPRVVGIWTKNKELELSVPKFKIDEFXVGPXPXKXVTXAKLXDNIRENFLRDMCKKYGXVEEVEILYNPKTKKHLGIAKVVFATVRGAKDAVQHLHSTSVMGNIIHVELDTKGETRMRFYELLVTGRYTPQTLPVG

SEQ ID NO: 7794 - protein, 63 aa, Homo sapiens
  UNSURE 23: Xaa=Ala or Asp or Glu or Gly or Val
  UNSURE 42: Xaa=Phe or Leu
MVFSGMISAHCNIPLLGSSDSSXSASQVAGITGVHHHTWLIXVFLVEMGFRHVGQAGLKLRTS

SEQ ID NO: 7795 - protein, 55 aa, Homo sapiens
  UNSURE 35: Xaa= *  or Glu or Gln
MRICLCCPGWSPTPDFKQSSCLSLPKCWDYRHEPXCPAPLPFSESFRISDCLKLP

SEQ ID NO: 7796 - protein, 55 aa, Homo sapiens
MEYLSALNPSDLLRSVSNISSEFGRRVWTSAPPPQRPFRVCDHKRTIRKGLTAAF

SEQ ID NO: 7797 - protein, 81 aa, Homo sapiens
  UNSURE 27: Xaa= *  or Ala or Glu or Gly or Leu or Ser or Val
  UNSURE 70: Xaa=His or Leu or Gln
MRIFFESVYGQCKAIFYMNNPSRVLYXAAYNCTLRPVSKKKIYMTCPDCPSSIPTDSSNHQVLEAATESXAKYNNENTSKQ

SEQ ID NO: 7798 - protein, 111 aa, Homo sapiens
  SIGNAL -15..-1: score 9.3 seq ALVLLLCIGALLG/HS
  UNSURE 56: Xaa=Cys or Ser
  UNSURE 82: Xaa=Asp or Glu
MQALVLLLCIGALLGHSSCQNPASPPEEGSPDPDSTGALVEEEDPFFKVPVNKLAAAVSNFGYDLYRVRSXTSPTTNVLLSPLSVATALSALSLGAXSEQNPSFTGLSTMT

SEQ ID NO: 7799 - protein, 115 aa, Homo sapiens
  SIGNAL -18..-1: score 5.1 seq VFLLFLCFHLRFC/KV
  UNSURE 84: Xaa=Cys or Asp or Gly or His or Asn or Arg or Ser or Tyr
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLXNGTCTAEESLVFP

SEQ ID NO: 7800 - protein, 145 aa, Homo sapiens
  SIGNAL -19..-1: score 9.8 seq GIFLFLCSTPAWA/KE
  UNSURE 52: Xaa=Leu or Arg
  UNSURE 80: Xaa=Ala or Val
MKILILGIFLFLCSTPAWAKEKHYYIGIIETTWDYASDHGEKKLISVDTEHSNIYLQNGPDRIGRLYKKAXYLQYTDETFRTTIEKPVWLGFLGPIIKXETGDKVYVHLKNLASRPYTFHSHGILTIRNMRGPSTLITPQIFKSR

SEQ ID NO: 7801 - protein, 122 aa, Homo sapiens
  SIGNAL -19..-1: score 10.8 seq ILFLVAAATGAHS/QV
  UNSURE 24: Xaa=Ala or Thr
  UNSURE 35: Xaa=Ile or Asn or Ser or Thr
  UNSURE 53: Xaa=Ala or Gly
  UNSURE 59: Xaa=Asp or Asn
  UNSURE 63: Xaa=Glu or Lys
  UNSURE 64: Xaa=Phe or Leu
  UNSURE 81: Xaa=Leu or Met
  UNSURE 82: Xaa=Asp or Glu
  UNSURE 85: Xaa=Arg or Ser
  UNSURE 88: Xaa=Pro or Ser
MDWTWSILFLVAAATGAHSQVQLVQSGAEVKKPGASVKVSCKXSGYTFTSYGIXWVRQAPGQGLEWMGWISXYNGNTXYAQXXQGRVTMTTDTSTNTAYXXLRXLRXDDTAVYYCARPMGLL

SEQ ID NO: 7802 - protein, 120 aa, Homo sapiens
  SIGNAL -19..-1: score 11.9 seq LSLVLAVLQGVFA/EV
  UNSURE 99: Xaa=Gly or Arg or Trp
MGSTVILSLVLAVLQGVFAEVQLLQSAAEVKRPGESLRISCKTSGYSFTSYWIHWVRQMPGKELEWMGSIYPGNSDTRYSPSFQGHVTISADSSSSTAYLQWSSLKASDAAMYYCVRXTI

SEQ ID NO: 7803 - protein, 106 aa, Homo sapiens
  SIGNAL -19..-1: score 9.9 seq FLFVVAAATGVQS/QV
  UNSURE 24: Xaa=Ala or Thr
  UNSURE 32: Xaa=Ser or Tyr
  UNSURE 52: Xaa=Ile or Met or Thr
  UNSURE 54: Xaa=Phe or Ile or Leu or Val
  UNSURE 55: Xaa=Phe or Ile
  UNSURE 58: Xaa=Asp or Asn
  UNSURE 62: Xaa=Lys or Asn
MDWTWRFLFVVAAATGVQSQVQLVQSGAEVKKPGSSVKVSCKXSGGTFSSXAISWVRQAPGQGLEWMGGIXPXXTAXYAQXFQGRVSDYRGRIHEHNLHGIEQPEI

SEQ ID NO: 7804 - protein, 107 aa, Homo sapiens
  SIGNAL -19..-1: score 9.9 seq FLFVVAAATGVQS/QV
  UNSURE 31: Xaa=Ile or Asn or Ser or Thr
  UNSURE 35: Xaa=Asn or Ser
  UNSURE 52: Xaa=Ile or Thr
  UNSURE 54: Xaa=Phe or Ile
  UNSURE 58: Xaa=Ala or Pro
  UNSURE 62: Xaa=Pro or Gln
  UNSURE 66: Xaa=Asp or Gly
  UNSURE 79: Xaa=any one of the twenty amino acids
  UNSURE 80: Xaa=Ile or Leu or Val
MDWTWRFLFVVAAATGVQSQVQLVQSGAEVKKPGSSVKVSCKASGGTFSXYAIXWVRQAPGQGLEWMGGIXPXFGTXNYAXKFQXRVTITADESTNTXXYGTDQPDI

SEQ ID NO: 7805 - protein, 107 aa, Homo sapiens
  SIGNAL -19..-1: score 9.9 seq FLFVVAAATGVQS/QV
  UNSURE 3: Xaa=Lys or Gln
  UNSURE 5: Xaa=Glu or Val
  UNSURE 9: Xaa=Lys or Thr
  UNSURE 11: Xaa=Phe or Ile or Leu or Met or Val
  UNSURE 12: Xaa=Arg or Thr
  UNSURE 43: Xaa=Lys or Gln
  UNSURE 72: Xaa=Ala or Asp or Glu
  UNSURE 73: Xaa=Asp or His or Asn or Tyr
  UNSURE 78: Xaa=Ile or Thr
MDWTWRFLFVVAAATGVQSQVXLXQSGXGXXKPGSSVKISCKVSGDSFANYGIHWVRQAPGXGLEWMGGIVPLFGTADNAQRFQSKVTITXXRSTTXVFMEVKQPEI

SEQ ID NO: 7806 - protein, 151 aa, Homo sapiens
  SIGNAL -25..-1: score 3.9 seq RVGLLLGGGGVYG/SR
  UNSURE 94: Xaa=Ile or Lys or Asn or Arg or Ser or Thr
  UNSURE 103: Xaa=Glu or Lys
MPRKRKCDLRAVRVGLLLGGGGVYGSRFRFTFPGCRALSPWRVRVQRRRCEMSTMFADTLLIVFISVCTALLAEGITWVLVYRTDKYKRLKAEVEKQSKKLEKKKETITESAGRQQKKXIERQEEKLXNNNRDLSMVRMKSMFAIGFCFTA

SEQ ID NO: 7807 - protein, 114 aa, Homo sapiens
  SIGNAL -20..-1: score 9 seq VVIFATFVTLCNA/SC
MNVLLGSVVIFATFVTLCNASCYFIPNEGVPGDSTRKCMDLKGNKHPINSEWQTDNCETCTCYETEISCCTLVSTPVGYDKDNCQRIFKKEDCKYIVVEKKDPKKTCSVSEWII

SEQ ID NO: 7808 - protein, 103 aa, Homo sapiens
  SIGNAL -33..-1: score 5 seq LAAARLLSRXSSC/RR
  UNSURE -4: Xaa=Ser or Thr
MTATLAAAADIATMVSGSSGLAAARLLSRXSSCRRMEFGIVPTQLLGNISMLIKIQRLFARVSLANRAPFTASRHWNMAPNSLEEPLQGKEARHIWAYLSLIL

SEQ ID NO: 7809 - protein, 110 aa, Homo sapiens
  SIGNAL -32..-1: score 7 seq ITFLLQAIRNTTA/AE
  UNSURE -19: Xaa=Phe or Ile or Leu or Val
  UNSURE 60: Xaa=Ala or Gly
MWSGNRQRKPMRIXPGQSKITFLLQAIRNTTAAEEARQMAAVLLRRLLSSAFDEVYPALPSDVQTAIKSELLMIIQMETQSSMRKKVCDIAXELARNLIDEDGNNQWPEV

SEQ ID NO: 7810 - protein, 134 aa, Homo sapiens
  SIGNAL -13..-1: score 5.3 seq MLSRVVLSAAATA/AP
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADNSMSKNLPN

SEQ ID NO: 7811 - protein, 122 aa, Homo sapiens
  SIGNAL -15..-1: score 9.4 seq LLTGLVFCSLVLX/VS
  UNSURE 0: Xaa=Gly or Ser
MKLLTGLVFCSLVLXVSSRSFFSFLGEAFDGARDMWRAYSDMREANYIGSDKYFHARGNYDAAKRGPGGVWAAEAISDARENIQRFFGHGAEDSLADQAANEWGRSGKDPNHFRPAGLPEKY

SEQ ID NO: 7812 - protein, 151 aa, Homo sapiens
  SIGNAL -19..-1: score 12.1 seq TFLLLALSTAAQA/EP
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 7813 - protein, 277 aa, Homo sapiens
  SIGNAL -36..-1: score 4.2 seq LCFFGVALFCGCG/HE
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 7814 - protein, 104 aa, Homo sapiens
  SIGNAL -16..-1: score 6 seq SRLTAVSASWVQA/HP
MVRSRLTAVSASWVQAHPPADMGRRKSKRKPPPKKKMTGTLETQFTCPFCNHEKSCDVKMDRARNTGVISCTVCLEEFQTPITYLSEPVDVYSDWIDACEAANQ

SEQ ID NO: 7815 - protein, 234 aa, Homo sapiens
  SIGNAL -17..-1: score 9.2 seq VVFLTLSVTWIGA/AP
  UNSURE 72: Xaa=Ile or Leu
  UNSURE 83: Xaa=Asn or Thr
MWVPVVFLTLSVTWIGAAPLILSRIVGGWECEKHSQPWQVLVASRGRAVCGGVLVHPQWVLTAAHCIRKPGDDSSHDLMLLRLSEPAEXTDAVKVMDLPXQEPALGTTCYASGWGSIEPEEFLTPKKLQCVDLHVISNDVCAQVHPQKVTKFMLCAGRWTGGKSTCSGDLGAHLSVMVCFKVSRHGAVNHVPCPKGLPCTPRWCITGSGSRTPSWPTPEHPYQLPIVVNLEPWK

SEQ ID NO: 7816 - protein, 115 aa, Homo sapiens
  SIGNAL -28..-1: score 7.8 seq FSLVVFSCGGCWS/VT
MHTQDSEVVPVPAWPFSLVVFSCGGCWSVTAKMLRNLLALRQIGQRTISTASRRHFKNKVPEKQKLFQEDDEIPLYLKGGVADALLYRATMILTVGGTAYAIYELAVASFPKKQE

SEQ ID NO: 7817 - protein, 108 aa, Homo sapiens
  SIGNAL -16..-1: score 3.9 seq CAKLACTPSLIRA/GS
  UNSURE 90: Xaa=Ile or Asn or Ser or Thr
  UNSURE 91: Xaa=Ala or Cys or Asp or Phe or Gly or His or Ile or Leu or Asn or Pro or Arg or Ser or Thr or Val or Tyr
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLSLVMPEXXR

SEQ ID NO: 7818 - protein, 107 aa, Homo sapiens
  SIGNAL -34..-1: score 5.1 seq ASLLNFWNPPTTA/QV
  UNSURE -24: Xaa=His or Gln
  UNSURE -23: Xaa=Leu or Arg
  UNSURE -17: Xaa=Leu or Val
MGPLSAPPCTXXITWKGXLLTASLLNFWNPPTTAQVTIEAQPPKVSEGKDVLLLVHNLPQNLAGYIWYKGQMTYLYHYITSYVVDGQRIIYGPAYSGRERVYSNASC

SEQ ID NO: 7819 - protein, 158 aa, Homo sapiens
  SIGNAL -23..-1: score 8.6 seq LVLALALILVLES/SV
  UNSURE 8: Xaa=Gln or Arg
MMQKLLKCSRLVLALALILVLESSVQGYPTXRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 7820 - protein, 201 aa, Homo sapiens
  SIGNAL -18..-1: score 10.5 seq VLTVLSLLPLLEA/QI
MALSWVLTVLSLLPLLEAQIPLCANLVPVPITNATLDQITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 7821 - protein, 135 aa, Homo sapiens
  SIGNAL -24..-1: score 10.9 seq LAGLCCLVPVSLA/ED
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLVPSTSQTASSS

SEQ ID NO: 7822 - protein, 122 aa, Homo sapiens
  SIGNAL -23..-1: score 6.2 seq ILYFYALLFLSST/CV
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIIEI

SEQ ID NO: 7823 - protein, 110 aa, Homo sapiens
  SIGNAL -36..-1: score 9.7 seq LWTVLILFSCCCA/FX
  UNSURE 2: Xaa=Cys or Gly or Arg or Ser
  UNSURE 16: Xaa=His or Gln
  UNSURE 43: Xaa=Ala or Gly
  UNSURE 49: Xaa=Cys or Gly or Arg or Ser
  UNSURE 58: Xaa=Asn or Thr
  UNSURE 60: Xaa= *  or Glu or Lys or Gln
  UNSURE 63: Xaa=His or Gln
MAMECTRKNTRSTYYYELWWFWLLWTVLILFSCCCAFXHRRAKLRLQQQQRXVKSTCWPIMGHAMGLVLSLPVHCLTFXSSAPSXPQPTRMWFXAXAHXPPLILWPQAAP

SEQ ID NO: 7824 - protein, 113 aa, Homo sapiens
  SIGNAL -41..-1: score 4.6 seq AYLLYILLTGALQ/FG
  UNSURE 70: Xaa=Phe or Leu
  UNSURE 71: Xaa=Ile or Val
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNXXG

SEQ ID NO: 7825 - protein, 149 aa, Homo sapiens
  SIGNAL -26..-1: score 10.8 seq MLPLLWLLPHSWA/VP
  UNSURE 109: Xaa= *  or Lys
  UNSURE 111: Xaa=Leu or Trp
  UNSURE 121: Xaa=Phe or Tyr
  UNSURE 122: Xaa= *  or Cys or Tyr
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRGFPIAEVFTLXPXSLASQHFGLXXQ

SEQ ID NO: 7826 - protein, 116 aa, Homo sapiens
  SIGNAL -18..-1: score 6.3 seq LLFVGLLLTWESG/QV
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECSPA

SEQ ID NO: 7827 - protein, 189 aa, Homo sapiens
  SIGNAL -28..-1: score 12.5 seq ILLVLGWVQPSLG/KE
  UNSURE 132: Xaa=Ala or Pro
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGQGNCYKSNSSMHITDCRLTNGSSTPTVHTGPARRRDTSLWPVKGAHMCQSTLMLLWRTLPKVRXARYPTSLNLILSTAASSLFLPCCERSNYS

SEQ ID NO: 7828 - protein, 189 aa, Homo sapiens
  SIGNAL -28..-1: score 12.5 seq ILLVLGWVQPSLG/KE
  UNSURE 25: Xaa=Asp or Tyr
  UNSURE 132: Xaa=Ala or Pro
MALEKSLVRLLLLVLILLVLGWVQPSLGKESRAKKFQRQHMDSDSSPSSSSTXCNQMMRRRNMTQGRCKPVNTFVHEPLVDVQNVCFQEKVTCKNGQGNCYKSNSSMHITDCRLTNGSSTPTVHTGPARRRDTSLWPVKGAHMCQSTLMLLWRTLPKVRXARYPTSLNLILSTAASSLFLPCCERSNYS

SEQ ID NO: 7829 - protein, 155 aa, Homo sapiens
  SIGNAL -28..-1: score 12.5 seq ILLVLGWVQPSLG/KE
  UNSURE 69: Xaa=Arg or Ser
  UNSURE 75: Xaa=Gln or Arg
MALEKSLVRLLLLVLILLVLGWVQPSLGKESRAKKFQRQHMDSDSSPSSSSTYCNQMMRRRNMTQGRCKPVNTFVHEPLVDVQNVCFQEKVTCKNGXQLLQEXLQHAHHRLPPDKRLQYPNCAYRTSPKERHIIVACEGSPYVPVHFDASVEDST

SEQ ID NO: 7830 - protein, 139 aa, Homo sapiens
  SIGNAL -28..-1: score 9.4 seq ASLVLAFLGVCLG/IT
MAAVAAVAARRRRSWASLVLAFLGVCLGITLAVDRSNFKTCEESSFCKRQRSIRPGLSPYRALLDSLQLGPDSLTVHLIHEVTKVLLVLELQGLQKNMTRFRIDELEPRRPRYRVPDVLVADPPIAGFLSLVVMRTVWS

SEQ ID NO: 7831 - protein, 127 aa, Homo sapiens
  SIGNAL -30..-1: score 9.3 seq LFWLCGILILALA/IW
  UNSURE 43: Xaa=Ala or Gly
  UNSURE 75: Xaa=Ile or Leu or Val
  UNSURE 94: Xaa=Lys or Asn
  UNSURE 95: Xaa=Glu or Gln
MAGVSACIKYSMFTFNFLFWLCGILILALAIWVRVSNDSQAIFGSEDVGSSSYVAVDILIAVGAIIMILGFLXCCGAIKESRCMLLLFFIGLLLILLLQVATGIXGAVFKSKSDRIVNETLYEXXSF

SEQ ID NO: 7832 - protein, 127 aa, Homo sapiens; identical to SEQ ID NO: 7831
  SIGNAL -30..-1: score 9.3 seq LFWLCGILILALA/IW
  UNSURE 43: Xaa=Ala or Gly
  UNSURE 75: Xaa=Ile or Leu or Val
  UNSURE 94: Xaa=Lys or Asn
  UNSURE 95: Xaa=Glu or Gln

SEQ ID NO: 7833 - protein, 121 aa, Homo sapiens
  SIGNAL -32..-1: score 5.3 seq VIFTVLLQSLCVA/VT
  UNSURE -18: Xaa=Asn or Thr
MAMMEVQGGPSLGQXCVLIVIFTVLLQSLCVAVTYVYFTNELKQMQDKYSKSGIACFLKEDDSYWDPNDEESMNSPCWQVKWQLRQLVRKMILRTSEETISTVQEKQQNISPLVRERGLRE

SEQ ID NO: 7834 - protein, 122 aa, Homo sapiens
  SIGNAL -45..-1: score 7.2 seq SFALCMFVAAAGA/YV
MNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPAWSFVLLSTPASFPLLSWAQQ

SEQ ID NO: 7835 - protein, 129 aa, Homo sapiens
  SIGNAL -25..-1: score 8.9 seq IIAVLMSAQESWA/IK
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPLG

SEQ ID NO: 7836 - protein, 110 aa, Homo sapiens
  SIGNAL -24..-1: score 4.7 seq LLMIRSTAAATRS/SR
MIINDVQAPWWLLMIRSTAAATRSSRPFSGSSELSENQQPGAPNAPTHPAPPGLHHHHKHKGQHRQGHPENRDMPASEDLQDLQKKLCRKRCINQLLCKLPTDSELAPRS

SEQ ID NO: 7837 - protein, 103 aa, Homo sapiens
  SIGNAL -20..-1: score 6.9 seq AAFLSPLLPLLLG/FL
MAAAVPRAAFLSPLLPLLLGFLLLSAPHGGSGLHTKGALPLDTVTFYKVIPKSKFVLVKFDTQYPYGEKQDEFKRLAENSASSDDLLVAEVGISDYGDKRTWS

SEQ ID NO: 7838 - protein, 101 aa, Homo sapiens
  SIGNAL -17..-1: score 10.4 seq LLPALFLVLLVLG/FE
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 7839 - protein, 104 aa, Homo sapiens
  SIGNAL -24..-1: score 6.5 seq LSICLSAVATATG/AE
  UNSURE 68: Xaa=Ala or Asp or Glu or Gly or Val
  UNSURE 79: Xaa=Asp or Gly or Asn or Ser
MRLSWFRVLTVLSICLSAVATATGAEGKRKLQIGVKKRVDHCPIKSRKGDVLHMHYTGKLEDGTEFDSSLPQNQPFVFSLGTGQVIKGWDQXLLGMCEGEKRXW

SEQ ID NO: 7840 - protein, 115 aa, Homo sapiens
  SIGNAL -17..-1: score 4.4 seq AWATALFSSNVFP/LP
  UNSURE 21: Xaa=Cys or Ser
  UNSURE 70: Xaa=Leu or Arg
  UNSURE 73: Xaa= *  or Lys
MPLPAWATALFSSNVFPLPGLAVSSFIFEKNHLLIKCXNFALSLHEGCLGYPTRQRALVSNYRKSTPEQSSYLHTNNSGACIYVTIXSCXRLARGVFNPIRRSFKRMSAKWSKGS

SEQ ID NO: 7841 - protein, 117 aa, Homo sapiens
  SIGNAL -27..-1: score 3.6 seq ACLLCSLVKTIDQ/FE
MALETVPKDLRHLRACLLCSLVKTIDQFEYDGCDNCDAYLQMKGNREMVYDCTSSSFDGIIAMMSPEDSWVSKWQRVSNFKPGVYAVSVTGRLPQGIVRELKSRGVAYKSRDTAIKT

SEQ ID NO: 7842 - protein, 111 aa, Homo sapiens
  SIGNAL -42..-1: score 7.4 seq SLSVLVLLLTIIA/VT
  UNSURE 34: Xaa=Asn or Thr
  UNSURE 65: Xaa= *  or Trp
MGKSESQMDITDINTPKPKKKQRWTPLEISLSVLVLLLTIIAVTMIALYATYDDGICKSSDCIKSAARLIQNMDAXTEPCTDFFKYACGGWLKRNVIPETSSRYGLXHFKR

SEQ ID NO: 7843 - protein, 110 aa, Homo sapiens
  SIGNAL -21..-1: score 9.1 seq LLSGALALTETWA/GS
  UNSURE -15: Xaa=Ile or Leu
  UNSURE 11: Xaa=Ala or Ser
  UNSURE 24: Xaa=Ala or Ser
  UNSURE 44: Xaa=Asp or Glu
  UNSURE 51: Xaa=Asp or Gly
  UNSURE 52: Xaa=Gly or Arg
MAPRTLXLLLSGALALTETWAGSHSMRYFYTXVSRPGRGEPRFIXVGYVDDTQFVRFDSDAASQXGAAGAVXXAGGAGVLGPGDTEVQAPGTGGLDPTTVAMVTKLWSPR

SEQ ID NO: 7844 - protein, 136 aa, Homo sapiens
  SIGNAL -24..-1: score 9.4 seq LLSGALALTETWA/XS
  UNSURE -15: Xaa=Ile or Leu
  UNSURE 1: Xaa=Cys or Gly
  UNSURE 9: Xaa=Asp or Tyr
  UNSURE 24: Xaa=Ala or Ser
  UNSURE 45: Xaa=Glu or Gly
  UNSURE 52: Xaa=Ile or Met or Val
  UNSURE 63: Xaa=Asp or Glu or Lys or Asn
  UNSURE 89: Xaa=Lys or Asn or Arg or Ser
MRVMAPRTLXLLLSGALALTETWAXSHSMRYFXTAVSRPGRGEPRFIXVGYVDDTQFVRFDSDAASPRXEPRAPWXEQEGPEYWDRXTQKYKPLRKSGFPKKTLLELTFFCPXKQTKTKHTHKPPETHNMYTLRKN

SEQ ID NO: 7845 - protein, 115 aa, Homo sapiens
  SIGNAL -20..-1: score 10.4 seq VLFGLLLVLAVFC/HS
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKQFFCW

SEQ ID NO: 7846 - protein, 115 aa, Homo sapiens; identical to SEQ ID NO: 7845
  SIGNAL -20..-1: score 10.4 seq VLFGLLLVLAVFC/HS

SEQ ID NO: 7847 - protein, 115 aa, Homo sapiens; identical to SEQ ID NO: 7845
  SIGNAL -20..-1: score 10.4 seq VLFGLLLVLAVFC/HS

SEQ ID NO: 7848 - protein, 198 aa, Homo sapiens
  SIGNAL -48..-1: score 5.1 seq SAPLCLLCSGSSS/PA
MPELILYVAITLSVAERLVGPGHACAEPSFRSSRCSAPLCLLCSGSSSPATAPHPLKMFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 7849 - protein, 155 aa, Homo sapiens
  SIGNAL -19..-1: score 3.5 seq RLLRASVARHVSA/IP
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGT

SEQ ID NO: 7850 - protein, 101 aa, Homo sapiens
  SIGNAL -27..-1: score 10.9 seq LFLGXLLLPLVVA/FA
  UNSURE -9: Xaa=Leu or Val
MSSAAGFCASRPGLLFLGXLLLPLVVAFASAEAEEDGDLQCLCVKTTSQVRPRHITSLEVIKAGPHCPTAQLIATLKNGRKICLDLQAPLYKKIIKKLLES

SEQ ID NO: 7851 - protein, 106 aa, Homo sapiens
  SIGNAL -30..-1: score 5.9 seq LGVNLVVMPPTXA/RS
  UNSURE -2: Xaa=Gln or Arg
  UNSURE 74: Xaa=Arg or Thr
MAGKRSGWSRAALLQLLLGVNLVVMPPTXARSLRFVTLLYRHGDRSPVKTYPKDPYQEEEWPQGFGQLTKEGMLQHWELGQALRQRYHGFLNTSYHRQEVYVRXDL

SEQ ID NO: 7852 - protein, 197 aa, Homo sapiens
  SIGNAL -19..-1: score 5.1 seq SLLWAATCLGVLC/VL
  UNSURE 155: Xaa=Phe or Leu
  UNSURE 158: Xaa=His or Gln
  UNSURE 167: Xaa=Cys or Phe or Ser or Tyr
  UNSURE 170: Xaa=Cys or Ser
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVXGVXAVIFFLYKXCKXKERNYHTL

SEQ ID NO: 7853 - protein, 127 aa, Homo sapiens
  SIGNAL -26..-1: score 10.4 seq LCLCVLVLACIGA/CQ
  UNSURE 10: Xaa=Leu or Pro
  UNSURE 41: Xaa=Ala or Asp or Glu or Gly or Val
  UNSURE 98: Xaa=Lys or Asn
MSLLRNRLQALPALCLCVLVLACIGACQPEAQEGTXSPPPKLKMSRWSLVRGRMKELLETVVNRTRXGWQWFWSPSTFRGFMQTYYDDHLRDLGPRTKAWFLESKDSLLKKTHSLCPRLVCGDXDQG

SEQ ID NO: 7854 - protein, 134 aa, Homo sapiens
  SIGNAL -17..-1: score 9.3 seq LALSLLILVLAFG/IP
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTKRSQTPKGP

SEQ ID NO: 7855 - protein, 116 aa, Homo sapiens
  SIGNAL -27..-1: score 8.6 seq IVLALGCVTGAPS/DP
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 7856 - protein, 122 aa, Homo sapiens
  SIGNAL -15..-1: score 4.2 seq LSHLQGISGPILG/QP
MDLSHLQGISGPILGQPFYPLPAASHPLLNPRPGTPLHLAMVQQQLQRSVLHPPGSGSHAAAVSVQTTPQNVPSRSGLPHMHSQLEHRQPEEQLPCGPCQMVWLRCATATPALHARQSYQCR

SEQ ID NO: 7857 - protein, 142 aa, Homo sapiens
  SIGNAL -43..-1: score 5.1 seq PTLGAFWLAVLLA/DM
MRSHPGAQLFPRSGPTHPASLHQRSPAACPPTLGAFWLAVLLADMRQRLLPSVTSLLLVALLFPGSSQARHVNHSATEALGELRERAPGQGTNGFQLLRHAVQMGPLTTAHPTLPRGCSTGNEKYHLPYAARDLQTFFLPFW

SEQ ID NO: 7858 - protein, 147 aa, Homo sapiens
  SIGNAL -40..-1: score 4.6 seq ITGVILLAVGVWG/KL
  UNSURE 107: Xaa=Ser or Thr
MASRRMETKPVITCLKTLLIIYSFVFWITGVILLAVGVWGKLTLGTYISLIAENSTNAPYVLIGTGTTIVVFGLFGCFATCRGSPWMLKLYAMFLSLVFLAELVAGISGFVFRHEIKDTFLRTYTDAMQTYNGNDERSRAVDHVQRX

SEQ ID NO: 7859 - protein, 118 aa, Homo sapiens
  SIGNAL -21..-1: score 9.3 seq GLLAALAVCGSWG/LN
  UNSURE 70: Xaa=Ile or Asn or Ser or Thr
  UNSURE 80: Xaa= *  or Leu or Gln
MEGPVLTLGLLAALAVCGSWGLNEEERLIRHLFQEKGYNKELRPVAHKEESVDVALALTLSNLISLKEVEETLTTNVWIEHGWTDNRLKWXAEEFGNISVXRLPPDMVWLRDCAGEQQ

SEQ ID NO: 7860 - protein, 122 aa, Homo sapiens
  SIGNAL -27..-1: score 5.7 seq LVSLFCSCFLADP/LN
  UNSURE 85: Xaa=Leu or Val
MTLAAYKEKMKELPLVSLFCSCFLADPLNKSSYKYEADTVDLNWCVISDMEVIELNKCTSGQSFEVILKPPSFDGVPEFNASLPRRRDPSLEEIQKKLEAAEGAKEVPGSGXLKHLAEKTGT

SEQ ID NO: 7861 - protein, 114 aa, Homo sapiens
  SIGNAL -48..-1: score 4.6 seq VFGSFLLLLFSLT/QF
  UNSURE 22: Xaa=Phe or Leu
  UNSURE 41: Xaa= *  or Gly or Arg
MQATADSTKMDCVWSNWKSQAIDLLYWRDIKQTGIVFGSFLLLLFSLTQFSVVSVVAYLALAALSATISXRIYKSVLQAVQITDEGHRXRPTWSLRSPFLRSRFRSTRTACSST

SEQ ID NO: 7862 - protein, 152 aa, Homo sapiens
  SIGNAL -33..-1: score 9.5 seq LLLGLVMPLAIIA/QV
MGTMKTQRDGHSLGRWSLVLLLLGLVMPLAIIAQVLSYKEAVLRAIDGINQRSSDANLYRLLDLDPRPTMDGDPDTPKPVSFTVKETVCPRTTQQSPEDCDFKKDGLVKRCMGTVTLNQARGSFDISCDKDNKRFALLGDFFRKSKEKMAKS

SEQ ID NO: 7863 - protein, 134 aa, Homo sapiens
  SIGNAL -47..-1: score 4.9 seq LSDGLSLAAPGWG/VP
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGARIAASGNGCWLGNVESMSFEIRNASL

SEQ ID NO: 7864 - protein, 124 aa, Homo sapiens
  SIGNAL -30..-1: score 9.9 seq LLFGFTLVSGTGA/EK
MPACRLGPLAAALLLSLLLFGFTLVSGTGAEKTGVCPELQADQNCTQECVSDSECADNLKCCSAGCATFCSLPNDKEGSCPQVNINFPQLGLCRDQCQVDSQCPGQMKCCRNGCGKVSCVTPNF

SEQ ID NO: 7865 - protein, 143 aa, Homo sapiens
  SIGNAL -37..-1: score 4.2 seq LADVCLDTPLCNG/HT
  UNSURE 102: Xaa=Ile or Asn or Ser or Thr
MGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGXNLTT

SEQ ID NO: 7866 - protein, 115 aa, Homo sapiens
  SIGNAL -39..-1: score 4.3 seq IHISWLSLSRVNC/SQ
MKPPSSIQTSEFDSSDEEPIEDEQTPIHISWLSLSRVNCSQFLGLCALPGCKFKDVRRNVQKDTEELKSCGIQDIFVFCTRGELSKYRVPNLLDLYQQCGIITHHHPIADGGTLT

SEQ ID NO: 7867 - protein, 119 aa, Homo sapiens
  SIGNAL -16..-1: score 6.5 seq VLXLFVCLFETES/XS
  UNSURE -11: Xaa=Phe or His or Leu or Tyr
  UNSURE 1: Xaa=Gly or Arg
MIFVLXLFVCLFETESXSVARAGVQWHGLVSLRPLPPGFKRFSCLSLLSSWDYRRVPPRLANFCIFSRDGVMPFDQAGLELLTSSDPPALAFQGAGIAGVSHEAWPGICLFVIGLFLLA

SEQ ID NO: 7868 - protein, 106 aa, Homo sapiens
  SIGNAL -49..-1: score 5.9 seq FVFIFVXLRESLA/LL
  UNSURE -7: Xaa=Cys or Phe or Leu or Trp
  UNSURE 39: Xaa=Cys or Arg or Ser
MILLDIHTYLLKKYLFISFTYYLIGLNFFFLFSCWFFVFIFVXLRESLALLPRLECSGVISAHCKLCLLGSHHSPASASQVAGTTGAXHYAWLIFCIFSRDGVSLC

SEQ ID NO: 7869 - protein, 131 aa, Homo sapiens
  SIGNAL -37..-1: score 10.1 seq LLGLCVCLSGCST/ET
  UNSURE 13: Xaa=Arg or Trp
  UNSURE 80: Xaa=Arg or Ser
  UNSURE 81: Xaa=Cys or Gly or Arg
  UNSURE 89: Xaa=Gly or Arg
  UNSURE 90: Xaa=Pro or Thr
MGGSFALQDSFSSLQGLLGPEYVKLLGLCVCLSGCSTETLHTQLCISDPXPWWHGLTRRSPDLWVAKICGRSVVSWMGSHNHSLLPLAGGGAFFLAPCCSWAGDCPTPFFFILCGSXXSLGQSIVXXGYFS

SEQ ID NO: 7870 - protein, 112 aa, Homo sapiens
  SIGNAL -49..-1: score 7.7 seq LCLLGSSDSPASA/SQ
  UNSURE 55: Xaa=Ser or Thr
MHVVVVVVVVVVVVLRQSLALLPRLECSGTILAHCSLCLLGSSDSPASASQVARTTGMCHHTQLIFVFLIETGFLHIGQAALELLTSGDPPASASQSAGITGVXTTPGRLSN

SEQ ID NO: 7871 - protein, 101 aa, Homo sapiens
  SIGNAL -23..-1: score 4.6 seq LFFYFILWRRSLA/LS
  UNSURE -22: Xaa=Asp or Glu or Gly
MXMSVSKFPFLFFYFILWRRSLALSPRLECSGPILAHCNLRLLGSSNSPTLASRVAGTTGARCHAWLIFCIFSRDGFSPCCPGWSGTPELRQSTHLGLPRY

SEQ ID NO: 7872 - protein, 136 aa, Homo sapiens
  SIGNAL -38..-1: score 7 seq LVMVWLGLLPLFS/GP
  UNSURE 84: Xaa=Phe or Val
  UNSURE 85: Xaa=Phe or Ser
  UNSURE 87: Xaa=Cys or Phe
  UNSURE 91: Xaa= *  or Ser or Trp
  UNSURE 96: Xaa=Ile or Met
MANAIIKKPCAMPAQPHTGNLLWPPLVMVWLGLLPLFSGPHLQAVQHLALAYLPLNSVVLAHNSPAILNVWLTLRCPLPYRICLWPFEHAFPSIRNTHSCLSSSCCCPASAPLLVDYLFFYXXGXFKSXASLRXNN

SEQ ID NO: 7873 - protein, 119 aa, Homo sapiens
  SIGNAL -14..-1: score 4.2 seq VIFAPLFAIFAFA/TC
MVIFAPLFAIFAFATCGGYSGGLRLSVDCVNKTESNLSIDIAFAYPFRLHQVTFEVPTCEGKERQKLALIGDSSSSAEFFVTVAVFAFLYSLAATVVYIFFQNKYRENTGAHSLTSLSL

SEQ ID NO: 7874 - protein, 121 aa, Homo sapiens
  SIGNAL -16..-1: score 4.1 seq VFFLTEAGSVAQA/GV
  UNSURE 3: Xaa=Lys or Gln
  UNSURE 82: Xaa=His or Gln
  UNSURE 97: Xaa=Ala or Thr
  UNSURE 100: Xaa= *  or Leu
MFWVFFLTEAGSVAQAGVXWCDLGSLQPPPPRIKQFPCLSLPSSWDYRCTPPRPANFCIFLVETGFLRVGRADLELQTSSDAPTWASQSTGIAGVNHXARPFANVLLLSRDPXLYXFILFP

SEQ ID NO: 7875 - protein, 122 aa, Homo sapiens
  SIGNAL -21..-1: score 5.8 seq ACVRVCLVWTSFC/QP
  UNSURE 59: Xaa= *  or Cys or Phe or Leu or Ser or Trp or Tyr
MCVCVCVRACVRVCLVWTSFCQPLAFTFFLAYAGQTKCEILPSAELSKGSWGLAGDGCGICPGLEPSQDSAGKAAVLRCXGADATSLSSPKGEHGDNMGVCPQHSRCRAPVAKYYRVWVGIT

SEQ ID NO: 7876 - protein, 116 aa, Homo sapiens
  SIGNAL -19..-1: score 5.8 seq HLMSLVTSTSASA/SA
  UNSURE 62: Xaa= *  or Cys or Trp
  UNSURE 79: Xaa=Leu or Trp
  UNSURE 81: Xaa=Arg or Ser
MIGNYDHLMSLVTSTSASASASPFQSAWYSESEITQGARSRSQNQQRDHDSKRPKLSCTNCTTSAGRNVGNGLNTLSDSSXWHSQVPRSSSMVLGSFXDXLNEREERFGEKNRFLY

SEQ ID NO: 7877 - protein, 115 aa, Homo sapiens
  SIGNAL -15..-1: score 8.6 seq PLLIICLLPAIEG/KN
MLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKII

SEQ ID NO: 7878 - protein, 108 aa, Homo sapiens
  SIGNAL -17..-1: score 5.7 seq VVCCSCSWFFLFC/FV
  UNSURE 56: Xaa= *  or Cys or Gly
  UNSURE 59: Xaa=Arg or Ser
  UNSURE 61: Xaa=Asp or Asn
  UNSURE 62: Xaa=Ala or Glu or Gly or Lys or Met or Arg or Thr or Val
  UNSURE 64: Xaa= *  or Leu
  UNSURE 66: Xaa=Asn or Tyr
  UNSURE 67: Xaa= *  or Tyr
  UNSURE 71: Xaa=Pro or Ser
MISDVVCCSCSWFFLFCFVFEMESHSVTQAGVQWRDLGSLQALPPGFSPFCLSLPSSWDYRCLPPSSANFFFXIFXSXXVXPXXPGWXQSPDLMIRPPRPPKVLGIQA

SEQ ID NO: 7879 - protein, 107 aa, Homo sapiens
  SIGNAL -21..-1: score 4.9 seq GVVAHACCPGTLG/CR
  UNSURE 57: Xaa=Asp or Gly or Asn or Ser
  UNSURE 73: Xaa= *  or Arg
MKLDTSRPGVVAHACCPGTLGCRGGWITRSGDRDQPGQRGEAPSLLKMLKKLAGRGGPRLWSQLLGRLRQKNRLNLGXGGCGELRSRHCTPAWXQSETLSQNQKKET

SEQ ID NO: 7880 - protein, 135 aa, Homo sapiens
  SIGNAL -20..-1: score 4.5 seq GTLVFTVITAVLG/SF
MTEDKVTGTLVFTVITAVLGSFQFGYDIGVINAPQQVIISHYRHVLGVPLDDRKAINNYVINSTDELPTISYSMNPKPTPWAEEETVAAAQLITMLWSLSVSSFAVGGMTASFFGGWLGDTLGRANFRPGSYVYR

SEQ ID NO: 7881 - protein, 103 aa, Homo sapiens
  SIGNAL -24..-1: score 4.5 seq CVLKCVCLPLILS/PP
MHFYSSNSDIECVLKCVCLPLILSPPTIRNTFLQLLLARLPRKIVELESQHRARWLTPVILALWEAKAGGSPEVRSSRPAGPTWRNPDSTKNTKISQAWWWAL

SEQ ID NO: 7882 - protein, 105 aa, Homo sapiens
  SIGNAL -34..-1: score 8.2 seq TLFLLTLSSSTLS/FL
  UNSURE 70: Xaa=Ala or Pro
MAAQETHAAHLYFLPNLRNFQTLFLLTLSSSTLSFLFFFNFSDLNLSSFYFLFLFLLRWSHALVAQAGVQWCDLGSLQPLSPGFRLSSCPTPEWLGLQACTSSXS

SEQ ID NO: 7883 - protein, 110 aa, Homo sapiens
  SIGNAL -28..-1: score 4.5 seq LMSPALAAHVTRS/SQ
MNRKRKSQTQERTRGLMSPALAAHVTRSSQGPPLAVVAPSPKTKGQKAEDVPVRVALGASSCEICHEVFKSKNVRVLKCGHKYHKGCFKQWLKGQSACPACQTCDLLSEE

SEQ ID NO: 7884 - protein, 101 aa, Homo sapiens [sequence omitted]

SEQ ID NO: 7885 - protein, 106 aa, Homo sapiens [sequence omitted]

SEQ ID NO: 7886 - protein, 105 aa, Homo sapiens
  SIGNAL -40..-1: score 5 seq LTLFISAXFXSET/WQ
  UNSURE -6: Xaa=Cys or Phe or Leu or Trp
  UNSURE -4: Xaa=Ala or Asp or Asn or Thr
  UNSURE 38: Xaa=Glu or Lys or Met or Val
  UNSURE 49: Xaa=Ala or Gly or Pro or Arg or Ser or Thr or Trp
MPACILEDVEISFRQKWSINSDTLLGCLTLFISAXFXSETWQKLVSQSTAFLTMCGVTYAWYMPLLLLKFYSLLLAQXLLNPFLMCTGXRKNYSQHFERKFSEQY

SEQ ID NO: 7887 - protein, 109 aa, Homo sapiens
  SIGNAL -41..-1: score 6.1 seq VLLALSLRMECSG/MI
  UNSURE 62: Xaa=Cys or Pro or Arg or Ser or Thr
MEQILLHNLRGKTLLIPGFQTPGLQNDKVLLALSLRMECSGMILAHYNLCLPGSSDSPALRSQVTGTTGTHHHTQLIFVFFVETGFYHVSRAGLELLTSGDPXASIAHY

SEQ ID NO: 7888 - protein, 103 aa, Homo sapiens
  SIGNAL -43..-1: score 9.1 seq CLFVCLFFXWSLA/LS
  UNSURE -42: Xaa=Leu or Pro or Ser
  UNSURE -5: Xaa= *  or Leu
MXPSDNCCYLYFFSLPFSCPQLYIVFFVVFCLFVCLFFXWSLALSPRLECSGAISAHCNLHLPGSSDSPTSASRVAGIIDMASPCLANFSIFSRDGVLPCWRG

SEQ ID NO: 7889 - protein, 128 aa, Homo sapiens [sequence omitted]

SEQ ID NO: 7890 - protein, 107 aa, Homo sapiens
MNQEKLAKLQAQVRIGGKGTARRKKKVVHRTATADDKKLQSSLKKLAVNNIAGIEEVNMIKDDGTVIHFNNPKVQASLSANTFAITGHAEAKPITEMLPGNIKSAWC

SEQ ID NO: 7891 - protein, 165 aa, Homo sapiens [sequence omitted]

SEQ ID NO: 7892 - protein, 103 aa, Homo sapiens
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 7893 - protein, 117 aa, Homo sapiens [sequence omitted]

SEQ ID NO: 7894 - protein, 117 aa, Homo sapiens [sequence omitted]

SEQ ID NO: 7895 - protein, 141 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 7896 - protein, 102 aa, Homo sapiens
MNKLKSSQKDKVRQFMIFTQSSEKTAVSCLSQNDWKLDVATDNFFQNPELYIRESVKGSLDRKKLEQLYNRYKDPQDENKIGIDGIQQFCDDLALDPASIVC

SEQ ID NO: 7897 - protein, 181 aa, Homo sapiens
  UNSURE 154: Xaa=Asn or Tyr
MGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWXIQATCATSGDGLYEGLDWLSNQLRNQK

SEQ ID NO: 7898 - protein, 140 aa, Homo sapiens [sequence omitted]

SEQ ID NO: 7899 - protein, 108 aa, Homo sapiens
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLTGVNRCTGT

SEQ ID NO: 7900 - protein, 165 aa, Homo sapiens
MFFSAALRARAAGLTAHWGRHVRNLHKTAMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGNKGWGDYT

SEQ ID NO: 7901 - protein, 120 aa, Homo sapiens
  UNSURE 38: Xaa=Cys or Trp
  UNSURE 62: Xaa=Gly or Val
  UNSURE 119: Xaa=Ile or Met
  UNSURE 120: Xaa=Ala or Glu or Gly or Val
MNSSDEEKQLQLITSLKEQAIGEYEDLRAENQKTKEKXDKIRQERDEAVKKLEEFQKISHMXIEEVNFMQNHLEIEKTCRESAEALATKLNKENKTLKRISMLYMAKLGPDVITEEINXX

SEQ ID NO: 7902 - protein, 101 aa, Homo sapiens
MVEKKTSVRSQDPGQRRVLDRAARQRRINRQLEALENDNFQDDPHAGLPQLGKRLPQFDDDADTGKKKKKTRGDHFKLRFRKNFQALLEEQNLSVAEGLTT

SEQ ID NO: 7903 - protein, 101 aa, Homo sapiens
MAVVSAVRWLGLRSRLGQPLTGRRAGLCEQARSCRFYSGSATLSKVEGTDVTGIEEVVIPKKKTWDKVAVLQALASTVNRDTTAVPYVFQDDPYLMPAKHI

SEQ ID NO: 7904 - protein, 101 aa, Homo sapiens
MGKGDPKKPRGKMSSYAFFVQTCREEHKKKHPDASVNFSEFSKKCSERWKTMSAKEKGKFEDMAKADKARYEREMKTYIPPKGETKKKFKDPNAPKRPHCC

SEQ ID NO: 7905 - protein, 116 aa, Homo sapiens
MAEGNHRKKPLKVLESLGKDFLTGVLDNLVEQNVLNWKEEEKKKYYDAKTEDKVRVMADSMQEKQRMAGQMLLQTFFNIDQISPNKKAHPNMEAGPPESGESTDALKLCPHEEFWN

SEQ ID NO: 7906 - protein, 106 aa, Homo sapiens
  UNSURE 71: Xaa=Met or Arg
  UNSURE 72: Xaa=Glu or Gly or Lys or Arg
  UNSURE 92: Xaa=Gly or Val
MAEDADMRNELEEMQRRADQLADESLESTRRMLQLVEESKDAGIRTLVMLDEQGEQLERIEEGMDQINKDXXEAEKNLTDLGKFCGLCVCPXTSLNQVMLTKSLGQ

SEQ ID NO: 7907 - protein, 106 aa, Homo sapiens; identical to SEQ ID NO: 7906
  UNSURE 71: Xaa=Met or Arg
  UNSURE 72: Xaa=Glu or Gly or Lys or Arg
  UNSURE 92: Xaa=Gly or Val

SEQ ID NO: 7908 - protein, 119 aa, Homo sapiens
  UNSURE 24: Xaa=Asp or Glu
  UNSURE 92: Xaa=Gly or Arg
  UNSURE 96: Xaa=Glu or Gly
  UNSURE 119: Xaa=Pro or Thr
MAAIAASEVLVDSAEEGSLAAAAXLAAQKREQRLRKFRELHLMRNEARKLNHQEVVEEDKRLKLPANWEAKKARLEWELKEEEKKKECAARXEDYXKVKLLEISAEDAERWERKRRGKX

SEQ ID NO: 7909 - protein, 104 aa, Homo sapiens
  UNSURE 81: Xaa=Glu or Lys
  UNSURE 93: Xaa=Lys or Arg
MAALFLKRLTLQTVKSENSCIRCFGKHILQKTAPAQLSPIASAPRLSFLIHAKAFSTAEDTQNEGKKTKKNKTAFSNVGRXISQRVIHLFDEXAMIWETCTEQM

SEQ ID NO: 7910 - protein, 121 aa, Homo sapiens
  UNSURE 111: Xaa=Asp or His
  UNSURE 113: Xaa=Leu or Gln
  UNSURE 115: Xaa=Lys or Gln
MKVELCSFSGYKIYPGHGRRYARTDGKVFQFLNAKCESAFLSKRNPRQINWTVLYRRKHKKGQSEEIQKKRTRRAVKFQRAITGASLADIMAKRNQKPEVRKAQREQAIRXLXRXHLSKRL

SEQ ID NO: 7911 - protein, 108 aa, Homo sapiens
  UNSURE 97: Xaa=Ala or Glu or Gly or Val
  UNSURE 103: Xaa=Ser or Thr
  UNSURE 104: Xaa=Lys or Asn
  UNSURE 105: Xaa=Ala or Pro
MVNPTVFFDIAVDGEPLGRVSFELFADKVPKTAENFRALSTGEKGFGYKGSCFHRIIPGFMCQGGDFTRHNGTGGKSIYGEGQPAFVIKPSQRNLGXRDTARXXXRFQ

SEQ ID NO: 7912 - protein, 165 aa, Homo sapiens
  UNSURE 96: Xaa=Gly or Val
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPXILSMANAGPNTNGSQFFICTAKTEWLDGKHVVFGKVKEGMNIVEAMERFGSRNGKTSKKITIADCGQLE

SEQ ID NO: 7913 - protein, 149 aa, Homo sapiens [sequence omitted]

SEQ ID NO: 7914 - protein, 125 aa, Homo sapiens
  UNSURE 21: Xaa=Ile or Leu or Val
MAPAKKGGEKKKGRSAINEVXTREYTINIHKRIHGVGFKKRAPRALKEIRKFAMKEMGTPDVRIDTRLNKAVWAKGIRNVPYRIRVRLSRKRNEDEDSPNKLYTLVTYVPVTTFKNLQTVNVDEN

SEQ ID NO: 7915 - protein, 101 aa, Homo sapiens
  UNSURE 21: Xaa=Ile or Leu or Val
MAPAKKGGEKKKGRSAINEVXTREYTINIHKRIHGVGFKKRAPRALKEIRKFAMKEMGTPDVRIDTRLNKAVWAKGIRNVPYRIRVRLSRKRNEDEGLSIL

SEQ ID NO: 7916 - protein, 121 aa, Homo sapiens
MVDMMDLPRSRINAGMLAQFIDKPVCFVGRLEKIHPTGKMFILSDGEGKNGTIELMEPLDEEISGIVEVVGRVTAKATILCTSYVQFKEDSHPFDLGLYNEAVKIIHDFPQFYPLGIVQHD

SEQ ID NO: 7917 - protein, 105 aa, Homo sapiens
MVRTKTWTLKKHFVGYPTNSDFELKTAELPPLKNGEVLLEALFLTVDPYMRVAAKRLKEGDTMMGQQVAKVVESKNVALPKGTIVLASPGWTTHSISDGKDLESC

SEQ ID NO: 7918 - protein, 159 aa, Homo sapiens
MKNHLLFWGVLAVFIKAVHVKAQEDERIVLVDNKCKCARITSRIIRSSEDPNEDIVERNIRIIVPLNNRENISDPTSPLRTRFVYHLSDLCKKCDPTEVELDNQIVTATQSNICDEDSATETCYTYDRNKCYTAVVPLVYGGETKMVETALTPDACYPD

SEQ ID NO: 7919 - protein, 159 aa, Homo sapiens; identical to SEQ ID NO: 7918

SEQ ID NO: 7920 - protein, 144 aa, Homo sapiens
  UNSURE 118: Xaa=Glu or Lys
  UNSURE 132: Xaa= *  or Glu or Lys or Gln
MSTKNFRVSDGDWICPDKKCGNVNFARRTSCNRCGREKTTEAKMMKAGGTEIGKTLAEKSRGLFSANDWQCKTCSNVNWARRSECNMCNTPKYAKLEERTGYGGGFNERENVEYIERXNLMVNMMSLDVKRXNTEGKQLVLHLY

SEQ ID NO: 7921 - protein, 116 aa, Homo sapiens
MAGVLKKTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 7922 - protein, 104 aa, Homo sapiens [sequence omitted]

SEQ ID NO: 7923 - protein, 154 aa, Homo sapiens [sequence omitted]

SEQ ID NO: 7924 - protein, 122 aa, Homo sapiens
MAASRRLTKDNPPYDKGAFRIEINFPAEYPFKPPKITFKTKIYHPNIDEKGQVCLPVISAENWKPATKTDQVIQSLIALVNDPQPEHPLRADLAEEYSKDRKKFCKNAEEFTKKYGEKRPVD

SEQ ID NO: 7925 - protein, 209 aa, Homo sapiens
  UNSURE 178: Xaa=Gln or Arg
  UNSURE 183: Xaa=Gly or Arg
  UNSURE 186: Xaa= *  or Ala or Glu or Gly or Ile or Lys or Leu or Pro or Gln or Arg or Ser or Thr or Val
MSMLRLQKRLASSVLRCGKKKVWLDPNETNEIANANSRQQIRKLIKDGLIIRKPVTVHSRARCRKNTLARRKGRHMGIGKRKGTANARMPEKVTWMRRMRILRRLLRRYRESKKIDRHMYHSLYLKVKGNVFKNKRILMEHIHKLKADKARKKLLADQAEARRSKTKEARKRREERLXGQEGXRSXRLYPRRKRPRNKTSHFVCTYWPL

SEQ ID NO: 7926 - protein, 109 aa, Homo sapiens
  UNSURE 18: Xaa=Ser or Thr
  UNSURE 106: Xaa=His or Arg
MGGAGPERALSFRCCGRXMSMLRLQKRLASSVLRCGKKKVWLDPNETNEIANANSRQQIRKLIKDGLIIRKPVTVHSRARCRKNTLARRKGRHMGIGKRKGTANAXPSG

SEQ ID NO: 7927 - protein, 114 aa, Homo sapiens
MAQVLFSRNMRLNVALTFWRKRSISELVAYLLRIEDLGVVVDCLPVLTNCLQEEKQYISLGCCVDLLPLVKSLLKSKFEEYVIVGLNWLQAVIKRWWSELSSKTEIINDGNIQI

SEQ ID NO: 7928 - protein, 117 aa, Homo sapiens
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRASEWENGSGM

SEQ ID NO: 7929 - protein, 111 aa, Homo sapiens
  UNSURE 104: Xaa=Leu or Pro or Gln or Arg
MRIEKCYFCSGPIYPGHGMMFVRNDCKVFRFCKSKCHKNFKKKRNPRKVRWTKAFRKAAGKELTVDNSFEFEKRRNEPIKYQRELWNKTIDAMKRVEEIKQKRXAKFIMNR

SEQ ID NO: 7930 - protein, 131 aa, Homo sapiens
MNDTVTIRTRKFMTNRLLQRKQMVIDVLHPGKATVPKTEIREKLAKMYKTTPDVIFVFGFRTHFGGGKTTGFGMIYDSLDYAKKNEPKHRLARHGLYEKKKTSRKQRKERKNRMKKVRGTAKANVGAGKKK

SEQ ID NO: 7931 - protein, 227 aa, Homo sapiens
  UNSURE 147: Xaa=Glu or Lys
  UNSURE 157: Xaa=Ala or Thr
  UNSURE 172: Xaa=Lys or Met
  UNSURE 220: Xaa=Ala or Cys or Asp or Phe or Gly or His or Ile or Leu or Asn or Pro or Arg or Ser or Thr or Val or Tyr
MAAGMYLEHYLDSIENLPFELQRNFQLMRDLDQRTEDLKAEIDKLATEYMSSARSLSSEEKLALLKQIQEAYGKCKEFGDDKVQLAMQTYEMVDKHIRRLDTDLARFEADLKEKQIESSDYDSSSSKGKKSRTQKEKKAARARSKGXNSDEEAPKTXQKKLKLVRTSPEYGXPSVTFGSVHPSDVLDMPVDPNEPTYCLCHQVSYGEMIGCDTLIVPLSXSILPVWG

SEQ ID NO: 7932 - protein, 101 aa, Homo sapiens
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLAGFFLCIL

SEQ ID NO: 7933 - protein, 125 aa, Homo sapiens
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALLW

SEQ ID NO: 7934 - protein, 108 aa, Homo sapiens
  UNSURE 103: Xaa=Ala or Pro or Ser or Thr
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQXFSGHF

SEQ ID NO: 7935 - protein, 107 aa, Homo sapiens
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDELET

SEQ ID NO: 7936 - protein, 106 aa, Homo sapiens
  UNSURE 56: Xaa=Ile or Met
MYNTVWNMEDLDLEYAKTDINCGTDLMFYIEMDPPALPPKPPKPTTVANNGMNNNXSLQDAEWYWGDISREEVNEKLRDTADGTFLVRDASTKMHGDYTLTLGKGK

SEQ ID NO: 7937 - protein, 103 aa, Homo sapiens
  UNSURE 83: Xaa=Leu or Val
MYTAYHYVILVIAPVGSPGDEFCKQRLPQLNSKDNKFLTCTEEDGVLVYHHAQDVILEVIYTDPVDLSLGTVAEITGHQLMSXSTANAKKDPSCKTCNISVGR

SEQ ID NO: 7938 - protein, 117 aa, Homo sapiens
MKFVYKEEHPFEKRRSEGEKIRKKYPDRVPVIVEKAPKARIGDLDKKKYLVPSDLTVGQFYFLIRKRIHLRAEDALFFFVNNVIPPTSATMGQLYQEHHEEDFFLYIAYSDESVYGL

SEQ ID NO: 7939 - protein, 106 aa, Homo sapiens
  UNSURE 67: Xaa=Asp or Glu or Gly
  UNSURE 68: Xaa=His or Leu or Pro or Arg
MPCFSLSTMSFHPPVPQWVSCTRNTMKKTSFSTLPTVTKVSTVCEAAAPELEGGLILQRERWPPFLXXPPPSSSNTTSLIQDRHFLMFVAFSPASLRRGNGGVGIL

SEQ ID NO: 7940 - protein, 117 aa, Homo sapiens; identical to SEQ ID NO: 7938

SEQ ID NO: 7941 - protein, 125 aa, Homo sapiens [sequence omitted]

SEQ ID NO: 7942 - protein, 131 aa, Homo sapiens [sequence omitted]

SEQ ID NO: 7943 - protein, 149 aa, Homo sapiens
  UNSURE 8: Xaa=His or Leu
  UNSURE 21: Xaa=Pro or Thr
  UNSURE 143: Xaa= *  or Asp or Glu or Phe or His or Ile or Lys or Leu or Met or Asn or Gln or Val or Tyr
  UNSURE 144: Xaa= *  or Glu or Lys or Gln
  UNSURE 147: Xaa=Asp or Glu
MRHSNVQXRLVSSVSFLRCRXRKASPSSRPFPATCRTLFYILRSPPTATIDAMSGYSSDRDRGRDRGFGAPRFGGSRAGPLSGKKFGNPGEKLVKKKWNLDELPKFEKNFYQEHPDLARRTAQEVETYRRSKEITVRGHNCPXXVLXFL

SEQ ID NO: 7944 - protein, 172 aa, Homo sapiens
  UNSURE 101: Xaa=Asp or Asn
MASNFKKANMASSSQRKRMSPKPELTEEQKQEIREAFDLFDADGTGTIDVKELKVAMRALGFEPKKEEIKKMISEIDKEGTGKMNFGDFLTVMTQKMSEKXTKEEILKAFKLFDDDETGKISFKNLKRVAKELGENLTDEELQEMIDEADRDGDGEVSEQEFLRIMKKTSLY

SEQ ID NO: 7945 - protein, 106 aa, Homo sapiens
MPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 7946 - protein, 111 aa, Homo sapiens
  UNSURE 92: Xaa=His or Gln
MIINISHVWCCGEMKAIEDGNLEEMEEEVRLKKRKRRRNVDKDPAKEDVEKAKKRRGRPPAEKLSPNPPKLTKQMNAIIDTVINYKDSSGRXSVKSSFSYLQGKNYQNTMN

SEQ ID NO: 7947 - protein, 129 aa, Homo sapiens
MAKSLRSKWKRKMRAEKRKKNAPKEASRLKSILKLDGDVLMKDVQEIATVVVPKPKHCQEKMQCEVKDEKDDMKMETDIKRNKKTLLDQHGQYPIWMNQRQRKRLKAKREKRKGKSKAKAVKVAKGLAW

SEQ ID NO: 7948 - protein, 108 aa, Homo sapiens
MADPRVRQIKIKTGVVKRLVKEKVMYEKEAKQQEEKIEKMRAEDGENYDIKKQAEILQESRMMIPDCQRRLEAAYLDLQRILENEKDLEEAEEYKEARLVLDSVKLEA

SEQ ID NO: 7949 - protein, 111 aa, Homo sapiens
  UNSURE 72: Xaa=Cys or Phe or Gly or Val
MVRMNVLADALKSINNAEKRGKRQVLIRPCSKVIVRFLTVMMKHGYIGEFEIIDDHRAGKIVVNLTGRLNKXGVQWHDLGYCNLCLPGSSDSPASASLVAEITVWGDQPQI

SEQ ID NO: 7950 - protein, 132 aa, Homo sapiens
MVRMNVLADALKSINNAEKRGKRQVLIRPCSKVIVRFLTVMMKHGYIGEFEIIDDHRAGKIVVNLTGRLNKCGVISPRFDVQLKDLEKWQNNLLPSRQFGFIVLTTQLASWTMKKQDENTQEENPGILFLGM

SEQ ID NO: 7951 - protein, 155 aa, Homo sapiens
  UNSURE 16: Xaa=Ser or Thr
MVARKGQKSPRFRRVXCFLRLGRSTLLELEPAGRPCSGRTRHRALHRRLVACVTVSSRRHRKEAGRGRAESFIAVGMAAPSMKERQVCWGARDEYWKCLDENLEDASQCKKLRSSFESSCPQQWIKYFDKRRDYLKFKEKFEAGQFEPSETTAKS

SEQ ID NO: 7952 - protein, 127 aa, Homo sapiens
MIVSSALMIWKGLIVLTGSESPIVVVLSGSMEPAFHRGDLLFLTNFREDPIRAGEIVVFKVEGRDIPIVHRVIKVHEKDNGDIKFLTKGDNNEVDDRGLYKEGQNWLEKKDVVGRARGFLPYVVWSP

SEQ ID NO: 7953 - protein, 145 aa, Homo sapiens [sequence omitted]

SEQ ID NO: 7954 - protein, 128 aa, Homo sapiens
  UNSURE 42: Xaa=Asp or Asn
  UNSURE 43: Xaa=Ala or Val
  UNSURE 44: Xaa=Gly or Ser
  UNSURE 81: Xaa=Ile or Lys or Arg or Thr
  UNSURE 126: Xaa= *  or Ala or Cys or Asp or Glu or Phe or Gly or His or Ile or Lys or Leu or Asn or Pro or Gln or Arg or Ser or Thr or Val or Tyr
MESKEERALNNLIVENVNQENDEKDEKEQVANKGEPLALPLXXXEYCVPRGNRRRFRVRQPILQYRWDMMHRLGEPQARMXEENMERIGEEVRQLMEKLREKQLSHSLRAVSTDPPHHDHHDEFCXMP

SEQ ID NO: 7955 - protein, 128 aa, Homo sapiens; identical to SEQ ID NO: 7954
  UNSURE 42: Xaa=Asp or Asn
  UNSURE 43: Xaa=Ala or Val
  UNSURE 44: Xaa=Gly or Ser
  UNSURE 81: Xaa=Ile or Lys or Arg or Thr
  UNSURE 126: Xaa= *  or Ala or Cys or Asp or Glu or Phe or Gly or His or Ile or Lys or Leu or Asn or Pro or Gln or Arg or Ser or Thr or Val or Tyr

SEQ ID NO: 7956 - protein, 133 aa, Homo sapiens
MSGGGTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRLQAANDSVCRLQQREQERKRFIVTT

SEQ ID NO: 7957 - protein, 165 aa, Homo sapiens
MASGVQVADEVCRIFYDMKVRKCSTPEEIKKRKKAVIFCLSADKKCIIVEEGKEILVGDVGVTITDPFKHFVGMLPEKDCRYALYDASFETKESRKEELMFFLWAPELAPLKSKMIYASSKDAIKKKFQGIKHECQANGPEDLNRACIAEKLGGSLIVAFEGCPV

SEQ ID NO: 7958 - protein, 126 aa, Homo sapiens
  UNSURE 122: Xaa=His or Leu or Pro or Arg
MAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGXELES

SEQ ID NO: 7959 - protein, 126 aa, Homo sapiens
MKASGTLREYKVVGRCLPTPKCHTPPLYRMRIFAPNHVVAKSRFWYFVSQLKKMKKSSGEIVYCGQVFEKSPLRVKNFGIWLRYDSRSGTHNMYREYRDLTTAALSPSATETWVPGTAPEPTPFRS

SEQ ID NO: 7960 - protein, 122 aa, Homo sapiens
  UNSURE 79: Xaa= *  or Gly
  UNSURE 83: Xaa=Cys or Gly or Arg or Ser
MQLKPMEINPEMLNKVLSRLGVAGQWRFVDVLGLEEESLGSVPAPACALLLLFPLTAQHENFRKKQIEELKFSCWAVRXNSSXSSAVPRVCLLLQQCLDGTDPGTLFQPPTALRFPLRLPHL

SEQ ID NO: 7961 - protein, 114 aa, Homo sapiens
  UNSURE 79: Xaa= *  or Gly
  UNSURE 83: Xaa=Cys or Gly or Arg or Ser
MQLKPMEINPEMLNKVLSRLGVAGQWRFVDVLGLEEESLGSVPAPACALLLLFPLTAQHENFRKKQIEELKFSCWAVRXNSSXSSAVPRVCLLLQQCLDGTDPGTLFQPPTDPL

SEQ ID NO: 7962 - protein, 121 aa, Homo sapiens
  UNSURE 79: Xaa= *  or Gly
  UNSURE 83: Xaa=Cys or Gly or Arg or Ser
MQLKPMEINPEMLNKVLSRLGVAGQWRFVDVLGLEEESLGSVPAPACALLLLFPLTAQHENFRKKQIEELKFSCWAVRXNSSXSSAVPRVCLLLQQCLDGTDPGTLFQHTLEEAQLSFLIF

SEQ ID NO: 7963 - protein, 137 aa, Homo sapiens
  UNSURE 125: Xaa=Asp or Asn
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRXVLDFYNVPIQEI

SEQ ID NO: 7964 - protein, 151 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPKPTAAL

SEQ ID NO: 7965 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 7966 - protein, 126 aa, Homo sapiens
MPEPTKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 7967 - protein, 175 aa, Homo sapiens
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 7968 - protein, 250 aa, Homo sapiens
  UNSURE 16: Xaa=Asp or Glu
  UNSURE 38: Xaa=His or Gln
  UNSURE 39: Xaa=Ala or Ser
  UNSURE 53: Xaa=Glu or Gln
  UNSURE 60: Xaa=Glu or Gly
MTSAFKLDFLPDMMVXGRLLVPDRINGTANKMNGALDXXDQPDPDAIKMFVGXIPRSWSXKELTSQLTPHTHLATMDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 7969 - protein, 108 aa, Homo sapiens
MRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 7970 - protein, 142 aa, Homo sapiens
  UNSURE 108: Xaa=Ile or Val
MEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLXSRKPDWDLKRDVAKKLEKLKKRTQRAIAELIREG

SEQ ID NO: 7971 - protein, 108 aa, Homo sapiens [sequence omitted]

SEQ ID NO: 7972 - protein, 122 aa, Homo sapiens
  UNSURE 111: Xaa=His or Gln
  UNSURE 120: Xaa=Phe or Leu
MTKKRRNNGRAKKGRGHVQPIRCTNCARCVPKDKAIKKFVIRNIVEAAAVRDISEASVFDAYVLPKLYVKLHYCVSCAIHSKVVRNRSREARKDRTPPPRFRPAGAAPRPXQSPCKELSXKD

SEQ ID NO: 7973 - protein, 143 aa, Homo sapiens
MEEKKGISGYSYTQEELERVSALKSEVDEMKGRTLDDMSEMVKKLYSLVSEKKSALASVIKELRQLRQKYQELTQECDEKKSQYDSCAAGLESNRSKLEQEVRRLREECLQEESRYHYTNCMIKNLEVQLRRATDENEGIYLF

SEQ ID NO: 7974 - protein, 131 aa, Homo sapiens
  UNSURE 121: Xaa=Arg or Thr
MASMGTLAFDEYGRPFLIIKDQDRKSRLMGLEALKSHIMAAKAVANTMRTSLGPNGLDKMMVDKDGDVTVTNDGATILSMMDVDHQIAKLMVELSKSQDDEIGDGTTGVVVLAGALLEKRXIASRAFTQSE

SEQ ID NO: 7975 - protein, 143 aa, Homo sapiens [sequence omitted]

SEQ ID NO: 7976 - protein, 109 aa, Homo sapiens
MPVAVMAESAFSFKKLLDQCENQELEAPGGIATPPVYGQLLALYLLHNDMNNARYLWKRIPPAIKSANSELGGIWSVGQRIWQRDFPGIYTTINAHQWSETVQPIMEST

SEQ ID NO: 7977 - protein, 134 aa, Homo sapiens
MVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 7978 - protein, 121 aa, Homo sapiens
  UNSURE 65: Xaa=Ile or Lys or Arg or Thr
  UNSURE 75: Xaa=Ala or Pro or Ser or Thr
  UNSURE 84: Xaa= *  or Glu or Lys or Gln
  UNSURE 91: Xaa=Asp or Glu or Lys or Asn
  UNSURE 94: Xaa=Lys or Met
  UNSURE 95: Xaa=Gln or Arg
  UNSURE 105: Xaa=Lys or Arg
  UNSURE 106: Xaa=Asp or Glu
  UNSURE 112: Xaa=Glu or Val
MEAEVDKLELMFQKAESDLDYIQYRLEYEIKTNHPDSASEKNPVTLLKELSVIKSRYQTLYARFXPVAVEQKESXSRICATVKXTMNMIQXLQXXTDLELSPLTXXEKTAAXQFRFHMPDL

SEQ ID NO: 7979 - protein, 102 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 7980 - protein, 117 aa, Homo sapiens
  UNSURE 34: Xaa=Ile or Asn or Ser or Thr
MLGRGGCCRGAGDAPPQDPMEMAEVEETLKRLQXQKGVQGIIVVNTEGIPIKSTMDNHTTTQYASLMHSFILKARSTVRDIDPQNDLTFLRIRSKKNEIMVAPDKDYFLIVIQNPTE

SEQ ID NO: 7981 - protein, 110 aa, Homo sapiens
  UNSURE 104: Xaa= *  or Cys or Phe or Leu or Ser or Trp or Tyr
MAGGEAGVTLGQPHLSRQDLTTLDVTKLTPLSHEVISRQATINIGTIGHVAHGKSTVVKAISGVHTVRFKNELERNITIKLGYANAKIYKLDDPSCPRPECYRXLWEQYT

SEQ ID NO: 7982 - protein, 126 aa, Homo sapiens
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDPESWLRFSGPPGST

SEQ ID NO: 7983 - protein, 172 aa, Homo sapiens [sequence omitted]

SEQ ID NO: 7984 - protein, 107 aa, Homo sapiens
MKNFVTKVSVGEFVGEGEGKSKKISKKNAAIAVLEELKKLPPLPAVERVKPRIKKKTKPIVKPQTSPEYGQGINPISRLAQIQQAKKEKEQSTRSSQSEASRAAGSL

SEQ ID NO: 7985 - protein, 124 aa, Homo sapiens
  UNSURE 119: Xaa=Leu or Trp
MALSKRELDELKPWIEKTVKRVLGFSEPTVVTAALNCVGKGMDKKKAADHLKPFLDDSTLRFVDKLFEAVEEGRSSRHSKSSSDRSRKRELKEVFGDDSEISKESSGVKKRRIPRFEEXKKSQR

SEQ ID NO: 7986 - protein, 107 aa, Homo sapiens
MENHKSNNKENITIVDISRKINQLPEAERNLLENGSVYVGLNAALCGLIANSLFRRILNVTKARIAAGLPMAGIPFLTTDLTYRCFVSFPLNTGDLDCETCTITRSD

SEQ ID NO: 7987 - protein, 118 aa, Homo sapiens
  UNSURE 11: Xaa=Ser or Thr
  UNSURE 101: Xaa= *  or Cys or Phe or Leu or Ser or Tyr
MSGGLLKALRXDSYVELSQYRDQHFRGDNEEQEKLLKKSCTLYVGNLSFYTTEEQIYELFSKSGDIKKIIMGLDKMKKTACGFCLWNITHAQMRKTPCGTXMGRVWMTESFAQTGTQL

SEQ ID NO: 7988 - protein, 122 aa, Homo sapiens
MADEATRRVVSEIPVLKTNAGPRDRELWVQRLKEEYQSLIRYVENNKNADNDWFRLESNKEGTRWFGKCWYIHDLLKYEFDIEFDIPITYPTTAPEIAVPELDGKTAKMYSWVHGWQWKSLI

SEQ ID NO: 7989 - protein, 122 aa, Homo sapiens; identical to SEQ ID NO: 7988

SEQ ID NO: 7990 - protein, 112 aa, Homo sapiens
MPKFYCDYCDTYLTHDSPSVRKTHCSGRKHKENVKDYYQKWMEEQAQSLIDKTTAAFQQGKIPPTPFSAPPPAGAMIPPPPSLPGPPRPGMMPAPHMGGPPMMPMMGLLLLG

SEQ ID NO: 7991 - protein, 127 aa, Homo sapiens
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNWG

SEQ ID NO: 7992 - protein, 127 aa, Homo sapiens
  UNSURE 98: Xaa=Ile or Met
  UNSURE 112: Xaa=Asp or Glu
  UNSURE 123: Xaa=Ala or Pro or Ser or Thr
MEEVPHDCPGADSAQAGRGASCQGCPNQRLCASGAGATADTAIEEIKEKMKTVKHKILVLSGKGGVGKSTFSAHLAHGLAEDFGQGCQKVLLLEEKYXISLWFFLCIVFSRXRVSLCCPGWSXVARS

SEQ ID NO: 7993 - protein, 206 aa, Homo sapiens
  UNSURE 141: Xaa=Phe or Leu
  UNSURE 202: Xaa=Phe or Leu
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSXGGGTGSGFTSLLMERLSVDYGKKSKLEFSIYPAPQVSTAVVEPYNSILTTHTTLEHSDCAXHGRQ

SEQ ID NO: 7994 - protein, 206 aa, Homo sapiens
  UNSURE 141: Xaa=Phe or Leu or Pro or Ser
  UNSURE 142: Xaa=Cys or Gly
  UNSURE 202: Xaa=Phe or Leu
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLADQCTGLQGFLVFHSXXGGTGSGFTSLLMERLSVDYGKKSKLEFSIYPAPQVSTAVVEPYNSILTTHTTLEHSDCAXHGRQ

SEQ ID NO: 7995 - protein, 108 aa, Homo sapiens
MEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRRVPG

SEQ ID NO: 7996 - protein, 135 aa, Homo sapiens
  UNSURE 56: Xaa=Asp or Gly
MAFLASGPYLTHQQKVLRLYKRALRHLESWCVQRDKYRYFACLMRARFEEHKNEKXMAKATQLKEAEEEFWYRQHPQPYIFPDSPGGTSYERYDCYKVPEWCLDDWHPSEKAMYPDYFAKREQWKKLRGKLGTRG

SEQ ID NO: 7997 - protein, 204 aa, Homo sapiens [sequence omitted]

SEQ ID NO: 7998 - protein, 204 aa, Homo sapiens [sequence omitted]

SEQ ID NO: 7999 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 8000 - protein, 191 aa, Homo sapiens
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 8001 - protein, 191 aa, Homo sapiens
  UNSURE 11: Xaa=Asp or Glu or Gly
  UNSURE 26: Xaa=Asp or Gly or Asn or Ser
MQTIKCVVVGXGAVGKTCLLISYTTXKFPSEYVPAVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 8002 - protein, 103 aa, Homo sapiens
  UNSURE 18: Xaa=Ala or Pro or Ser or Thr
  UNSURE 23: Xaa= *  or Asp or Glu or Tyr
  UNSURE 49: Xaa=Gly or Val
MSRGSSAGFDRHITIFSXEGRLXQVEYAFKAINQGGLTSVAVRGKDCAXIVTQKKVPDKLLDSSTVTHLFKITENIGCVMTGMTADSRSQVISVLMNLKAIDL

SEQ ID NO: 8003 - protein, 112 aa, Homo sapiens
MAAPEEHDSPTEASQPIVEEEETKTFKDLGVTDVLCEACDQLGWTKPTKIQIEAIPLALQGRDIIGLAETGSGKTGAFALPILNALLETPQRLFALVLTPTRELAFQISEPV

SEQ ID NO: 8004 - protein, 130 aa, Homo sapiens
  UNSURE 66: Xaa=Phe or Leu
  UNSURE 81: Xaa=Gly or Arg
MAMEMRLPVARKPLSERLGRDTKKHLVVPGDTITTDTGFMRGHGTYMGEEKLIASVAGSVERVNKXICVKALKTRYIGEVXDIVVGRITEVQQKRWKVETNSRLDSVLLLSSMNLPGGELRRDLQKMSLQ

SEQ ID NO: 8005 - protein, 135 aa, Homo sapiens
  UNSURE 98: Xaa=Ala or Pro
  UNSURE 103: Xaa=Glu or Gly
  UNSURE 126: Xaa= *  or Leu or Ser or Trp
MAGHPKERVVTDEVHQNQILRELYLKELRTQKLHTQYHVNPLRKVHRITRKPMSWHDNLEEPADARFLNLIHHAAQGPTKKYPEAQTENQEIGWDSEXLVDPXRRDHRMNHFRVYSDITLYKAKMXDLGEDDRHK

SEQ ID NO: 8006 - protein, 180 aa, Homo sapiens
  UNSURE 174: Xaa=Asp or Glu or Gly or His or Gln or Arg
  UNSURE 175: Xaa= *  or Leu
MTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLXXGMEPG

SEQ ID NO: 8007 - protein, 109 aa, Homo sapiens
MSAAMRERFDRFLHEKNCMTDLLAKLEAKTGVNRSFIALGVIGLVALYLVFGYGASLLCNLIGFGYPAYISIKAIESPDQEHPVPEGKKILKGDGNMLKRHRSQHENAW

SEQ ID NO: 8008 - protein, 123 aa, Homo sapiens [sequence omitted]

SEQ ID NO: 8009 - protein, 120 aa, Homo sapiens
MWASELRGPGCADSLNAALAHSPLRNRQCRGFPGGGHSIQPLYTPRAPAAAPPPPHKMAAPIEETAAASPAPFCGRREICQHGKPLLRMHPSLETPLKGWSLGDHIKRKMPTTSTTSTRF

SEQ ID NO: 8010 - protein, 123 aa, Homo sapiens
MGAPGGKINRPRTELKKKLFKRRRVLNRERRLRHRVVGAVIDQGLITRHHLKKRASSARANITLSGKKRRKLLQQIRLAQKEKTAMEVEAPSKPARTSEPQLKRQKKTKAPQDVEMKDLEDES

SEQ ID NO: 8011 - protein, 113 aa, Homo sapiens
MTVKTEAAKGTLTYSRMRGMVAILIAFMKQRRMGLNDFIQKIANNSYACKHPEVQSILKISQPQEPELMNANPSPPPSPSQQINLGPSSNPHAKPSDFHFLKVIGKGSLERFF

SEQ ID NO: 8012 - protein, 119 aa, Homo sapiens
MASGLVRLLQQGHRCLLAPVAPKLVPPVRGVKKGFRAAFRFQKELERQRLLRCPPPPVRRSEKPNWDYHAEIQAFGHRLQENFSLDLLKTAFVNSCYIKSEEAKRQQLGIGERSCSSES

SEQ ID NO: 8013 - protein, 114 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDQNTLST

SEQ ID NO: 8014 - protein, 109 aa, Homo sapiens
MAASAARGAAALRRSINQPVAFVRRIPWTAASSQLKEHFAQFGHVRRCILPFDKETGFHRGLGWVQFSSEEGLRNALQQENHIIDGVKVQVHTRRPKLPQTSDDEKKDF

SEQ ID NO: 8015 - protein, 131 aa, Homo sapiens
MAPKGSSKQQSEEDLLLQDFSRNLSAKSSALFFGNAFIVSAIPIWLYWRIWHMDLIQSAVLYSVMTLVSTYLVAFAYKNVKFVLKHKVAQKREDAVSKEVTRKLSEADNRKMSRKEKDERILWKKNEVAAL

SEQ ID NO: 8016 - protein, 105 aa, Homo sapiens [sequence omitted]

SEQ ID NO: 8017 - protein, 105 aa, Homo sapiens
  UNSURE 93: Xaa=Asp or Gly
MADEEEDPTFEEENEEIGGGAEGGQGKRKRLFSKELRCMMYGFGDDQNPYTESVDILEDLVIEFITEMTHKAMSIGRQGRVQVEDIVFLIRKXPRKFARLKTCLL

SEQ ID NO: 8018 - protein, 112 aa, Homo sapiens
  UNSURE 101: Xaa=Ala or Gly
  UNSURE 102: Xaa=Ala or Pro
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNXXTCKNRKSSYS

SEQ ID NO: 8019 - protein, 103 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQARTFS

SEQ ID NO: 8020 - protein, 111 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEENFYLEPYLKEVIRERKEREEWAKK

SEQ ID NO: 8021 - protein, 151 aa, Homo sapiens [sequence omitted]

SEQ ID NO: 8022 - protein, 180 aa, Homo sapiens
  UNSURE 8: Xaa=Ala or Val
  UNSURE 78: Xaa=Phe or Ser
  UNSURE 170: Xaa=Asp or His or Asn or Tyr
MLPAVGSXDEEEDPAEEDCPELVPIETTQSEEEEKSGLGAKIPVTIITGYLGAGKTTLLNYILTEQHSKRVAVILNEXGEGSALEKSLAVSQGGELYEEWLELRNGCLCCSVKDNGLRAIENLMQKKGKFDDILLETTGLADPGAVTSMFWVDAELGSDIYLDGIITIVXSKYGLKVKYH

SEQ ID NO: 8023 - protein, 160 aa, Homo sapiens
  UNSURE 123: Xaa=Ile or Met
MKVHFLILSTSCDKFQFLFKSIELKSPCCFEILEESPLIQGTLTVGATAGSITMKRLVCVLLVCSSAVAQLHKDPTLDHHWHLWKKTYGKQYKEKNEEAVRRLIWEKNLKFVMLHNLEHSMGXHSYDLGMNHLGDMTSEEVMSLMSSLRVPSQWQRKYHI

SEQ ID NO: 8024 - protein, 104 aa, Homo sapiens
MSHTILLVQPTKRPEGRTYADYESVNECMEGVCKMYEEHLKRMNPNSPSITYDISQLFDFIDDLADLSCLVYRADTQTYQPYNKDWIKEKIYVLLRRQAQQAGK

SEQ ID NO: 8025 - protein, 149 aa, Homo sapiens
MTEPGASPEDPWVKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPMKGRTGL

SEQ ID NO: 8026 - protein, 102 aa, Homo sapiens
  UNSURE 86: Xaa=Ala or Glu or Gly or Val
MVRYRVRSLSERSHEVYRQQLHGQEQGHHGQEEQGLSPEHVEVYERTHGQSHYRRRHCSRRRLHRIHRRQIAPAEGAKDAPAGTGXGIAEAAEPGREHAEGH

SEQ ID NO: 8027 - protein, 263 aa, Homo sapiens [sequence omitted]

SEQ ID NO: 8028 - protein, 210 aa, Homo sapiens
  UNSURE 12: Xaa=Cys or Gly
MVLAGDEVKKIXMQRFIKIDGKVRTDITYPAGFMDVISIDKTGENFRLIYDTKGRFAVHRITPEEAKYKLCKVRKIFVGTKGIPHLVTHDARTIRYPDPLIKVNDTIQIDLETGKITDFIKFDTGNLCMVTGGANLGRIGVITNRERHPGSFDVVHVKDANGNSFATRLSNIFVIGKGNKPWISLPRGKGIRLTIAEERDKRLAAKQSSG

SEQ ID NO: 8029 - protein, 140 aa, Homo sapiens
  UNSURE 5: Xaa=Pro or Thr
  UNSURE 102: Xaa=Lys or Gln
MVPWXPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSXDRTETEKAGRKGTKIKRGHGYHMVIEEQMEKQAEIVGM

SEQ ID NO: 8030 - protein, 111 aa, Homo sapiens
MVVTRSARAKASIQAASAESSGQKSFAANGIQAHPESSTGSDARTTAESQTTGKQSLIPRTPKARKRKSRTTGSLPKGTEPSTDGETSEAESNYSVSEHMIHFKGTRRGRS

SEQ ID NO: 8031 - protein, 112 aa, Homo sapiens
MAVTTRLTWLHEKILQNHFGGKRLSLLYKGSVHGFRNGVLLDRCCNQGPTLTVIYSEDHIIGAYAEESYQEGKYASIILFALQDTKISEWKLGLCTPETLFCCDVTKYNSPT

SEQ ID NO: 8032 - protein, 128 aa, Homo sapiens
MAGNLLSGAGRRLWDWVPLACRSFSLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 8033 - protein, 152 aa, Homo sapiens
  UNSURE 107: Xaa=Ile or Met
  UNSURE 108: Xaa=Ala or Thr
MGKQKKTRKYATMKRMLSLRDQRLKEKDRLKPKKKEKKDPSALKEREVPQHPSCLFFQYNTQLGPPYHILVDTNFINFSIKAKLDLVQSMMDCLYAKCIPCITDCVXXEIEKLGQKYRVALRIAKDPRFERLPCTHKGTYADDCLSTESNSA

SEQ ID NO: 8034 - protein, 116 aa, Homo sapiens
  UNSURE 6: Xaa=Asp or Val
  UNSURE 99: Xaa=Cys or Phe or His or Leu or Pro or Arg or Ser or Tyr
MSESLXVCDVAEDLVEKLRKFRFRKETNNAAIIMKIDKDKRLVVLDEELEGISPDELKDELPERQPRTFIVYSYKYQHDDGRVSYPLCFIFSSPVGCKXEQQMMYAGSKNKASPDS

SEQ ID NO: 8035 - protein, 129 aa, Homo sapiens
  UNSURE 120: Xaa=Cys or Gly or Arg or Ser
MANKGPSYGMSREVQSKIEKKYDEELEERLVEWIIVQCGPDVGRPDRGRLGFQVWLKNGVILSKLVNSLYPDGSKPVKVPENPPSMVFKQMEQVAQFLKAAEDYGVIKTDMFQTVDLFEXKTWQQCRGP

SEQ ID NO: 8036 - protein, 109 aa, Homo sapiens
  UNSURE 87: Xaa=Pro or Ser
MAAEEEDEVEWVVESIAGFLRGPDWSIPILDFVEQKCEVFDDEEESKLTYTEIHQEYKELVEKLLEGYLKEIGINEDQFQEACTSPXCKDPYITGHFATCVGSRRFYYL

SEQ ID NO: 8037 - protein, 105 aa, Homo sapiens
MVKQIESKTAFQEALDAAGDKLVVVDFSATWCGPCKMIKPFFHSLSEKYSNVIFLEVDVDDCQDVASECEVKCMPTFQFFKKGQKVGEFSGANKEKLEATINELV

SEQ ID NO: 8038 - protein, 132 aa, Homo sapiens
  UNSURE 77: Xaa=Ala or Asp or Glu or Gly or Val
  UNSURE 128: Xaa=His or Gln
  UNSURE 131: Xaa=Glu or Lys
MVEAFCATWKLTNSQNFDEYMKALGVGFATRQVGNVTKPTVIISQEGDKVVIRTLSTFKNTEISFQLGEEFDETTAXYRNCKSVVSLDGDKLVHIQKWDGKETNFVREIKDGKMVMTLTFGDVVAVRXYEXA

SEQ ID NO: 8039 - protein, 121 aa, Homo sapiens
MKRFYLPGTSRPPIIVSEFRNEIYDVRHRAAYHPDFPTVLTALEIDNAVVANSLIDMRGIETVLLIKNNSVARAVMQSQKPPKNCREAFTADGDQVFAGRYYSSENTRPKFLSRDVDSENK

SEQ ID NO: 8040 - protein, 138 aa, Homo sapiens
  UNSURE 68: Xaa=Lys or Asn
METSAPRAGSQVVATTARHSAAYRADPLRVSSRDKLTEMAASSQGNFEGNFESLDLAEFAKKQPWWRXCSGRNLDLQQKSIAWQPSCSLEVSLDGAQVSYSRRLESWLQQLWEVDFFSFSLQTILGTSKLTGNEWRRT

SEQ ID NO: 8041 - protein, 129 aa, Homo sapiens
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 8042 - protein, 125 aa, Homo sapiens
  UNSURE 121: Xaa=His or Gln
MEPDGTYEPGFVGIRFCQECNNMLYPKEDKENRILLYACRNCDYQQEADNSCIYVNKITHEVDELTQIIADVSQDPTLPRTEDHPCQKCGHKEAVFFQSHSARAEDAMRLYYVCTAPHCGXRWTE

SEQ ID NO: 8043 - protein, 106 aa, Homo sapiens
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 8044 - protein, 101 aa, Homo sapiens
  UNSURE 10: Xaa=Ala or Gly
  UNSURE 38: Xaa=His or Gln
  UNSURE 74: Xaa=Cys or Tyr
MAAWSPAAAXLSSAGSAGFHFTIGCLPLSTEGELRVTXILKEKFPRATAIKVTDISGTKRRNQRDAWIADIYLXPQTLTTPWLHRCCCLRPWMNFTDIILP

SEQ ID NO: 8045 - protein, 105 aa, Homo sapiens
MGERLAKASHESKASEIEYKLGKVNDRWQHLLDLIAARVKKLKETLVAVQQLDKNMSSLRTWLAHIESELAKPIVYDSCNSEEIQRWICSSLILNIFLSVMFKLK

SEQ ID NO: 8046 - protein, 101 aa, Homo sapiens
  UNSURE 70: Xaa=Lys or Asn
  UNSURE 81: Xaa=Ala or Asp or Glu or Gly or Ile or Lys or Met or Asn or Arg or Ser or Thr or Val
  UNSURE 82: Xaa=Ala or Pro or Ser or Thr
MDRRNDYGYRVPLFQGPLPPPGSLGLPFPPDIQTETTEEDSVLLMHTLLAATKDSLAMDPPVVNRPKKSXTKKAPIKTITXXAPAAPPVQLPMRLPPTSPK

SEQ ID NO: 8047 - protein, 122 aa, Homo sapiens
  UNSURE 99: Xaa=Asp or Glu
  UNSURE 100: Xaa=Ala or Glu or Gly or Val
MKPEMWGKCLDCINELMDILFANPNIFVGENILEESENLHNADQPLRVRGCILTLVERMDEEFTKIMQNTDPHSQEYVEHLKDEAQVCAIIERVQRYLXXEGHYRGGLPHLPAAHPAHLLQV

SEQ ID NO: 8048 - protein, 111 aa, Homo sapiens
  UNSURE 51: Xaa=Glu or Gly
  UNSURE 54: Xaa=Gly or Ser
  UNSURE 58: Xaa=Asp or Gly
  UNSURE 59: Xaa=Asp or Glu or Lys or Asn
MQSSWHVVSRIFWIEEVIGSIPLKAMELAIVCFLIEGPFVRMLKICVPFKXKAXFKSXXQKYPFSFSMVYFSRFSVPPSVVKSFLYSWQCQEYWFEKLLAYLEFGLVNLVF

SEQ ID NO: 8049 - protein, 124 aa, Homo sapiens
  UNSURE 116: Xaa=Gly or Arg
MPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEASRSGAFLSLMIXYSSADHCK

SEQ ID NO: 8050 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 8051 - protein, 161 aa, Homo sapiens
  UNSURE 108: Xaa=Lys or Met or Arg or Thr
  UNSURE 109: Xaa=Lys or Asn or Thr
  UNSURE 145: Xaa=Lys or Arg
  UNSURE 156: Xaa=Ser or Thr
  UNSURE 159: Xaa=Lys or Pro or Gln or Thr
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVXXYEQGFITDPVVLSPKDRVRDVFEARPAWFLRYPNHXHRPDGEPLVAXSPXGH

SEQ ID NO: 8052 - protein, 126 aa, Homo sapiens
MADEIAKAQVARPGGDTIFGKIIRKEIPAKIIFEDDRCLAFHDISPQAPTHFLVIPKKHISQISVAEDDDESLLGHLMIVGKKCAADLGLNKGYRMVVNEGSDGGQSVYHVHLHVLGGRQMHWPPG

SEQ ID NO: 8053 - protein, 106 aa, Homo sapiens
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 8054 - protein, 154 aa, Homo sapiens
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 8055 - protein, 107 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGT

SEQ ID NO: 8056 - protein, 122 aa, Homo sapiens
MAEKPKLHYFNARGRMESTRWLLAAAGVEFEEKFIKSAEDLDKLRNDGYLMFQQVPMVEIDGMKLVQTRAILNYIASKYNLYGKDIKERALIDMYIEGIADLGEMILLLPVCPPEEKMPSLP

SEQ ID NO: 8057 - protein, 104 aa, Homo sapiens
  UNSURE 33: Xaa=Ile or Lys
  UNSURE 38: Xaa=Asp or His or Asn or Tyr
  UNSURE 64: Xaa=Arg or Ser
  UNSURE 65: Xaa= *  or Lys
  UNSURE 67: Xaa= *  or Leu or Gln
  UNSURE 89: Xaa=Ala or Glu
  UNSURE 90: Xaa=Asp or Glu
  UNSURE 91: Xaa=Ala or Val
MTFRATDSEFDLTNIEEYAENSALSRLNNIKAXQRVSXVTSTENESDTQILTFRHITKAQEKTXXRXQPIKLEPLVSSKTIVLASVATXXXVKLLWRIEVMSRL

SEQ ID NO: 8058 - protein, 108 aa, Homo sapiens
  UNSURE 81: Xaa=Asp or Glu or Gly
  UNSURE 105: Xaa=Ile or Lys
MIHSLFLINCSGDIFLEKHWKSVVSQSVCDYFFEAQEKAADVENVPPVISTPHHYLISIYRDKLFFVSVIQTEVPPLFVIXVPTSELLTLFRTTLVSVQRLQLRXMWS

SEQ ID NO: 8059 - protein, 127 aa, Homo sapiens
  UNSURE 122: Xaa=Ala or Thr
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPESAPLKSKMIYASSKXPSRRS

SEQ ID NO: 8060 - protein, 128 aa, Homo sapiens
  UNSURE 9: Xaa=Ala or Val
MAGSGVRQXTSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 8061 - protein, 120 aa, Homo sapiens
  UNSURE 115: Xaa=Cys or Gly or Arg or Ser
MAAAVAAAGAGEPQSPDELLPKGDAEKPEEELEEDDDEELDETLSERLWGLTEMFPERVRSAAGATFDLSLFVAQKMYRFSRAALWIGTTSFMILVLPVVFETEKLQMEQQQQLXSGRYF

SEQ ID NO: 8062 - protein, 129 aa, Homo sapiens
MKMFESADSTATRSGQDLWAEICSCLPNPEQEDGANNAFSDSFVDSCPEGEGQREVADFAVQPAVKPWAPLQDSEVYLASLEKKLRRIKGLNQEVTSKDMLRTLGPSQEGMLGSVPPGEVSFRVLCGWT

SEQ ID NO: 8063 - protein, 106 aa, Homo sapiens
  UNSURE 104: Xaa=Arg or Thr
MGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRXCT

SEQ ID NO: 8064 - protein, 113 aa, Homo sapiens
  UNSURE 36: Xaa=Cys or Ser
  UNSURE 51: Xaa=Pro or Thr
  UNSURE 108: Xaa=Leu or Met or Val
MAAIPPDSWQPPNVYLETSMGIIVLELYWKHAPKTXKNFAELARRGYYNGXKFHRIIKDFMIQGGDPTGTGRGGASIYGKQFEDELHPDLKFTGAEFSQWPMRGQIPXAASSL

SEQ ID NO: 8065 - protein, 105 aa, Homo sapiens
  UNSURE 74: Xaa=Ile or Lys
  UNSURE 75: Xaa=Asp or Glu
  UNSURE 80: Xaa=Asp or Glu
MRQPYLSSREVSSSRKRWRTFPVDCVAMCGDCVEKEYPNRGNTCLENGSFLLNFTGCAVCSKRDFMLITNKSLXXEDGEXIVTYDRVYHAVSVMRQSRRYYQYSP

SEQ ID NO: 8066 - protein, 122 aa, Homo sapiens
MPHPYSRNENNGGRGAEDSSMQLTTRRQKAEAGVLENLAVLEFTLTPPRSSAAEPSSPALPGARWRWFCCQLGETELGHARWRRPPCCVPFPGCWPPPGSRAALQCDQSSTCESRRMPNLTG

SEQ ID NO: 8067 - protein, 166 aa, Homo sapiens
  UNSURE 47: Xaa=Lys or Arg
MLFNNKEKYTFEEIQQETDIPERELVRALQSLACGKPTQRVLTKEPXSKEIENGHIFTVNDQFTSKLHRVKIQTVAAKQGESDPERKETRQKVDDDRKHEIEAAIVRIMKSRKKMQHNVLVAEVTQQLKARFLPSPVVIKKRIEGLIEREYLARTPEDRKVYTYVA

SEQ ID NO: 8068 - protein, 126 aa, Homo sapiens
MAASRYRRFLKLCEEWPVDETKRGRDLGAYLRQRVAQAFREGENTQVAEPEACDQMYESLARLHSNYYKHKYPRPRDTSFSGLSLEEYKLILSTDTLEELKEIDKGMWKKLQEKFAPKGPEEDHKA

SEQ ID NO: 8069 - protein, 147 aa, Homo sapiens
  UNSURE 109: Xaa=Ile or Asn
MGHFTEEDKATITSLWGKVNVEDAGGETLGRLLVVYPWTQRFFDSFGNLSSASAIMGNPKVKAHGKKVLTSLGDAIKHLDDLKGTFAQLSELHCDKLHVDPENFKLLGXVLVTVLAIHFGKEFTPEVQASWQKMVTAVASALSSRYH

SEQ ID NO: 8070 - protein, 134 aa, Homo sapiens
  UNSURE 131: Xaa=Ile or Asn
MAGSRLETVGSIFSRTRDLVRAGVLKEKPLWFDVYDAFPPLREPVFQRPRVRYGKAKAPIQDIWYHEDRIRAKFYSVYGSGQRAFDLFNPNFKSTCQRFVEKYTELQKLGETDEEKLFVETGKALLAEGVXLRR

SEQ ID NO: 8071 - protein, 118 aa, Homo sapiens
MDVFLMIRRHKTTIFTDAKESSTVFELKRIVEGILKRPPDEQRLYKDDQLLDDGKTLGECGFTSQTARPQAPATVGLAFRADDTFEALCIEPFSSPPELPDVMKPQDSGSSANEQAVQ

SEQ ID NO: 8072 - protein, 118 aa, Homo sapiens; identical to SEQ ID NO: 8071

SEQ ID NO: 8073 - protein, 110 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSLVFWRLL

SEQ ID NO: 8074 - protein, 145 aa, Homo sapiens
  UNSURE 10: Xaa=His or Gln
  UNSURE 112: Xaa=Ile or Leu
MQAFLNVLDXCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPXLKLEKELLKQIKLDPSPQTIYKWIKDNISPKLM

SEQ ID NO: 8075 - protein, 116 aa, Homo sapiens
  UNSURE 31: Xaa=Lys or Asn
MGYAAKAMKAAHDNMDIDKVDELMQDIADQXELAEEISTAISKPVGFGEEFDEDELMAELEELEQEELDKNLLEISGPETVPLPNVPSIALPSKPAKKKEEEDDDMKELENWAGSM

SEQ ID NO: 8076 - protein, 104 aa, Homo sapiens
  UNSURE 9: Xaa=Asp or Glu
  UNSURE 12: Xaa=Glu or Gly
MNSELDYYXKFXEVHGILMYKDFVKYWDNVEAFQARPDDLVIATYPKSGTTWVSEIVYMIYKEGDVEKCKEDVIFNRIPFLECRKENLMNGNVQVDFKNYLHIF

SEQ ID NO: 8077 - protein, 112 aa, Homo sapiens
MGTRDDEYDYLFKVVLIGDSGVGKSNLLSRFTRNEFNLESKSTIGVEFATRSIQVDGKTIKAQIWDTAGQERYRAITSAYYRGAVGALLVYDIAKHLTYENVERSERTERSC

SEQ ID NO: 8078 - protein, 114 aa, Homo sapiens
  UNSURE 62: Xaa=Leu or Gln
  UNSURE 76: Xaa=Lys or Arg
  UNSURE 94: Xaa=His or Asn
  UNSURE 111: Xaa=Ile or Ser
  UNSURE 112: Xaa=Ile or Lys or Met or Asn or Arg or Ser or Thr
MGTPQKDVIIKSDAPDTLLLEKHADYIASYGSKKDDYEYCMSEYLRMSGIYWGLTVMDLMGXLHRMNREEILAFIXSCQHECGGISASIGHDPXLLYTLSAVQILTLYDSXXCY

SEQ ID NO: 8079 - protein, 141 aa, Homo sapiens
  UNSURE 95: Xaa=Ala or Val
  UNSURE 127: Xaa=Asp or Asn
METAGAATGQPASGLEAPGSTNDRLFLVKGGIFLGTVAAAGMLAGFITTLSLAKKKSPEWFNKGSMATAALPESGSSLALRALGWGSLYAWCGVXVISFAVWKALGVHSMNDFRSKMQSIFPTIPKXSESAVEWEETLKSK

SEQ ID NO: 8080 - protein, 129 aa, Homo sapiens
  UNSURE 16: Xaa=Asp or Glu
  UNSURE 100: Xaa=Lys or Arg
  UNSURE 103: Xaa= *  or Ala or Glu or Gly or Ile or Lys or Leu or Pro or Gln or Arg or Ser or Thr or Val
  UNSURE 104: Xaa=Ala or Asp or Gly or Ile or Asn or Ser or Thr or Val
  UNSURE 105: Xaa=His or Leu or Pro or Arg
  UNSURE 111: Xaa= *  or Leu
  UNSURE 121: Xaa=Ile or Val
MERSEYLGRGARCIAXQAEDVRVEGSFPVTMLPGDGVGPELMHAVKEVFKAAAVPVEFQEHHLSEVQNMASEEKLEQVLSSMKENKVAIIGKIHTPMEYXGAXXXPMICGXGVSWTYLPRXHVSHFLGI

SEQ ID NO: 8081 - protein, 106 aa, Homo sapiens
MMATGTPESQARFGQSVKGLLTEKVTTCGTDVIALTKQVLKGSRSSELLGQAARNMVLQEDAILHSEDSLRKMAIITTHLQYQQEAIQKNVEQSSDLQDQLNHLLK

SEQ ID NO: 8082 - protein, 103 aa, Homo sapiens
MMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 8083 - protein, 102 aa, Homo sapiens
  UNSURE 60: Xaa=His or Arg
MLRAGAPTGDLPRAGEVHTGTTIMAVEFDGGVVMGSDSRVSAGEAVVNRVFDKLSPLHEXIYCALSGSAADAQAVADMAAYQLELHGIELEELHLFWLLQMW

SEQ ID NO: 8084 - protein, 128 aa, Homo sapiens
  UNSURE 85: Xaa=Pro or Thr
  UNSURE 125: Xaa=Ala or Val
MADILSQSETLASQDLSGDFKKPALPVSPAARSKAPASSSSNPEEVQKEGPTALQDSNSGEPDIPPPQPDCGDFRSLQEEQSRPXTAVSSPGGPARAPPYQEPPWGGPATAPYSLETLKAALSLXPVA

SEQ ID NO: 8085 - protein, 111 aa, Homo sapiens
  UNSURE 40: Xaa=Phe or Leu
  UNSURE 108: Xaa=His or Leu or Pro or Gln or Arg
MERDRRKRSASSISSTLLDTSPWLQTLEVSLADQQEDSQXSLFKRSPDTGHPLPAPAASARRHQCSEAVAWCSVEHPRRGPFCCLSRLTPLHHTSWPSLLPFPRIVKXDSH

SEQ ID NO: 8086 - protein, 108 aa, Homo sapiens
MILQRLFRFSSVIRSAVSVHLRRNIGVTAVAFNKELDPIQKLFVDKIREYKSKRQTSGGPVDASSEYQQELERELFKLKQMFGNADMNTFPTFKFEDPKFEVIEKPQA

SEQ ID NO: 8087 - protein, 118 aa, Homo sapiens
MSLLNKPKSEMTPEELQKREEEEFNTGPLSVLTQSVKNNTQVLINCRNNKKLLGRVKAFDRHCNMVLENVKEMWTEVPKSGKGKKKSKPVNKDRYISKMFLRGDSVIVVLRNPLIAGK

SEQ ID NO: 8088 - protein, 118 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEDSQQIPSLQD

SEQ ID NO: 8089 - protein, 119 aa, Homo sapiens
MALNKNHSEGGGVIVNNTESILMSYDHVELTFNDMKNVPEAFKGTKKGTVYLTPYRVIFLSKGKDAMQSFMMPFYLMKDCEIKQPVFGANYIKGTVKAEAGGGWEGSASYKLTFTAGRH

SEQ ID NO: 8090 - protein, 109 aa, Homo sapiens
MTVHNLYLFDRNGVCLHYSEWHRKKQAGIPKEEEYKLMYGMLFSIRSFVSKMSPLDMKDGFLAFQTSRYKLHYYETPTGIKVVMNTDLGVGPIRDVLHHIYSALLWSWW

SEQ ID NO: 8091 - protein, 122 aa, Homo sapiens
  UNSURE 87: Xaa=Asp or Gly
  UNSURE 98: Xaa=Asn or Thr
MTVHNLYLFDRNGVCLHYSEWHRKKQAGIPKEEEYKLMYGMLFSIRSFVSKMSPLDMKDGFLAFQTSRYKLHYYETPTGIKVVMNTXLGVGPSEMCCXTSTVRCCGAGGEESPVPAGPNCAK

SEQ ID NO: 8092 - protein, 119 aa, Homo sapiens
  UNSURE 110: Xaa=Cys or Tyr
  UNSURE 115: Xaa=Glu or Gly
  UNSURE 116: Xaa=Gly or Arg or Ser
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMLXGKGLXXSRL

SEQ ID NO: 8093 - protein, 144 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMAAIRRPAPSCAAEACDGEEEADPPHQELLSPLPPEQ

SEQ ID NO: 8094 - protein, 112 aa, Homo sapiens
  UNSURE 22: Xaa=Ala or Glu
  UNSURE 32: Xaa=Ile or Asn
  UNSURE 43: Xaa=His or Gln
  UNSURE 57: Xaa=His or Gln
  UNSURE 64: Xaa=Leu or Met or Val
MLWANSNSNGLIHRKTVGVEPXADGKGVVVVXKRRSGQAEAGXLLCADHHQQECSRXAQQHQTXIRKNKYRPDLRMAAIRRPAPSCAAEACDGEEEADPPHQELLSPLPPEQ

SEQ ID NO: 8095 - protein, 120 aa, Homo sapiens
  UNSURE 49: Xaa=Leu or Arg
  UNSURE 106: Xaa=Ile or Lys or Met or Asn or Arg or Ser or Thr
MLKKCLKKYWGEGNSSQQDCGHYWSYYFDVPWKAQKSSKEDISYFDLHXFLKEKWSLPPVQFTRAFSLPCPPFLVAVARKDAEAVWFTKCLNLAVNDNCQTHVEGXFLLIHKKEDSLPTS

SEQ ID NO: 8096 - protein, 147 aa, Homo sapiens
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTSMTFFSSHLGTI

SEQ ID NO: 8097 - protein, 116 aa, Homo sapiens
MKHYEVEILDAKTREKLCFLDKVEPHATIAEIKNLFTKTHPQWYPARQSLRLDPKGKSLKDEDVLQKLPVGTTATLYFRDLGAQISWVTVFLTEYAGPFSSTCSSTSECPSSMAQI

SEQ ID NO: 8098 - protein, 131 aa, Homo sapiens
  UNSURE 8: Xaa=Ala or Val
  UNSURE 11: Xaa=Cys or Phe or Gly or Val
  UNSURE 31: Xaa=Lys or Met or Arg or Thr
MILQETKXACXIPAIPHCSRVEILDAKTREXLCFLDKVEPHATIAEIKNLFTKTHPQWYPARQSLRLDPKGKSLKDEDVLQKLPVGTTATLYFRDLGAQISWVTVFLTEYAGPFSSTCSSTSECPSSMAQI

SEQ ID NO: 8099 - protein, 108 aa, Homo sapiens
  UNSURE 72: Xaa=Phe or Ser
MVNLGLSRVDDAVAAKHPGLGEYAACQSHAFMKGVFTFVTGTGMAFGLQMFIQRKFPYPLQWSLLVAVVAGXVVSYGVTRVESEKCNNLWLFLETGQLPKDRSTDQRS

SEQ ID NO: 8100 - protein, 101 aa, Homo sapiens
  UNSURE 67: Xaa=Gly or Ser
MVYLVNLSEKDYIRKKNKCGALELKLQELSAEERQKYLEANMTQSALPKIIKAGFAALQLEYFFTAXPDEVRAWTIRKGTKAPQAAGKIHTDFEKGFIWLK

SEQ ID NO: 8101 - protein, 124 aa, Homo sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 8102 - protein, 104 aa, Homo sapiens
  UNSURE 39: Xaa= *  or Gly or Arg
MEDHQHVPIDIQTSKLLDWLVDRRHCSLKWQSLVLTIRXEDQCCHPGHARERRDRPAAVWVLHSLLSLPKNPGPSQRHRGLHEEYFWPILFTADEGLAGDYSSV

SEQ ID NO: 8103 - protein, 112 aa, Homo sapiens
  UNSURE 33: Xaa=Leu or Met or Val
  UNSURE 99: Xaa=Leu or Gln
MRKVVLITGASSGIGLALCKRLLAEDDELHLCXACRNMSKAEAVCAALLASHPTAEVTIVQVDVSNLQSVFRASKELKQRFQRLDCIYLNAGIMPNPQXISKHFSLASFQEK

SEQ ID NO: 8104 - protein, 124 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGSSGPRCETTRRWSR

SEQ ID NO: 8105 - protein, 131 aa, Homo sapiens
  UNSURE 24: Xaa=Cys or Tyr
  UNSURE 107: Xaa= *  or Cys or Trp
  UNSURE 120: Xaa= *  or Leu or Ser or Trp
  UNSURE 121: Xaa=Met or Val
  UNSURE 131: Xaa=Ala or Thr
MSDIEEVVEEYEEEEQEGKRKRVXSFGSKTAWFETDPPLLSSLAAWTSEQKQLLKSRRRQRKRMLKQRLRPRRPGQKKMKKKRKQRRLKMAQWRSPNQSPGRSCPTXCLPRSQMEREWTXXTSTGSAWRRX

SEQ ID NO: 8106 - protein, 104 aa, Homo sapiens
  UNSURE 103: Xaa=Lys or Met or Arg or Thr
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQLPKTXI

SEQ ID NO: 8107 - protein, 130 aa, Homo sapiens
MAAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVR

SEQ ID NO: 8108 - protein, 102 aa, Homo sapiens
  UNSURE 86: Xaa= *  or Ala or Gly or Ser
MGALVIRGIRNFNLENRAEREISKMKPSVAPRHPSTNSLLREQISLYPEVKGEIARKDEKLLSFLKDVYVDSKDPVSSLQVKAAEXCQEPKNSDCRKTIILI

SEQ ID NO: 8109 - protein, 125 aa, Homo sapiens
MAASGADAGPGTILGVTKGSITSSVLLAGGRTGSAGLSRGHRALHTHRDHPHTAAYLQELGRMRKVVLEAPDETTLKELAETLQQKNIDHMLWLEQPENIATCIALRPYPKEEVGQYLKKFRLFK

SEQ ID NO: 8110 - protein, 106 aa, Homo sapiens
  UNSURE 73: Xaa=Cys or Ser
  UNSURE 97: Xaa=Asp or His
  UNSURE 103: Xaa=Asp or Glu
MDGRVQLIKALLALPIRPATRRWRNPIPFPETFDGDTDRLPEFIVQTGSYMFVDENTFSSDALKVTFLITRLXSPPDCQTTTSFCPQTCAATAIAIXRIPPTXCCS

SEQ ID NO: 8111 - protein, 108 aa, Homo sapiens
  UNSURE 6: Xaa=Met or Arg
  UNSURE 23: Xaa=Leu or Val
  UNSURE 89: Xaa=Gly or Ser
MRETAXRQSMKGDWHQQFGSPPXAGGPCRGYLWRTAHTPEGSGLDKGGCSADFDLLWGMWIPLRPAPLHWSWRLIWEAVCALAPEGTWXTPHLENPHPEHSFPGAPLT

SEQ ID NO: 8112 - protein, 128 aa, Homo sapiens
  UNSURE 87: Xaa=Gln or Arg
  UNSURE 99: Xaa=Glu or Gly
  UNSURE 102: Xaa=Glu or Gly
  UNSURE 107: Xaa=Ile or Lys or Met or Asn or Arg or Ser or Thr
  UNSURE 113: Xaa=Asp or Gly
MGRSRSRSPRRERRRSRSTSRERERRRRERSRSRERDRRRSRSRSPHRRRSRSPRRHRSTSPSPSRLKERRDEEKKETKETKSKERXITEEDLEGKTEXEIXMMKLXGICSFXSTKGKKVDGSVNAYA

SEQ ID NO: 8113 - protein, 186 aa, Homo sapiens
  UNSURE 42: Xaa=Gly or Arg
  UNSURE 151: Xaa=Ala or Glu
  UNSURE 160: Xaa=Ala or Gly
  UNSURE 171: Xaa=His or Gln
  UNSURE 172: Xaa=any one of the twenty amino acids
  UNSURE 179: Xaa=Glu or Gln
MPRFPPTLIFSGSQVRFSAPPNSLVSFFDASLPGTLPVLNRXCVEAAVMTGLALNCHINKKSLFDRKHYFYADLPAGYQITQQRLPIAVNGSLIYGVCAGKKQSQVIPKTVRIKQIQLEQDSGKSLHDNLRSQTLIDLNRAGVGLLEVVLXPDMSCGEEXATAVRELQLIXXALGNQPXEHGRGPS

SEQ ID NO: 8114 - protein, 106 aa, Homo sapiens
  UNSURE 97: Xaa=Asp or Glu
MATVTATTKVPEIRDVTRIERIGAHSHIRGLGLDDALEPRQASQGMVGQLAARRAAGVVLEMIREGKIAGRAVLIAGQPGTGKTAIAMGMAQALGPXHAIHSHRRQ

SEQ ID NO: 8115 - protein, 106 aa, Homo sapiens
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 8116 - protein, 122 aa, Homo sapiens
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERRLKEAEDNIREMLMARRAK

SEQ ID NO: 8117 - protein, 129 aa, Homo sapiens
  UNSURE 111: Xaa=Asp or Glu
MEDLLDLDEELRYSLATSRAKMGRRAQQESAQAENHLNGKNSSLTLTGETSSAKLPRCRQGGWAGDSVKASKFRRKASEEIEDFRLRPQSLNGSDYGGDIPIIPDLEEVQXEDFVLQVAAPSQHPDKSG

SEQ ID NO: 8118 - protein, 124 aa, Homo sapiens
MQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKGGSVNLQWTSRDGRKRETPSI

SEQ ID NO: 8119 - protein, 115 aa, Homo sapiens
  UNSURE 12: Xaa=Gly or Arg
  UNSURE 34: Xaa=Asp or Gly
  UNSURE 35: Xaa=Ile or Val
  UNSURE 38: Xaa=Ala or Pro
  UNSURE 41: Xaa=Ala or Asp or Glu
  UNSURE 45: Xaa=Leu or Trp
  UNSURE 64: Xaa=Lys or Gln
  UNSURE 101: Xaa=Lys or Thr
  UNSURE 106: Xaa=Ala or Gly or Pro or Arg or Ser or Thr or Trp
  UNSURE 113: Xaa=Lys or Asn or Arg or Ser
MSRVLVPCHVKXSVALQVGDVRTSQGRPGVLVIXXTFXSVXPFEXQEITFKNYYTAFLSIRVRXYTSAHTPAKWVTCLRDYCLMPDPHSEEGAQEYVSLFXHQMLXTWLEYRXYA

SEQ ID NO: 8120 - protein, 115 aa, Homo sapiens
  UNSURE 78: Xaa=Asp or Tyr
  UNSURE 92: Xaa=Ala or Gly
  UNSURE 97: Xaa=Ile or Met
  UNSURE 111: Xaa=Lys or Arg
MEFPFDVDALFPERITVLDQHLRPPARRPGTTTPARVDLQQQIMTIIDELGKASAKAQNLSAPITSASRMQSNRHVVXILKDSSARPAGKGXIIGFXKWDTRSSLYWMIVXLIMR

SEQ ID NO: 8121 - protein, 139 aa, Homo sapiens
  UNSURE 128: Xaa=Arg or Trp
MVVYKTDGKKVYYPADPPPYIDGIRINSPHYLTKIKLTTPGTHTFTLVVSQYEKQNTIHYTVRVYSACSFTFSKIPSPYTLSKRINGKWSGQSAGGCGNFQETHKNNPIYQFHIEKTGPLLIELRGPXRSWSPWLSEEI

SEQ ID NO: 8122 - protein, 114 aa, Homo sapiens
  UNSURE 62: Xaa=Glu or Lys
MAEDVSSAAPSPRGCADGRDADPTEEQMAETERNDEEQFECQELLECQVQVGAPEEEEEEEXDAGLVAEAEAVAAGWMLDFLCLSLCRAFRDGRSEDFRRPATAQRLLFMDYPV

SEQ ID NO: 8123 - protein, 103 aa, Homo sapiens
  UNSURE 97: Xaa=His or Gln
MAGLTDLQRLQARVEELERWVYGPGGARGSRKVADGLVKVQVALGNISSKRERVKILYKKIEDLIKYLDPEYIDRIAIPDASKLQFILAEEQFILSXVALLSR

SEQ ID NO: 8124 - protein, 125 aa, Homo sapiens
  UNSURE 80: Xaa=Asp or Glu
MGLAGVCALRRSAGYILVGGAGGQSAAAAARRCSEGEWASGGVRSFSRAAAAMAPIKVGDAIPAVEVFEGEPGNKVNLAXLFKGKKGVLFGVPGAFTPGCSKTHLPGFVEQAEALKAKGVQVVAV

SEQ ID NO: 8125 - protein, 102 aa, Homo sapiens
MGKRDNRVAYMNPIAMARSRGPIQSSGPTIQDYLNRPRPTWEEVKEQLEKKKKGSKALAEFEEKMNENWKKELEKHREKLLSGSESSSKKKTEKEKRKEEIW

SEQ ID NO: 8126 - protein, 108 aa, Homo sapiens
  UNSURE 101: Xaa=Ile or Met
MAAVLQRVERLSNRVVRVLGCNPGPMTLQGTNTYLVGTGPRRILIDTGEPAIPEYISCLKQALTEFNTAIQEIVVTHWHRDHSGGIGDICKSINNDTTYCXKKLPRNP

SEQ ID NO: 8127 - protein, 102 aa, Homo sapiens
  UNSURE 76: Xaa= *  or Cys or Trp
  UNSURE 77: Xaa=Ala or Pro or Ser or Thr
MSCTRMIQVLDPRPLTSSVMPVDVAMRLCLAHSPPVKSFLGPYDEFQRRHFVNKLKPLKSCLNIKHKAKSPPNIIXXDHSLPLHLLPKYLSARLALAADLTS

SEQ ID NO: 8128 - protein, 109 aa, Homo sapiens
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIR

SEQ ID NO: 8129 - protein, 105 aa, Homo sapiens
MMDVSGVGFPSKVPWKKMSAEELENQYCPSRWVVRLGAEEALRTYSQIGIEATTRARATRKSLLHVPYGDGEGEKVDIYFPDESSEALPFFLFFHGGYWQSGRLS

SEQ ID NO: 8130 - protein, 109 aa, Homo sapiens
  UNSURE 39: Xaa= *  or Gly or Arg
  UNSURE 40: Xaa=Gly or Arg
  UNSURE 44: Xaa=Lys or Arg
  UNSURE 61: Xaa=Ala or Thr
  UNSURE 104: Xaa=any one of the twenty amino acids
MEVHGKPKASPSCSSPTRDSSGVPVSKELLTAGKPTAAXXIWDXLLINSQPKSRKTSTLQXVRIERSPLLDQVQTFLPQMARANEKLRKEMAAAPPGRFNIENXDGPHK

SEQ ID NO: 8131 - protein, 111 aa, Homo sapiens
  UNSURE 81: Xaa=Asp or Glu or Gly
MSSEMLPAFIETSNVDKKQGINEDQEESQKPRLGEGCEPISKRQMKKLIKQKQWEEQRELRKQKRKEKRKRKKLERQCQMXPNSDGHDRKRVRRDVVHSTFALLLTVVLIT

SEQ ID NO: 8132 - protein, 114 aa, Homo sapiens
  UNSURE 83: Xaa=Ile or Asn or Thr
MKLETSIRELHEMFMDMAMFVETQGEMINNIERNVMNATDYVEHAKEETKKAIKYQSKARRKLMFIIICVIVLLVILGIILAXNIVIATISQEPFILETQTTSATKSASCHFRE

SEQ ID NO: 8133 - protein, 119 aa, Homo sapiens
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVSTAAWRTSRS

SEQ ID NO: 8134 - protein, 103 aa, Homo sapiens
  UNSURE 87: Xaa=His or Arg
MFLIPLGNSLTLFCILFYSFHHKTAIAYFWARAIIQTLILQTLLLLMNSSLIDCRVVHYYLFLQVSQDHPSACPTTRYLQLSHFLIXSLQQSLYIYSIVTHCI

SEQ ID NO: 8135 - protein, 105 aa, Homo sapiens
MDFTEAYADTCSTVGLAAREGNVKVLRKLLKKGRSVDVADNRGWMPIHEAAYHNSVECLQMLINADSSENYIKMKTFEGFCALHLGCKSRTLENRTDSFRSWGRS

SEQ ID NO: 8136 - protein, 121 aa, Homo sapiens
  UNSURE 121: Xaa=Gly or Ser
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSX

SEQ ID NO: 8137 - protein, 113 aa, Homo sapiens
MYTREAAHKLTGRGSSSVYALLGNCVSAAGQRAMFPGEEIGQAGLPIAFLKILETLSFIELRHCPPLISSKTPVTRLKPCLVFRRSMGPRLKEPAPLLRATVTTLRENTAPIS

SEQ ID NO: 8138 - protein, 113 aa, Homo sapiens [sequence omitted]

SEQ ID NO: 8139 - protein, 121 aa, Homo sapiens
  UNSURE 76: Xaa=Lys or Met
  UNSURE 77: Xaa=Ile or Arg or Ser
MKHFYTLKCRSMLEIYSCYQSSIKCLPLGKNDTLVNPNMPRYPLCILRRMFLFKLIIVLSIKHLTSVVTSGFKSPXXPWGTQSHQRNFERSSQLLSTIEGRNRIRNRSLIKHMNKLNPLLI

SEQ ID NO: 8140 - protein, 115 aa, Homo sapiens
  UNSURE 92: Xaa=His or Gln
  UNSURE 103: Xaa= *  or Gly or Ile or Leu or Arg or Val
MVSRVQLPPEIQLAQRLAGNEQVTRDRAVRKLRKYIVARTQRAAGGFTHDELLKVWKGLFYCMWMQDKPLLQEELGRTISQLVHAFQTTEAXTCSFRPSGRPXIASGRALTGCAG

SEQ ID NO: 8141 - protein, 139 aa, Homo sapiens
  UNSURE 3: Xaa=Ala or Asp or Gly or Val
  UNSURE 19: Xaa=Ala or Asp or Gly
  UNSURE 34: Xaa=Asp or Glu
  UNSURE 37: Xaa=Asp or Glu
  UNSURE 49: Xaa=Lys or Arg
  UNSURE 101: Xaa=Pro or Gln
  UNSURE 103: Xaa=Lys or Met or Arg
  UNSURE 112: Xaa=Asn or Thr
  UNSURE 129: Xaa=Ile or Met
  UNSURE 130: Xaa=Glu or Lys
  UNSURE 131: Xaa=Asp or Glu or Val
  UNSURE 135: Xaa= *  or Glu or Lys or Gln
  UNSURE 137: Xaa=His or Gln
  UNSURE 138: Xaa=Glu or Lys
MEXMGCRFYHAASIAARAXSYMAYMTQYQRKLWXDIXDLVHDPEFDRGXARCIISDGMDAGLWQLCTTRDIMDSVVRVMAMAIDYRRQAWLRLTSLTKKTXEXISHLPFDGXSLFGQDVKAVVAEDNNXXXNDYXDXXY

SEQ ID NO: 8142 - protein, 108 aa, Homo sapiens
  UNSURE 104: Xaa=Ile or Met
MELTGDSMEVKPIMTIKLRRRPNDPVPIPDKRRKPAPAQLNYLLTDEQIMEDLRTLNKLKSPKRPASPSSPEHLPATPAESPAQKFEARIEDGKLYYDQRWYVXGNLD

SEQ ID NO: 8143 - protein, 107 aa, Homo sapiens
MQRASRLKRELHMLATEPPPGITCWQDKDQMDDLRAQILGGANTPYEKGVFKLEVIIPERYPFEPPQIRFLTPIYHPNIDSAGRICLDVLNCHQKVLGDHPSTSQLC

SEQ ID NO: 8144 - protein, 102 aa, Homo sapiens
  UNSURE 18: Xaa=Ala or Glu
  UNSURE 49: Xaa=Glu or Gly
  UNSURE 79: Xaa=Cys or Tyr
MAITKKSGNNRCWRGCGXIGTLLHCWWDCKLVQPLWKSVWRFLRHLELXIPFDPAIPLLGIYPKDYKSCCHKDTCTRMXIVALFTIAKTWNQSKCPIMNRLD

SEQ ID NO: 8145 - protein, 109 aa, Homo sapiens
  UNSURE 2: Xaa=Cys or Phe or Leu or Arg or Trp
  UNSURE 4: Xaa=Asp or His
  UNSURE 7: Xaa=Glu or Gly
  UNSURE 11: Xaa=Phe or Leu
  UNSURE 18: Xaa=Asp or His or Asn
MXLXLPXNFSXRTQYMSXLPIDASPDPLCWSALALIRKYQRLSGLNKRHLFSHSPGGWKSKTKVFAGLVSSKASLLGLEMALVGLLSAGVPGVSLCVQIFSYKDTGEIG

SEQ ID NO: 8146 - protein, 111 aa, Homo sapiens
  UNSURE 107: Xaa=His or Leu or Gln
  UNSURE 109: Xaa= *  or Glu or Lys
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKXRXQL

SEQ ID NO: 8147 - protein, 111 aa, Homo sapiens
  UNSURE 4: Xaa=Pro or Arg
  UNSURE 34: Xaa=Ala or Glu
  UNSURE 96: Xaa=Asp or Glu
  UNSURE 98: Xaa=Ala or Pro or Ser or Thr
  UNSURE 109: Xaa=Cys or Phe or Leu or Ser or Trp
MAAXGTGSGLWRPRSRDGFCPRAVRGSSAWLTPXASRSLALSLVQSGGFCCRSGFRRVQVISQQVSCAGRARRTKKRRAVGPAALAFMRPQRAPEXLXTVRGLLEFFSXGV

SEQ ID NO: 8148 - protein, 118 aa, Homo sapiens
  UNSURE 86: Xaa=Ala or Asp or Glu or Gly or His or Ile or Lys or Leu or Asn or Pro or Gln or Arg or Ser or Thr or Val
MEPKKACIAKSILSQKNKAGGITLPDFKLYYKATVTKTAWYWYQNRDIDQWNRTEPSEIMLHIYNHLIFDRPDKNKKWGKDSLFNXWCWENWLAICRKLKLHPFLTLYAKLIQDGLKT

SEQ ID NO: 8149 - protein, 134 aa, Homo sapiens
  UNSURE 110: Xaa=Lys or Arg
  UNSURE 116: Xaa=Glu or Val
MTFFCWNLVGPLEFSYRNLSLSRQNIDSWCKDHSYVIAGYYQANERVKDASPNQVAEKVASRIAEGFSDTALIMVDNTKFTMDCVGLRSTCTSTMRTDGGAETHTMTTVXLARGTXDLSLAPGQPVLRDARGFR

SEQ ID NO: 8150 - protein, 102 aa, Homo sapiens
MSSDEEKYSLPVVQNDSSRGSSVSSNLQEEYEELLHYAIVTPNIEPCASQSSHPKGELVPDVRISTIHDILHSQGNNSEVRETAIEVGKGCDFHIVKSFKDR

SEQ ID NO: 8151 - protein, 121 aa, Homo sapiens
MRLECNGTILAHCNLHLPGSSDSPASASRVAGITEQLRGLSWLYENLVGFLKIKSTKMKLQTRLWPPGVSHFQASAHSASGNLLKSLFKCSYQFMILAASASDKQISAVTPWIRLSLQISG

SEQ ID NO: 8152 - protein, 102 aa, Homo sapiens
MCVRLCVGGCVFFCTPGGRGICKVSSLLSCRVDMQPTDMHSLLLQPQPPLLQPLQPLTVTVMAGCTQPTPTMPLPLPLAMELALWRVYTEVATADLPPTEVT

SEQ ID NO: 8153 - protein, 135 aa, Homo sapiens [sequence omitted]

SEQ ID NO: 8154 - protein, 110 aa, Homo sapiens
MTTGSGQEPGQSGTSLRTGPMGSLGQAEQVSSMPMGSLEHEGLVSLRPVGLQEQEGPMSLGPVGSAGPVETSKGLLGQEGLVEIAMDSPEQEGLVGPMEITMGSLEKAGL

SEQ ID NO: 8155 - protein, 118 aa, Homo sapiens
  UNSURE 12: Xaa=Ile or Ser or Thr
  UNSURE 13: Xaa=Phe or Val
  UNSURE 84: Xaa=Glu or Gln
  UNSURE 113: Xaa=Asp or Glu
MACLLETPIRMXXLSEVTASSRHYVDRLFDPDPQKVLQGVIDMKNAVIGNNKQKANLIVLGAVPRLLYLLQQETSSTELKTECXWCWEVLLWVLKTMSSLYWTAILSLPYCKXYCPQT

SEQ ID NO: 8156 - protein, 116 aa, Homo sapiens
  UNSURE 37: Xaa=Ala or Asp
MLDKLQNEIDQELEHNNSLVREEKETTDTRKKSLLSXALAKSGERLQALTLLMIHYRAGIEDIETLESLSLDQHSKKISKYTDDTEEDLDNEISQLIDSQPFSSISDDLFGPSESV

SEQ ID NO: 8157 - protein, 121 aa, Homo sapiens
  UNSURE 96: Xaa=Cys or Gly
  UNSURE 113: Xaa=Gly or Val
MLTHYAYEYSSTSLCDICFQLFGEYIYELPINGSNDNSLIVKLSPKVLVTFINTSVICTSVPLSPPPCQHLLLSIFFLILAILVVMIQYFMVDLTXTSLMSNEAEHLFMCLLXISVSFSKK

SEQ ID NO: 8158 - protein, 133 aa, Homo sapiens
  UNSURE 2: Xaa=Ala or Val
  UNSURE 46: Xaa=Glu or Lys
  UNSURE 108: Xaa=Ile or Lys or Met or Arg or Thr
  UNSURE 109: Xaa=Phe or Val
  UNSURE 118: Xaa=His or Leu or Pro
MXTFVSELEAAKKNLSEALGDNVKQYWANLKLWFKQKISKEEFDLXAHRLLTQDNVHSHNDFLLAILTRCQILVSTPDGAGSLPWPGGSAAKPGKPKGKKKLSSVRQXXDHRFQPQNXLSGAQQFVAKDPQDE

SEQ ID NO: 8159 - protein, 111 aa, Homo sapiens
MPGYEVAKYDLIWICDSGIRVIPDTLTDMVNQMTEKVGLVHGLPYVADRQGFAATLEQMESRSVAQAGVQWRDLGSLQAPPPGFTPFSCLSLLSSWDYRCPPPCLANFLYF

SEQ ID NO: 8160 - protein, 106 aa, Homo sapiens
MAESLRSPRRSLYKLVGSPPWKEAFRQRCLERMRNSRDRLLNRYRQAGSSGPGNSQNSFLVQEVMEEEWNALQSVENCPEDLAQLEELIDMAVLEEIQQELINQGL

SEQ ID NO: 8161 - protein, 117 aa, Homo sapiens [sequence omitted]

SEQ ID NO: 8162 - protein, 113 aa, Homo sapiens
MILPFRGQPIIFNPDFFVEKLRHEKPEIFTELVVSNITRLIDLPGTELAQLMGEVDLKLPGGAGPASGFFRSLMSLKRKEKGVIFGSPLTEEGIAQIYQLIEYLQKLASRGFV

SEQ ID NO: 8163 - protein, 132 aa, Homo sapiens
  UNSURE 29: Xaa= *  or Ala or Glu or Gly or Lys or Pro or Gln or Arg or Ser or Thr
MATVDIKNPEITTNRFYGPQVNNISHTKXKKKGKAKKKRLTKADIGTPSNFQHIGHVGWDPNTGFDLNNLDPELKNLFDMCGISEAQLKDRETSKVIYDFIEKTGGVEAVKNELRRQGNFYLYSAFCFVLIF

SEQ ID NO: 8164 - protein, 104 aa, Homo sapiens
  UNSURE 25: Xaa=Asp or Glu
  UNSURE 30: Xaa=Gly or Trp
  UNSURE 33: Xaa=Cys or Ser
  UNSURE 73: Xaa=Cys or Phe or Tyr
MVHWMWGRGLDPDNFSIPYLTALGXLLGTXAPXTQLPCSLAHRGPRHGCRGLAWSLNIFPIPLHFLFEIFLLXPCPSSTPHSHLFLGLHFDTKFSLFSMGIFIH

SEQ ID NO: 8165 - protein, 105 aa, Homo sapiens
  UNSURE 36: Xaa=Met or Arg or Thr
  UNSURE 37: Xaa= *  or Cys or Gly or Arg or Ser
MAAVVENVVKLLGEQYYKDAMEQCHNYNARLCAERXXRLPFLDSQTGVAQSNCYIWMEKRHRGPGLASGQLYSYPARRWRKKRRAHPPEDPRLSFPSIKPDTDRP

SEQ ID NO: 8166 - protein, 113 aa, Homo sapiens
  UNSURE 32: Xaa=Ala or Gly
  UNSURE 34: Xaa=Asp or His
  UNSURE 68: Xaa=Leu or Pro or Gln or Arg
  UNSURE 91: Xaa= *  or Glu or Lys or Gln
  UNSURE 92: Xaa=Lys or Arg
MGILVVLIFNYINKVNILTMQWRISLHMPLYXPXVIISLVQTPRSRIPWSRNILNLNSDRYQHCLPKXLYHCTLLSAMKSTSCTNHRVRYXXQKNAEGIVPAFGVLNNDETDM

SEQ ID NO: 8167 - protein, 102 aa, Homo sapiens
  UNSURE 10: Xaa=Lys or Asn
  UNSURE 12: Xaa=Ala or Glu or Gly
  UNSURE 14: Xaa=Ala or Asp
  UNSURE 85: Xaa= *  or Ala or Glu or Gly or Lys or Leu or Met or Pro or Gln or Arg or Ser or Thr or Val or Trp
MFWKFDLHTXSXLXTLLEREDLSLPELLDEEDVLQECKVVNRKLLDFLLQPPHLQAMVAWVTQEPPDSGEERLRYKYPSVACEIXTSDVPQINDALGADESF

SEQ ID NO: 8168 - protein, 139 aa, Homo sapiens
  UNSURE 127: Xaa=Asn or Ser or Thr
MELWARGFYCAGPHTQQGLGRESPGGAQPVGSCSFLAATAGDTGGQWVSWLEVGTRLRKLGSSCRLDRHYSNNETSGRASSARQSAIFILSSFFLTQSLLCNRHCSRHWGYNGKQNRASILAGDRLXNCEHVSLEKAVC

SEQ ID NO: 8169 - protein, 134 aa, Homo sapiens
  UNSURE 55: Xaa=Ala or Pro or Ser or Thr
  UNSURE 96: Xaa=Ile or Met or Arg or Ser
MAEMRAWRPLVRPSLQCVKLGRATARWWWVVKVKPHDKDAKMKYQECNKIVKQKXFERAIAGDEHKRSVVDSLDIESMTIEGEYSGPKLEDDKVTXTFMKGLMQWYKDQKKLHQKMRLPGSGPLVEVGQAPSRG

SEQ ID NO: 8170 - protein, 104 aa, Homo sapiens
MVNDGVLPKAGALNSNDAFVLKTPSAAYLWVGTGASEAEKTGAQELLRVLRAQPVQVAEGSEPDGFWEALGGKAAYRTSPRLKDKKMDAILLASLPAPTRLDVL

SEQ ID NO: 8171 - protein, 101 aa, Homo sapiens
  UNSURE 24: Xaa=Asp or Glu
  UNSURE 26: Xaa= *  or Trp
  UNSURE 87: Xaa=His or Gln
  UNSURE 88: Xaa= *  or Glu or Gly or Lys or Arg
MSVEKMTKVEESFQKAMGLKKTVXRXRNSHTHCLWQMALGQRRNPYATLRMQDTMVQKLALAKKQLLMVRQAALHQLFEKEHQQYQXXLNQMGKAFYVERF

SEQ ID NO: 8172 - protein, 107 aa, Homo sapiens
MGKDFMSKTPKAMATKAKIDKWDLIKLKSCCTAKETTIRVNRQPTKWEKIFATYLSDKGLISRIYNELKQIYKKKNNPIKKWAKDMNRHFSKEDIYAAKKHMKKCSS

SEQ ID NO: 8173 - protein, 102 aa, Homo sapiens
  UNSURE 29: Xaa=Asp or Glu
  UNSURE 30: Xaa=Phe or His or Ile or Leu or Asn or Pro or Ser or Thr or Tyr
  UNSURE 95: Xaa= *  or Lys
  UNSURE 96: Xaa=Lys or Thr
MDKFLETYTLPRLNQEEVESLHRPITSSXXEAVINSLATKKSPGPDEFYQRYKEELVPFLLKLLQTIQKEGLLPNSFCEASVILMPRPGRDTTKXXIPGQYP

SEQ ID NO: 8174 - protein, 110 aa, Homo sapiens
MIANDVHTLRRSKTTVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 8175 - protein, 105 aa, Homo sapiens
  UNSURE 104: Xaa=Glu or Val
MSSNVPADMINLRLILVSGKTKEFLFSPNDSASDIAKHVYDNWPMDWEEEQVSSPNILRLIYQGRFLHGNVTLGALKLPFGKTTVMHLVARETLPEPNSQRSEXS

SEQ ID NO: 8176 - protein, 139 aa, Homo sapiens
  UNSURE 36: Xaa=Glu or Gln
  UNSURE 139: Xaa=Lys or Asn
MQVLVCQHECVRELATRPGRLSPIENFLPLHYDYLXFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVX

SEQ ID NO: 8177 - protein, 122 aa, Homo sapiens
  UNSURE 110: Xaa=Ile or Lys or Met or Asn or Thr
MEDTPLVISKQKTEVVCGVPTQVVCTAFSSHILVVVTQFGKMGTLVSLEPSSVASDVSKPVLTTKVLLGQDEPLIHVFAKNLVAFVSQEAGNRAVLLAVAVKDKSMEGLXALREVIRVCQVW

SEQ ID NO: 8178 - DNA, 396 bp, Homo sapiens
  misc_feature 204: r=a or g
  misc_feature 205: r=a or g
  misc_feature 321: r=a or g
  misc_feature 327: k=g or t
  misc_feature 342: n=a, g, c or t
  misc_feature 343: n=a, g, c or t
  misc_feature 369: m=a or c
tcctccgagagggaggaggcccaactggtgatgctgctgctgctgctgctgccgccgccgccgcctctattgctgatactctagtggggctggaagggtggttcctattcgcaccatcgccaaccagagacagagggaaaaaaaaaaccggcagccactgctgatgttgggttcggaggctgcatccgactcggtcacaaggarratggattcagtttgcatctctccctccttaaacagcttctccgggtctcagcatgggcttccagggcagcgattgaggagaccttaccaaggagcaccacacagtagatgctgagrcatcgkactccaggataaganncagtaacatggcagcacctgcttgamagaaattaaaaaccaacagactccatt

SEQ ID NO: 8179 - DNA, 518 bp, Homo sapiens
  misc_feature 432: y=c or t
gcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagttatatgccatcttctatcactgctgtacttttcccatagaaaccccagcctagcatctcccacagttctaaacgatgttccatgagaaaaagattctacggccataaaagtcaaggayacttcatcctatgccctgtccctgagtatttgaaattgccattagcattttaaaggttctgataagtcctgcactacttcagtagt

SEQ ID NO: 8180 - DNA, 542 bp, Homo sapiens
  misc_feature 94: r=a or g
gcgttctcgctgtgcactcttattctgcgcctgcgcgcggctacagcacggttcgtttttcctttagtcaggaaggacgttggtgttgaggttrgcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgagttcagctttgtttgcttcgtgacgttggg

SEQ ID NO: 8181 - DNA, 480 bp, Homo sapiens
gcgttctcgctgtgcactcttattctgcgcctgcgcgcggctacagcacggttcgtttttcctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaat

SEQ ID NO: 8182 - DNA, 574 bp, Homo sapiens
  misc_feature 196: w=a or t
cttttgcatccctaccccgacactgcgggttgtcacaacggcaccctcccgctttctctctgcctcggatttagtcgtgactgtgtgtcttcggccgtggtgcagcttcaggcctctcccgcatctactctctcacgcttccgctgcggcctgagggagggcggcgggcggaccacggaccggggttggcatacgwatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaat

SEQ ID NO: 8183 - DNA, 612 bp, Homo sapiens
  misc_feature 196: w=a or t
  misc_feature 526: y=c or t
cttttgcatccctaccccgacactgcgggttgtcacaacggcaccctcccgctttctctctgcctcggatttagtcgtgactgtgtgtcttcggccgtggtgcagcttcaggcctctcccgcatctactctctcacgcttccgctgcggcctgagggagggcggcgggcggaccacggaccggggttggcatacgwatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagttatatgccatcttctatcactgctgtacttttcccatagaaaccccagcctagcatctcccacagttctaaacgatgttccatgagaaaaagattctacggccataaaagtcaaggayacttcatcctatgccctgtccctgagtatttgaaattgccattagcattttaaaggttctgataagtcctgcactacttcagtagt

SEQ ID NO: 8184 - DNA, 636 bp, Homo sapiens
  misc_feature 196: w=a or t
cttttgcatccctaccccgacactgcgggttgtcacaacggcaccctcccgctttctctctgcctcggatttagtcgtgactgtgtgtcttcggccgtggtgcagcttcaggcctctcccgcatctactctctcacgcttccgctgcggcctgagggagggcggcgggcggaccacggaccggggttggcatacgwatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaccttcccccacccttctctgccaaccgctgtttcagcccctagctggattccagccattgctgcagctgctccacagcccttttcaggacccaaacaaccgcagccgctgttcccaggatggtgatccgtgtatatattgcatcttcctctggctctacagcgagttcagctttgtttgcttcgtgacgttggg

SEQ ID NO: 8185 - DNA, 522 bp, Homo sapiens
  misc_feature 401: n=a, g, c or t
  misc_feature 470: s=g or c
  misc_feature 487: y=c or t
agagggcgaaggtaggctggcagatacgttcgtcagcttgctcctttctgcccgtggacgccgccgaagaagcatcgttaaagtctctcttcaccctgccgtcatgtctaagtcagaggtgagttaggcgcgctttcccacttgaattttttcctctccctttcctgaatcggtaagatgctgctgggtttcgttccttgcaccagcccattctacagttccttcggtcgctgccacggcctacccctcccaaagttcaagtcgccattttgtcctcttgatcgccatgaggccgctctccgccaaccatgagttatcatgcgggactcgttactcgtagcaaaattcttaggcacacaggatctttgtctttttttaaaccttgccttggtgagcgagtnttctaaagagcgattagtcccattgtggagatgcacccctaccgcccaagcctttgttgcgcgtgcgtsggaaggcgactagggaygcatgcgcttgcgatttcctagcactcccaactcc

SEQ ID NO: 8186 - DNA, 353 bp, Homo sapiens
cctatttcgtgctataccagtacattgtctttatcattacttgcttgatgcttttctttaaatttacctaaatgtattcatcttaaaaagatattttctgactactttcccattgccttttgttgtataacaaatctccacacactgaatgacttaaaggaacaaaaatgtaccatttctcacgattctgtgtgttgcctgggtggtttcttctggtctgggctggctccattggacctggaatcagggtggcctctgtcacatgtctgatgattggcaggttgatgatgccaggaggacctcagctggggtagctactctctgctccacatgacttttcagcatggtcacga

SEQ ID NO: 8187 - DNA, 485 bp, Homo sapiens
ttaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccc

SEQ ID NO: 8188 - DNA, 367 bp, Homo sapiens
  misc_feature 17: k=g or t
gttctgcaggtctcgcktctgccaggagctacggccggaagatggcggcggccgcagcagttgtcgctactggagaagtccctgggactgagtaaggggaataaatacagtgctcagggcgagcgacagattccagttcttcagacaaacaatggtccaagtctaacaggattgactactatagcagctcatctagtcaagcaagcaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttac

SEQ ID NO: 8189 - DNA, 387 bp, Homo sapiens
agtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggaaagttaaaggagggaatatagatgtacatccatcagaaaaagcactcattgttcactatgaagtggaagctaccattcttggagaaatgggggaccccatgttgggagaacgaaaagaatgtcaaaaaatcattcgacttaagagtctcaatgcc

SEQ ID NO: 8190 - DNA, 409 bp, Homo sapiens
  misc_feature 364: n=a, g, c or t
  misc_feature 365: n=a, g, c or t
taattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccnnctaaaccacctatgctctcctgttatagttgtcagtaaatcacg

SEQ ID NO: 8191 - DNA, 205 bp, Homo sapiens
ataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgttgccaac

SEQ ID NO: 8192 - DNA, 249 bp, Homo sapiens
  misc_feature 90: k=g or t
gcggtcaggacgtcgaagccaaagaagaccagagccagccgggtggcacagcggtgtcgtggccgtgttgctgatcgcctgggtggttgktggcgtgtccctgcagcgaaggatcctggcagtgaaaaagcagtctggctcccgaggtccaccccttagctgtcagccttctgagcacccagcgaggaggggcgggggcaggggctgcagcccccagcgctgcctttgcggattctgtttttgagccgt

SEQ ID NO: 8193 - DNA, 246 bp, Homo sapiens
  misc_feature 103: k=g or t
  misc_feature 104: s=g or c
  misc_feature 246: s=g or c
cagaacgttataggttaagttctaataaagaaggcacagcagttaacaaaaagctggctgtattgtgaagatcatagaaagtaaaagaaaattcatgtcaatkscgtgtctgctgtgcgccacccacccctctcctcttccagggctagcagggctaccccgggctgggggctgtgttgccgcagctggccgcacccccctttccagggtcctccggaccccaccttccacactctgatcacagcs

SEQ ID NO: 8194 - DNA, 367 bp, Homo sapiens
  misc_feature 136: r=a or g
  misc_feature 349: r=a or g
acagagagcaccctgctacatttcctaatcaagaagttggcgtgcagctgggagagctagactaagttggtcatgatgcagaagctactcaaatgcagtcggcttgtcctggctcttgccctcatcctggttctgraatcctcagttcaagcttcctgtgtgagcaaacattttctcagcttgatactcagtgcatcagcggcttgcagaagagactgcctaggcctgctctgtccagtacggtagccacaagtcacttgtggctactgaacacttgaaatgtggcaaggccaaattgggacaggctgtgaatgcaaaatatacaagatttggaacccttagtatgaaraaaagaatgcaaaatatc

SEQ ID NO: 8195 - DNA, 533 bp, Homo sapiens
  misc_feature 12: s=g or c
  misc_feature 462: s=g or c
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccaacttgctcccctttaataaaacttttaagaagtcacattattggaaaacttaacttcaacatttggscgtgactcaagctcttctgaagttctctgagatgactgaatatgaaccaaagctgcactgtgctgtacttt

SEQ ID NO: 8196 - DNA, 401 bp, Homo sapiens
  misc_feature 356: k=g or t
acggtccaggctggacacaaccaaaggcggaggacccgtggcccacgaagctcatctttgaactgtccccgccttctcccgccttgacttgtgaccctaggccctttggggcgcctctgacccagctagccagatcccggacccaaaccatgttccctgtgaaggtgaaagtggagaaatcaggctgcctgggcctggctctgagattggccagggcagaggacacgcacgcccttccctggcccagtcagctgcccacctagctggggcctgggagctgactcctgctgggtcctctcttgccccagagctggagatggccaaagcccggaaccaactggatgctgtcttgcagkgtctgctggagaagagtcacatggacagggagcgtctggatgagg

SEQ ID NO: 8197 - DNA, 460 bp, Homo sapiens
  misc_feature 327: r=a or g
  misc_feature 345: w=a or t
  misc_feature 421: n=a, g, c or t
  misc_feature 422: n=a, g, c or t
agttgggcaaaaaaatcaaggtatttggtcccggaacaaagcttatcattacagaacaaagttgaaacttctgttttcacgttgatctgtacaaagaagataatggagattatttacctaaagtggatgttataaagattaaatgaaattaaatatggaaattacctaccagaatgcctggcacttgataaacaacttgatgcagatgtttcccccaagcccactatttttcttccttcaattgctgaaacaaagctcagaaggctggaacatacctttgtcttcttgagaaatttttccctgatgttattaagatacattgggaaraaaagaagagcaacacgwtctgggatcccaggaggggaacaccatgaagactaacgacacatacatgaaatttagctggttaacggtgccagannagtcactggacaaagaacacagatgtatcgtcagacat

SEQ ID NO: 8198 - DNA, 380 bp, Homo sapiens
  misc_feature 365: n=a, g, c or t
  misc_feature 366: s=g or c
  misc_feature 368: k=g or t
ctctggcgagctttgcgttccctgtgcgccggaagtgatcccctgcgtggctgggctgctcgggttagatcgtcaggaaaagcctaaagattagactgtaagaaaagaaaatagaagccatgtttcgaagacctgtattacaggtacttcgtcagtttgtaagacatgagtccgaaacatggcttctattttcttttcttacagtctaatcttttgtcatcaaagtacgatctttcccctatacaccctttcacagttagtgatttcactgtccacacagtttcctgagcttagagcctgggaaggagtcacccctaaccccttctcctctgtcaccactcccacttgtcattgactctgaagcnsgkttccttggaccc

SEQ ID NO: 8199 - DNA, 458 bp, Homo sapiens
  misc_feature 15: k=g or t
acgtgacgaggaackagccttagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatggtgaggaaatggcagagttgactctgggactggaaggagacagggaaacctgggcaggaaaggaatagcagttagaagctacagcataagaggagaggaacaaaggctgttgttttgggatgccatattttagaattgatgaatttgtttattttatttagacgtatttgcatcagacatgcgtttaagtcctggctcagtcacttacac

SEQ ID NO: 8200 - DNA, 170 bp, Homo sapiens
  misc_feature 52: s=g or c
gtgagctgctgctcctgcggttggtgagattacctgggtctagagtgcggastgctccgtggccacgaggacgtcaccatgcccaaagcaccaaagggaaaaagtgcaggacgggaaaaaaaagtcatccatccatatagtagaaaagcagctcaaattacgagagaggc

SEQ ID NO: 8201 - DNA, 225 bp, Homo sapiens
atttttttaccagagggagccagggctgcagcctcatctgtttgcggatcagaacccgagctgtgcttgtggctgcggctgctaactggctgcgcacagaagcgagtcggccgtctttcctttttcccccttacctaccatatcctgacttctactccttttattctctcaagcctcatttatcttcaacctctgtgagctttctttttctcccctactcaccac

SEQ ID NO: 8202 - DNA, 336 bp, Homo sapiens
atttttttaccagagggagccagggctgcagcctcatctgtttgcggatcagaacccgagctgtgcttgtggctgcggctgctaactggctgcgcacagaagctgagagaagagggtggcaataagtacttttgcctcattctgaagccttggaaggagctgtcaccatgcctcactcgtacccagccctttctgctgagcagaagaaggagttgtctgacattgccctgcggattgtagccccgggcaaaggcattctggctgcggatgagtctgtaggcagcatggccaagcggctgagccaaattggggtggaaaacacagaggagaaccacc

SEQ ID NO: 8203 - DNA, 419 bp, Homo sapiens
  misc_feature 146: w=a or t
aaccccgcctccctccccgccccgcgatgtcggaagaaacccgacagagcaaattggccgcagcgaagaaaaagttgagagaatatcagcagaggaatagccctggtgttcctacaggagcgaaaaagaagaagaaaataaaaaawtggcagtaaccctgagacaaccacttctggtggttgccactcacctgaggatattcaggacattctgaaggtgctggtgtccgaccttaaccgttccaatggggtagcgctccccccattggacaagtggaagacacccaaggacaatgctgctactctacaaccatctgatgacaccgtgttacctggcggtgtcccttcccctggtgccagtctcactagcatggcggcatctcagaatcatgatgctgacaatgtccctaatctcatgga

SEQ ID NO: 8204 - DNA, 455 bp, Homo sapiens
  misc_feature 126: y=c or t
  misc_feature 364: k=g or t
ccctagctttccttttccggttgcggcgccgcgcggtgaggttgtctagtccacgctcggagccatgccgtccaagggcccgctgcagtctgtgcaggtcttcggacgcaagaagacagcgacagygtggcgcactgcaaacgcggcaatggtctcatcaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggkccctgctggtagctgaccctcgtcgctgcgagtccaaaaagtttggaggtctggtgcccgcgctcgctaccagaaatcctaccgataagcc

SEQ ID NO: 8205 - DNA, 138 bp, Homo sapiens
aaaaatggaataaacaactcggaggaaccagagcgcgagagagcgagtggaggcagaatttaaaaataaaccggcccctccgccttccccacccgcttgccgctgccgctccctcttcccctgcccgcgccctcgaag

SEQ ID NO: 8206 - DNA, 487 bp, Homo sapiens
  misc_feature 35: m=a or c
  misc_feature 47: w=a or t
  misc_feature 52: m=a or c
  misc_feature 78: m=a or c
  misc_feature 101: m=a or c
  misc_feature 105: r=a or g
  misc_feature 150: r=a or g
  misc_feature 183: r=a or g
  misc_feature 184: r=a or g
gcgagaaagtgtcggtctccaagatggcggccgcmtggacgtctggwccgamtgcaccggaagccgtgacggccagamtcgttggtgtcctgtggttcgtmtcartcactacaggaccctggggggctgttgccacctccgccgggggcraggagtcgcttaagtgcgaggacctcaaagtgrracaatatcctctgtggagaacacccccccatggaggcgagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggt

SEQ ID NO: 8207 - DNA, 335 bp, Homo sapiens
taatccatgctattactgggcagtaggtctaattttttttgacaaaaatagatctattttccttatatattgatttagaatcttaagttagaattttatagaagaaatgtctgagcagttctatgtatggaggagcaattcagcttttcagcagcaactttatcttttgccactagagggagatctgtggttgctttctcctttggagaatagctgctttgcttttatttttaatttctaaggttggaatagaacttattctcaaaattcctttagtgttattaaatattttcatttattagtcaaaggtaagttaattaagcttgtttaatgat

SEQ ID NO: 8208 - DNA, 196 bp, Homo sapiens
attttcaggctgcactcagagaagctgcccttggctgctcgtagcgccgggccttctctcctcgtcatcatccagagcagccagtgtccgggaggcagaaggtaggctcaagatcagcctggcagaacgccaaacctagggcccctggcacccagaggcgagggggtgcctgctggctgccctgtccccactccct

SEQ ID NO: 8209 - DNA, 444 bp, Homo sapiens
attgctgtagtttatttccacccccttccctcctgtttctctctctccttctctctctctctctctctctcttttttttccgccctagctggggctgtgttggaggagaggaagaaagagagacagaggattgcattcatccgttacgttcttgaaatttcctaatagcaagaccagcgaaggattgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacgagcgatcgtcttctgatcaaaggaggtaaaattgttaatgatgaccagtcgttctatgcagacatatacatggaagatgggttgatcaagcaaatagg

SEQ ID NO: 8210 - DNA, 237 bp, Homo sapiens
gaacaatatctgtagatgatttatacaaaaaaaaattgcaatacacaattctacatcaagctcaataaccattttttgtttgcaagtttgacacatgaaggccttggagtttattactcttgtaacttattaagggcatcatggcctagagtttattacttgtgtaatttcactggggaaaacaattggtaaagtgtcaacatcagtagaaatctcaacaagccgaaaggtaagagg

SEQ ID NO: 8211 - DNA, 502 bp, Homo sapiens
  misc_feature 256: n=a, g, c or t
aaaacactgcctggagtgagagcaaactaccagcgcagtggggccggcgcgagtgtgcgtgtgtgtgcgtgtgtatgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacaagcagttngaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctggg

SEQ ID NO: 8212 - DNA, 407 bp, Homo sapiens
  misc_feature 32: n=a, g, c or t
  misc_feature 33: w=a or t
  misc_feature 168: r=a or g
cacacgaaaaacaaagaaaaaaatgcttgagnwttttctaacttccccttgcagtctgttgtgtgagcagcctgtttatttctctaatattatgtcagtttattctctttaatggactgtaaaaaaatgtaatcacaagagtgccaaatatcttgaaatgccaaaagrcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgc

SEQ ID NO: 8213 - DNA, 313 bp, Homo sapiens
  misc_feature 11: y=c or t
gctgcggtgayttttttcacgtgtcgccagggccggactgcgagtctctttgcggcgctacactagagcagagtacgagtctgaggcggagggagtaatggtgagtcccgcgtggccccgaggcctgcaggcccgggcctgtctgaggcgtacggggatccctgacgcccctcttttgttgggctgggcgggagggattggtggccactcagtgaccagcgcccgatggcaccttggagcggcaaggcccgcccgacccttttctcccccagggctctttgcacgcgcgtgtgctgccggtgtgtaaggcagg

SEQ ID NO: 8214 - DNA, 621 bp, Homo sapiens
  misc_feature 543: n=a, g, c or t
  misc_feature 570: n=a, g, c or t
  misc_feature 585: n=a, g, c or t
  misc_feature 586: k=g or t
  misc_feature 589: w=a or t
  misc_feature 592: w=a or t
  misc_feature 595: w=a or t
acaaggtctgatagttttataagggacttttctcccttttgctcatacttctccttgctgctgccatgtgaagaaggatgtgtttgcttctccttctgccatgattgtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgaggaacnaaggttttgaaatcccatcaggtcacngcgaggcctgactgnkctwatwgtwgaataaatgtcatctgaatatcccct

SEQ ID NO: 8215 - DNA, 573 bp, Homo sapiens
  misc_feature 495: n=a, g, c or t
  misc_feature 522: n=a, g, c or t
  misc_feature 537: n=a, g, c or t
  misc_feature 538: k=g or t
  misc_feature 541: w=a or t
  misc_feature 544: w=a or t
  misc_feature 547: w=a or t
agaatctttgccttgcatgtttcaggcccacctggctcctttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgaggaacnaaggttttgaaatcccatcaggtcacngcgaggcctgactgnkctwatwgtwgaataaatgtcatctgaatatcccct

SEQ ID NO: 8216 - DNA, 460 bp, Homo sapiens
ataatgcagcattcttttggacaccacacctaggtcggagcactgtcgtccttcagggctccagcctcttgatatttttgtacttcagtatcagctcgatagagcaaaagagagagaggacgagagaggggggtgaggagaaaagagagagagcgcgagagggagagggagagaaggaggggtgggaattacacaaagagagaccaaaaataattttgattcctaagttaatttgctcactgatctgggattttagtcaccatggagggtaaatggacaatctgcccaggactgcagcccgatactatttttcaaagccagaacttactccattttctatgcaaatgtcagaaaaatgaaacaccctctctcccaagtcagagaaggggaagcaacggctctcacgttgggacaatattatctggaagctgaagaagaaactgaatactccttccttcct

SEQ ID NO: 8217 - DNA, 577 bp, Homo sapiens
aaacccctgcgtcatgccttttggagggcgctccggctcttgtatagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaag

SEQ ID NO: 8218 - DNA, 596 bp, Homo sapiens
gcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttgtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaag

SEQ ID NO: 8219 - DNA, 200 bp, Homo sapiens
actgctggccgtggatccatttcacaggcctgccttctctcactaacgctcttcctagtccccgggccaactcggacagtttgctcatttattgcaacggtcaaggctggcttgtgccagaacggcgcgcgcgcgcgaacgcacgcacacacacggggggaaacttttttaaaaatgaaaggctagaagagctcagcggc

SEQ ID NO: 8220 - DNA, 203 bp, Homo sapiens
ccacaaatagcacatgtgtgcaaactggaaaaatgaacccttcttctgggaggacgccagcccaggccaggtcacccggcttggccagcagaacacagagtagattttggtcccgtttgttccccagtggggtatctatccttgtgcagggcacaagcctacatggtggctctggtcatatcattagaaaatagacagaaatg

SEQ ID NO: 8221 - DNA, 493 bp, Homo sapiens
  misc_feature 465: n=a, g, c or t
gccaggaggatctgtgtccaaaactccacgttttctgctacctggaaccgagagtctcttctccttcaagtccgtggttctggtggagcccgactgagcactaaggatcctctgcccaccatcgcctccagagaggagattgaagctactaagaatcatgttctagagaccttctaccccatatcacccatcatcgatcttcatgaatgcaatatttatgatgtgaaaaatgacacaggattccaggaaggctatccttacccctatccccataccctgtacttactggacaaagccaatttacgaccacaccgccttcaaccagatcagctgcgggccaagatgatcctgtttgcttttggcagtgccctggctcaggcccggctcctctatgggaatgatgccaaggtcttggagcagcccgtggtggtgcagagcgtgggcacggatggacgtgtcttccanttcctagtgtttcaactgaataccacag

SEQ ID NO: 8222 - DNA, 408 bp, Homo sapiens
  misc_feature 82: y=c or t
  misc_feature 86: s=g or c
  misc_feature 390: n=a, g, c or t
  misc_feature 405: n=a, g, c or t
agactactctacctttctggcttcaggacaccagacatcagagacagagagaaaaattcaaagggccaacccgtctttcctytggscaggtgctatctagacctgaagtagcgggaagagcagaaaggatggggcagccatctctgacttggatgctgatggtggtggtggcctcttggttcatcacaactgcagccactgacacctcagaagcaagatggtgctctgaatgtcacagcaatgccacctgcacggaggatgaggccgttacgacgtgcacctgtcaggagggcttcaccggcgatggcctgacctgcgtggacctggatgagtgcgcattcctggagctcacaactgctccgccaacagcagctgcgtaaacacgccagnttccttctcctgcgnctg

SEQ ID NO: 8223 - DNA, 354 bp, Homo sapiens
aagtctagagcagcactagcgcagagtgagactcatcagctggcaagcaggattctgtgtctctgggttcaggaatcctcaggcagcagaggggacttgctcctcagcccccatcactgcccccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaacatggcacagagcaagaggcacgtgtacagccggacgcccagcggcagcaggatgagcg

SEQ ID NO: 8224 - DNA, 211 bp, Homo sapiens
  misc_feature 137: k=g or t
cagcttttttcaggtaaaatattatttagaatgttctagagcagcctctaagaggggatctctcctttcatttcactttacttgctgtaacacccaaaaatgcagagtgaggttgatttcacctagaatttgtaaakaagacctggcctctgcctggaatttacaaggcaaagccagactttggattgagaatttacagaaaaccaacagg

SEQ ID NO: 8225 - DNA, 779 bp, Homo sapiens
  misc_feature 111: n=a, g, c or t
  misc_feature 112: n=a, g, c or t
  misc_feature 126: m=a or c
  misc_feature 167: r=a or g
  misc_feature 168: r=a or g
  misc_feature 243: k=g or t
  misc_feature 253: k=g or t
  misc_feature 271: n=a, g, c or t
  misc_feature 273: r=a or g
  misc_feature 302: k=g or t
  misc_feature 394: m=a or c
agaggagcgagatgttcaagaagcctacgccgtccaccttgaaggcaggggagctgcgcacgcacgtcagccgctgccaagtctgtatgagaagaacataatgaagcctgnntcagctaatgtcamaacatggtgctacttcttcttctttttgttaacagcaacgrrccctagaaatatatcctgtgtacctcactgtccaatatgaaaaccgtaaagtgccttataggaatttgcgtaackaacacaccckgcttcattgacctctacntrctgaaggagaaaaagacagcgataagctktcaatagtggcataccaaatggcacttttgatgaaataaaatatcaatattttctgcaatccaatgcactgatgtgtgaagtgagaactccmtcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggc

SEQ ID NO: 8226 - DNA, 681 bp, Homo sapiens
  misc_feature 124: y=c or t
  misc_feature 451: r=a or g
  misc_feature 583: r=a or g
gtttctgactttattaatctcaggaggtctctcttctttttgctctgctgcttcaagcctttggcatccagtgccttgtacttaatgaaagtttgcaacactctgagcaactgttctcagttcytctgccttatttctggcctccgttgcaactgttttgacctagtgaaggcctagactttctcagacagatttcttttaactcttctgccctgactccagtcttcactgggatgctgccttgcacttagggaaggttcacatgcctcaaggatctctctctctcagatttcttgactttccctcagtcttcagtatagtcctcctctgtgcctggtgaagacctgtggtaaagtgctggcagagaggaagctaaatcacgtaaaaattaagaaacagctcagcgtttcacagctaagctgccggcttccccttgaaggaataggagtaracctgctgaactatcacatgagagaagaggcccaaaagcttgcacactacagtcaagctggcccttaaagagatggacctagaagatgctgagccagatgtactcaattacttctccaaaattcatcaattrggaatacaacatgtttaagaccacagaacatctgcataggctgtaaatttcgttgaatgatggatgcaaagatggaagacagatggatagaggaaaag

SEQ ID NO: 8227 - DNA, 213 bp, Homo sapiens
ccccttatgtcgggtataaagcccctcccgctcacagtttccctagtcctcgaaggctcggaagcccgtcaccatgtcgtgcgagtcgtctatggttctcgggtactggtatggctgcccataaaaataaatacctgccattaaaataaataataaggaggggaaggagagagagggtcagggaaataatacaataaactatgtaaattccaa

SEQ ID NO: 8228 - DNA, 348 bp, Homo sapiens
  misc_feature 71: w=a or t
  misc_feature 159: r=a or g
  misc_feature 249: k=g or t
  misc_feature 252: k=g or t
  misc_feature 284: w=a or t
aatttagcatgctgttttctaacagacattgggtaccatcgaatgactgtcagaacagaaagctaaggcawaggagggaggatgctgtggtcatcctttcttgtttttttcttctttaatgaggatagagcacatgtgagattttactttctactccartaaaaattctgaagaattgcattggagactgttatattcaacacatacgtggattctgtgttatgatttacatttttctttatttcaggkaakcccttgctgctattgaacaacgcattgcagawgagaaagctaagagacccaaacaggaacgcaaggatgaggatgatgaaaatggcccaaagccaa

SEQ ID NO: 8229 - DNA, 566 bp, Homo sapiens
agctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgagga

SEQ ID NO: 8230 - DNA, 627 bp, Homo sapiens
  misc_feature 423: n=a, g, c or t
  misc_feature 560: s=g or c
  misc_feature 567: w=a or t
  misc_feature 582: s=g or c
agctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctgatgagttcccgagccttgtcctccagtgtgtntccaaactccttcagcttatccaaggcactggaactcatcagccgcatcaaacagagtgaactttctgccaagatgcgggagtggttttcagagacatttcagaaagtgaaggagaaactcaagattgactcatgasgacctgwagggtgacatcccasgaggggcctctgaaatttcccacaccccagcgcctgtgctgagga

SEQ ID NO: 8231 - DNA, 356 bp, Homo sapiens
  misc_feature 339: n=a, g, c or t
  misc_feature 342: m=a or c
  misc_feature 343: m=a or c
  misc_feature 348: s=g or c
  misc_feature 349: n=a, g, c or t
gacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatttctgccaagatgcgggagtggttttcagagacatttcagaaagtgaaggagaaactcaagattgacttncgmmcgatsngaagggt

SEQ ID NO: 8232 - DNA, 382 bp, Homo sapiens
  misc_feature 170: m=a or c
acttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagggatctgcctcctgtggtccagamccagagccttctctgacgtcctctgctgaagccatcgttctgccagggcaccacatttggacagcgggtggctgagaacattcccactttggggagcctttgtttcacaccctctgatgtaggcggcagcttcctttcctttgggcctctggttatggagaaggctaaggcaaggtcctttctctcacagctaacaagttgtgcttctggaa

SEQ ID NO: 8233 - DNA, 440 bp, Homo sapiens
  misc_feature 15: r=a or g
  misc_feature 33: s=g or c
  misc_feature 83: m=a or c
aggtcctcacaattrctctacagctcagaacascaactgctgaggctgccttgggaagaggatgatcctaaacaaagctctgmtgctgggggccctcgctctgaccaccgtgatgagcccctgtggaggtgaagacattgtggctgaccatgttgcctcttgtggtgtaaacttgtaccagttttacggtccctctggccagttcacccatgaatttgatggagatgagcagttctacgtggacctggagaagaaggagactgcctggcggtggcctgagttcagcaaatttggaggttttgacccgcaggtgcactgagaaacatggctgtggcaaaacacaacttgaacatcatgattaaacgctacaactctaccgctgctaccaatgaggttcctgaggtcacagtgttttccaagtctcccgtgacactgggtca

SEQ ID NO: 8234 - DNA, 514 bp, Homo sapiens
  misc_feature 124: m=a or c
  misc_feature 276: s=g or c
gtagaatttgttgtcttctgctaagcacgaaaagttaagatatctgcttacattgattttgtagacacattaagtcaagatttggaatttaagtcactggcaggtatctgtgcattcatagaamctattaaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaasctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatat

SEQ ID NO: 8235 - DNA, 337 bp, Homo sapiens
  misc_feature 54: m=a or c
  misc_feature 142: n=a, g, c or t
  misc_feature 168: r=a or g
  misc_feature 171: w=a or t
  misc_feature 178: r=a or g
  misc_feature 234: r=a or g
  misc_feature 282: w=a or t
  misc_feature 283: n=a, g, c or t
  misc_feature 284: n=a, g, c or t
  misc_feature 331: n=a, g, c or t
  misc_feature 332: n=a, g, c or t
gttgagggcactttcccagtccccgaggcggatccggtgttgcatccttggagmgagctgagagctcgagtacagaacctgctaaggccatcaaacctattgatcggaagtcagtccatcagatttgctctgggccggtggnactgagtctaagcactgcggtgaagragwtagtagraaacagtctggatgctggtgccactaatattgatctaaagcttaaggactatggartggatctcattgaagtttcaggcaatggatgtggggtagaagaagaawnnttcgaaggcttaagtaagttaactttctaatcctattacaaaataanntgggc

SEQ ID NO: 8236 - DNA, 258 bp, Homo sapiens
gagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtgagagggtaagggtgtagaggaaggtagtggtatagatttggtgatggg

SEQ ID NO: 8237 - DNA, 461 bp, Homo sapiens
  misc_feature 6: w=a or t
  misc_feature 368: m=a or c
  misc_feature 369: y=c or t
  misc_feature 426: y=c or t
agagtwtagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttamytcagaatttaaaaaggggaaagaaaacatcctgctaaaatatgaacatctgagtgcyccgttaaacatgtgtcactgggcagcggtgctcta

SEQ ID NO: 8238 - DNA, 458 bp, Homo sapiens
  misc_feature 6: w=a or t
agagtwtagactgtctttgcttcatcatctgaaggtaaaattttccagatacggcagacggctttcagagtacaataaacagggaatgagaactatttacatggaagtttctttctcatgatgcggtggagaagcctcggccacttggttctgccagatgttcctggggttactgtaaatgggaaggacaggcagagctaaacaaggtttatcatttaaaagtgcctgtgtgaagtcacttttgctggaaaactgcagcttgggagctttctttgtattcacatcccactcttctgtcaagtacactttaccctgaccttatgagtggatgaagatacctcagttgtctgactttgccaattgcttaatttcagaatttaaaaaggggaaagaaaaacatcctgctaaaatatgaacatctgagtgtcttattttccaacatcgtcaatagctgtgag

SEQ ID NO: 8239 - DNA, 386 bp, Homo sapiens
  misc_feature 34: s=g or c
  misc_feature 93: s=g or c
agacccgaggttttagaagcagagtcaggcgaastgggccagaaccgcgacctccgcaaccttgagcggcatccgtggagtgcgcctgcgcastacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaataggggg

SEQ ID NO: 8240 - DNA, 441 bp, Homo sapiens
  misc_feature 34: s=g or c
  misc_feature 93: s=g or c
agacccgaggttttagaagcagagtcaggcgaastgggccagaaccgcgacctccgcaaccttgagcggcatccgtggagtgcgcctgcgcastacgaccgcagcaggaaagcgccgccggccaggcccagctgtggccggacagggactggaagagaggacgcggtcgagtaggtgtgcaccagccctggcaacgagagcgtctaccccgaactctgctggccttgaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaataggggg

SEQ ID NO: 8241 - DNA, 463 bp, Homo sapiens
catttggtcagataagctacctctcacacttcttagtgatctaacttcagggtccgaacagctgaagcaggtaggaactgtgagcttgtattctgagtcatttagctctaagctgtttcttgattctggtgataaatatctacactgggtgagaagatagtggataaagtcccatataacacctgccaactaattgttaaaacattccatctcactgtgcctcagttttctctctctgccctgtgggctcattattttcctttcaacacctcctgtctttctagactctcagaaagatatattggtcgaggactatgccattataggaaattttgacctgaaaggatggtgggaactgggtaaaggcaggattctatcattctgctacttgctgtgtgactggagcagtgactcaactctctaggcctctgtcttgcgcatacatatatatatgtaaaataaa

SEQ ID NO: 8242 - DNA, 554 bp, Homo sapiens
gtgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaaga

SEQ ID NO: 8243 - DNA, 406 bp, Homo sapiens
  misc_feature 184: r=a or g
  misc_feature 197: y=c or t
  misc_feature 202: w=a or t
  misc_feature 204: w=a or t
  misc_feature 206: w=a or t
  misc_feature 209: y=c or t
  misc_feature 211: r=a or g
  misc_feature 212: w=a or t
  misc_feature 213: r=a or g
  misc_feature 217: m=a or c
  misc_feature 255: m=a or c
atcacccaaaaaccacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagrcttctggttacayctttwcwgwtaygrwrtcamctgggtgcgacaggcccctggacaagggcttgagtggmtgggatggatcagaggtaacaatgatagcacaaactatgcacagaagttccaggacagaatttccctgaccgcagacacatccactaaaacagtgtatatggagttgaggagactgaaatccgacgacacggcccgtatattactgtgcga

SEQ ID NO: 8244 - DNA, 195 bp, Homo sapiens
tttattccagaaccacccggtcttgctcagattgctctagcggttgcttaacaggtttacttgcttctagtttatcaaaaccacagccccacctcaaaaccttttgcagagttaatttttcacagaatagccagagggatgtttaaaagacacttttcattgcctccccctctcagtcaaaatccaccatgatcc

SEQ ID NO: 8245 - DNA, 305 bp, Homo sapiens
  misc_feature 36: s=g or c
  misc_feature 37: r=a or g
  misc_feature 93: y=c or t
  misc_feature 119: s=g or c
agggcttcgtgcggtgaggctcgctcgcgcggcagsrgatggccgaggcctcttggttctgcggcacgtgacggtcgggccgcctccgcctcyctctttactgcggcgcgggcaccccsgcggtcctcgggaggctagagatcatggaagggaagtggttgctgtgtatgttactggtgcttggaactgctattgttgaggctcatgatggacatgatgatgatgtgattgatattgaggatgaccttgacgatagcagttccaagcaccagtaacatacacagcaaccacttccctttgttcct

SEQ ID NO: 8246 - DNA, 400 bp, Homo sapiens
atcacccaacaaccacatccctcctctagagaatcccctgaaagcacagctcctcaccatggactggacctggagaatcctcttcttggtggcagcagtcacagatgcctactcccagatgcagatggtgcagtctggggctgaagtgaagaagactgggtcctcagtgaaggtttcctgcaagcttccggatacaccttcacctaccgctacctgcactgggtgcgacaggcccccggacaagcgcttgagtggatgggatggattatacctttcaatggtaacacccactacgcacagaaattccaggacagagtcaccattaccagcgacaggtctattaccagcgacaggtctatgagcacagcctacatggagctgagcagcctgagatctgagg

SEQ ID NO: 8247 - DNA, 374 bp, Homo sapiens
ctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccgga

SEQ ID NO: 8248 - DNA, 377 bp, Homo sapiens
  misc_feature 332: n=a, g, c or t
  misc_feature 334: m=a or c
  misc_feature 366: n=a, g, c or t
agccattttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaatacacctatgtgcatacattcacatttctcaccctttcttacacaaatgtagtggntmtacataaatgttctgcactttgcttttccacntactctatccc

SEQ ID NO: 8249 - DNA, 389 bp, Homo sapiens
  misc_feature 19: s=g or c
  misc_feature 122: r=a or g
  misc_feature 124: s=g or c
  misc_feature 130: r=a or g
  misc_feature 131: s=g or c
  misc_feature 133: r=a or g
  misc_feature 272: n=a, g, c or t
  misc_feature 273: n=a, g, c or t
  misc_feature 274: n=a, g, c or t
  misc_feature 275: n=a, g, c or t
  misc_feature 313: m=a or c
  misc_feature 333: n=a, g, c or t
  misc_feature 335: y=c or t
  misc_feature 347: r=a or g
  misc_feature 368: n=a, g, c or t
  misc_feature 369: r=a or g
  misc_feature 370: n=a, g, c or t
agcatcacataacaaccasattcctcctctaaagaagcccctgggagcacagctcatcaccatggactggacctggaggttcctctttgtggtggcagcagctacaggtgtccagtcccagrtscagctrstrcagtctggggctgaggtgaagaagcctgggtcctcggtgaaggtctcctgcgaggcttctggatacaccttcagcaactatgctgtcagctggttccagggcagagtcacgattaccgcggacgaatccacgaacaccnnnntatatgggactgaccagcctgacatctgaggacacggmcatttactactgtgcgagangyccggcgccttcrgtgactacatatcgtccttanrnttactactacggtatggac

SEQ ID NO: 8250 - DNA, 306 bp, Homo sapiens
  misc_feature 93: y=c or t
  misc_feature 102: y=c or t
  misc_feature 118: s=g or c
  misc_feature 121: r=a or g
  misc_feature 196: m=a or c
  misc_feature 246: m=a or c
  misc_feature 277: n=a, g, c or t
  misc_feature 296: n=a, g, c or t
agcatcacataacaaccacattcctcctctaaagaagcccctgggagcacagctcatcaccatggactggacctggaggttcctctttgtggyggcagcagytacaggtgtccagtcscargtgcagcttggtgcagtctggggatgaggtgaagacgcctgggtcctcgataaaaatctcctgtaagccttctgmaggcaccctcggcaaatacgacgtcagttgggtgcgacagattcctggamaagggcttcaatggatgggaggaatcagccntttcgcctatagatcaganttggcacaga

SEQ ID NO: 8251 - DNA, 470 bp, Homo sapiens
  misc_feature 122: s=g or c
  misc_feature 131: s=g or c
  misc_feature 148: s=g or c
  misc_feature 156: r=a or g
  misc_feature 174: r=a or g
  misc_feature 219: m=a or c
  misc_feature 220: y=c or t
  misc_feature 341: y=c or t
  misc_feature 350: s=g or c
  misc_feature 359: y=c or t
  misc_feature 365: w=a or t
  misc_feature 369: m=a or c
  misc_feature 385: w=a or t
  misc_feature 412: k=g or t
  misc_feature 414: n=a, g, c or t
  misc_feature 416: y=c or t
  misc_feature 428: r=a or g
  misc_feature 449: n=a, g, c or t
  misc_feature 450: r=a or g
  misc_feature 451: n=a, g, c or t
agcatcacataacaaccacattcctcctctaaagaagcccctgggagcacagctcatcaccatggactggacctggaggttcctctttgtggtggcagcagctacaggtgtccagtcccagstgcagctgstgcagtctggggctgasgtgaagargcctgggtcctcggtgarggtctcctgcagggcctctggaggcaccttcagtacgtatgggtmyatgctgggtgcgacaggcccctggacaagggcttgagtggatgggagagatcatccctctctctggaacaacaatctacgcacagaagttccagggaagactcactataaccgcgcacgaytccacaaasacagcctayatggawctgmgtagcctgagatctgwggacacggccatttattactgtgcgakangyccggcgccttcrgtgactacatatcgtccttanrnttactactacggtatggac

SEQ ID NO: 8252 - DNA, 389 bp, Homo sapiens
taagctacagaatcttctgagatctgatatgaaccttgttcttagtggcatcatccttgcatcagccaagctcaaaacctcagactcatctttgactcttccttctcaatcttttctgttcatttggtcccatcaattcctcctttaaaatgactatcacaggtgtcccttcttttctcctgtcttattacccctctgtcatgaagaattggaagagctggtcttagctctgcctctggctgctggcctagtttcttcatcactgaagtgaacagattatacaggattgtcttagatccctttcagagctaacattctgttctactcatccaggttttcaccttctcacacttacatcacagtaacttcctaattgtttttcatccctt

SEQ ID NO: 8253 - DNA, 287 bp, Homo sapiens
  misc_feature 266: n=a, g, c or t
agctttttgcctccaaggctttgctggcttgtgcggcatcctgctccgtctgcaggttgtgcttccggtgcggaggtcagggacaagatggtgccaccggtgcaggtctctccgctcatcaagattacctaaaacctcgggcagaagaggagaggaggatagcagcagaagagaagaagaagcaggatgaactgaaacggattgccagagaattggcagaagatgacagcatattaaagtgagtgaccctgcgacccactctttgnaccagcagcggatgaataaag

SEQ ID NO: 8254 - DNA, 360 bp, Homo sapiens
  misc_feature 116: m=a or c
atggccctgtccactgagcatcctcccgccacacagaaacccgcccagccggggccaccgaccccaccccctgcctggaaacttaaaggaggccggagctgtggggagctcagagmtgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatatacc

SEQ ID NO: 8255 - DNA, 261 bp, Homo sapiens
ggtctcattgaactcgcctgcagctcttgggttttttgtggcttccttcgttattggagccaggcctacaccccaggtaaaacctctgctcaagagttgggttgtgggtctgggagcgtgcagcctccacacaggcctgttgggcttgctgaggcttgggggttctgagaatctcgtcgaggcgagtgtgcggctccttctaccggcttaaagggcctcagttttcggtgggatggcagcggtatttggttgcagccggcc

SEQ ID NO: 8256 - DNA, 435 bp, Homo sapiens
  misc_feature 103: w=a or t
  misc_feature 188: w=a or t
  misc_feature 189: k=g or t
  misc_feature 408: r=a or g
  misc_feature 412: r=a or g
gtgagatttcggtatgtatgtttgtacattgtgtatggtatatataggtttaaatgccacaataattttaaatataatatttcagttaattaagatctgtttwacagttagactgacacttgtgaattgttttctcttcttgacccaatctcatacattactaactgaagttgtcatgtgttcacaawkataatttaaatgaacatagggtttgtgaaaacctgacagatcctaactataattcagctagtgggcagcattataatttatttatagctgtgtaatatagcaattaatgaactaatatacaatgagggcaaattgtactatattttgcatgaaattatacaacacaacaaaggttggcattatgtagttaagtacccacaaaatgttaacctacttgcrataratacaattaataatgtacataaa

SEQ ID NO: 8257 - DNA, 435 bp, Homo sapiens
  misc_feature 430: y=c or t
  misc_feature 431: s=g or c
  misc_feature 432: w=a or t
caggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcyswcga

SEQ ID NO: 8258 - DNA, 285 bp, Homo sapiens
  misc_feature 86: r=a or g
taggtatttgtagcattaggccaacatgtattaagctgagccagatgaataagtccatctgatgtattttcggtgtttaaaaatgrcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactt

SEQ ID NO: 8259 - DNA, 302 bp, Homo sapiens
  misc_feature 109: r=a or g
  misc_feature 110: m=a or c
  misc_feature 112: n=a, g, c or t
  misc_feature 217: n=a, g, c or t
  misc_feature 253: n=a, g, c or t
  misc_feature 279: n=a, g, c or t
  misc_feature 280: n=a, g, c or t
aatcgcttctcggccttttggctaagatcaagtgtagtatctgttcttatcagtttaatatctgatacgtcctctatccgaggacaatatattaaatggatttttggarmanggagatggaataggagcttgctccgtccactccacgcatcgacctggtattgcagtacctccaggaacggtgcaccccctccggggatacaacgtgtttcctaanagtggagggaggtgagagacggtagcacctgcgggncggcttgcacgccgagtgcctgtganngcgccggcttgacttaactgct

SEQ ID NO: 8260 - DNA, 430 bp, Homo sapiens
  misc_feature 373: m=a or c
aatcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggatgcctggtcacaatagggaagcgggggtggctcctcccctagcctgcaggaagcccttggtagcccacttatccaccttctcctgggtgtgtggctcagcagccaagtccttgtgcactgggttgggtcccagcatgagcctggtggcctggcgggccctggcaccatggagagcagcctgctgccagtgatggcctggatctccaagacggmctccagcactgtcatgcccttgaccagctagtgctggtacaggacctgggtaacagg

SEQ ID NO: 8261 - DNA, 495 bp, Homo sapiens
  misc_feature 471: s=g or c
gagattcggagcgcagggagtttgagagaaacttttattttgaagagaccaaggttgagggggggcttatttcctgacagctatttacttagagcaaatgattagttttagaaaggatggactataacattgaatcaattaaaaacgcggtttttgagcccattactgttggagctacagggagagaaacaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtascccatgtctgaagaagagagctcc

SEQ ID NO: 8262 - DNA, 147 bp, Homo sapiens
  misc_feature 107: n=a, g, c or t
  misc_feature 113: k=g or t
  misc_feature 114: n=a, g, c or t
  misc_feature 115: y=c or t
  misc_feature 120: k=g or t
acacacactcttggagagagagcgcgaggcagggagatgatctcctcctcctttttccaaggctgcacttcttggaagtgaagccggtttgggttttgtttcccttncccccknytccckcctcttcctccacccctttcccctccc

SEQ ID NO: 8263 - DNA, 477 bp, Homo sapiens
ttgttctcatccgaatttttgtgagagtagtctacacttgctctttttacctcctcactgcatctcattatggtctttaaccctctatcattccactgaaattgctctttcagatgtcacaaatgatgatctgattgctaaatttaaagtgtatattttcagttttcatcctgaatacttctgctgcatttgatatgaaccactttctccttgaaattctctcctttcttctctgaccatatcttctcaatcacctgccttcaatggattctcttaagggaagcattctaaatgtggctgttcttggagttttatcttgggtgcacttttctacgcacccttatggtttaaaactaacacccaccccaaaatacatgtcttcatctcagacctctcccctgcgtttcagacttatatagctaactaccttcacctaagcatttcactggttcctcaaattcaagtatttaaaactga

SEQ ID NO: 8264 - DNA, 519 bp, Homo sapiens
agcagtttctctccactcacagcctgaagcatacccggcagggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggtatgtggccaaagggcaggaactggcgggaggtgggggaagctgtggaggctgcagagagggcacaggcagagggaagggggctcagggaaaggggaagaggaggcagaggataggggacccagggaagatgcctatagaaatcgtatctgtgccaagatgggccaaggtggggctggagggagcccagcgaaggagaaggggcgtccacagtctcacacagggaggcaggagcaagagtcacc

SEQ ID NO: 8265 - DNA, 437 bp, Homo sapiens
  misc_feature 206: w=a or t
  misc_feature 207: y=c or t
aacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccataaggagcagagtcctttgtactgaccaagatgagcawyatctacatccaggagcctcccacgaatgggaaggttttattgaaaactacagctggagatattgacatagagttgtggtccaaagaagctcctaaagcttgcagaaattttatccaactttgtttggaagcttattatgacaataccatttttcatagagttgtgcctggtttcatagtccaaggcggagatcctactggcacagggagtggtggagagtctatctatgg

SEQ ID NO: 8266 - DNA, 208 bp, Homo sapiens
aaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggtgaggtctttgcacgttgctatactcccccttttaaaagcactcaatgg

SEQ ID NO: 8267 - DNA, 342 bp, Homo sapiens
agagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcac

SEQ ID NO: 8268 - DNA, 320 bp, Homo sapiens
aagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccacctcttgtctgcatagccttcttctctgcctgctcttcaaatactgtgtatttctggccttgttagacttgtttctatcttaacacattttccccgagtgttctcatctacttctaaggtttaatttacc

SEQ ID NO: 8269 - DNA, 185 bp, Homo sapiens
aagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctaggtaatgattggggaagggctgagc

SEQ ID NO: 8270 - DNA, 314 bp, Homo sapiens
  misc_feature 7: n=a, g, c or t
aaatccngatcgttgggactgcggtcgttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaac

SEQ ID NO: 8271 - DNA, 458 bp, Homo sapiens
  misc_feature 403: m=a or c
  misc_feature 409: n=a, g, c or t
  misc_feature 454: r=a or g
  misc_feature 456: y=c or t
  misc_feature 457: y=c or t
agtcagtcaagcgctcttccccgccttcccccaatctggttccaccccttccggatagccgcaggcggggttatcctattcagccaaaacctttctttttctagctggaccagtccggtacgctccgggcctcaccgaggaagtcccaccctgcaggggaaccgactctggccggccctaacccctctcgagcgagtcccgccccatctccggtctgtcctgaaggcagagggaagaccctcacccaacccctgcccgctctcttctaagagctgctagtccttctccaccccaggcgctccctctggctgcccctcccactcgctctgatctctctccgtccgctacttgcggtcgagccttcttgggggagccccgccactgaataccccctttgccatamtcccanctctcttaccccaaccctggacttccagttggccctagctataargyyc

SEQ ID NO: 8272 - DNA, 432 bp, Homo sapiens
  misc_feature 170: m=a or c
  misc_feature 303: r=a or g
  misc_feature 341: m=a or c
  misc_feature 346: y=c or t
  misc_feature 408: y=c or t
  misc_feature 409: w=a or t
agtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgamagaaaaaaaaagtcccttttcgacatcacattcctgtgttttccctcagcctggaaaacatattaatcccagtgcttttacgcccggaaacaaagagactaagccagactatgggggaaagggagataagaargatcctggaaactttaaagagggaaagagtgagattcmgaaaycgccaggactggactttaagggacgtcctgtgtcagcacaagggactggcacacacagacaywcgagaccgaggagaaactgcaga

SEQ ID NO: 8273 - DNA, 232 bp, Homo sapiens
  misc_feature 133: s=g or c
aaaaaactgagtgcgctgagcggggaagcgcaaaggggcaagttacccgtcctggcgtttctggggttcgcctcggaggctagcctcggtgctctcgcaggctcgctcgcttctgcatccccgttggcggccsggagccaactcttaagttctggacgccaggcctgaggcagttccgccatggacttctccaagttcctggcagacgacttcgacgtgaaggagtggatca

SEQ ID NO: 8274 - DNA, 287 bp, Homo sapiens
  misc_feature 203: s=g or c
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcaccggtgggggtgcagagtgtgtcctcttcagtggtatttgcggascgctcgtgcttgagatgcttgtaggaaaaggagtagctaaagagcacgtagcatgccagcaccatggtaatccccgagatgctc

SEQ ID NO: 8275 - DNA, 304 bp, Homo sapiens
  misc_feature 280: m=a or c
cctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggctgtgcgagtgctgatctgctccgtttttgcaaaaggcgcctgtgtctggcagagctggtgtgagamgagacaatcctgccccgccgccgg

SEQ ID NO: 8276 - DNA, 276 bp, Homo sapiens
  misc_feature 97: y=c or t
  misc_feature 180: r=a or g
  misc_feature 182: s=g or c
aggggcgtggggctggatcgcgcaggctgcttcctttaccttcctcccatggtctccttccggttctcgatgcttctctgagcctaagggtttccgycactcgttcaccctccccccagctcatgatcttcctccctcccccgccctcctggtccaatctccgatctgtttagtaagaargsggcctgtgtctggcagagctggtgtgagacgagacaatcctgccccgccgccgggataatcaagagttttggccggacctttgagcatacaccg

SEQ ID NO: 8277 - DNA, 386 bp, Homo sapiens
  misc_feature 338: r=a or g
ctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaraataatggaaaggatgtttaactcttttatctccgaacattgaatgag

SEQ ID NO: 8278 - DNA, 354 bp, Homo sapiens
  misc_feature 104: k=g or t
agagagcatcggccggcgaccgttccggcggccattgcgaaaacttccccacggctactgcgtccacgtggcggtggcgtggggactccctgaaagcagagcgkcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacaggtaggaaggtgtgagggtgtcctacctgcacagttgcgtcctgaagcagtggaatggcctggtgcagtgggcctcccctgggtggaggaggaaggggctctgttgagacgtggg

SEQ ID NO: 8279 - DNA, 578 bp, Homo sapiens
  misc_feature 433: y=c or t
acctcaccacgcccccatctccgtccgtgtacacacactcacacaaggacgccaaccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggcacctctaagatactgatggctctgcagaggacccattcattgcttctgcttttgctgctgaccctgctggggctggggctggtccagcctcctatggccaggatggcatgtaccagcgattcytgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctg

SEQ ID NO: 8280 - DNA, 302 bp, Homo sapiens
  misc_feature 12: y=c or t
agtcgtcagacyggtgctagcgacacgggagtggcaaacgcatcctcttgccgttcccggtgtttgggccttgcctgtgacggtgggaaaagaaaatggccttgctgtgctacaaccggggctgcggtcagcgcttcgatcctgagaccaattccgacgatgcttgcacataccacccaggtgttccggtctttcacgatgcattaaaggtaggaactatattttcatttttttcatatctgtgtagtaaattgagagatgtaatactaaatctttattttctcatctttttttctcagcta

SEQ ID NO: 8281 - DNA, 194 bp, Homo sapiens
tttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagca

SEQ ID NO: 8282 - DNA, 448 bp, Homo sapiens
  misc_feature 206: k=g or t
  misc_feature 324: w=a or t
  misc_feature 325: r=a or g
  misc_feature 326: n=a, g, c or t
  misc_feature 410: w=a or t
  misc_feature 418: r=a or g
aactcggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacgkccttcgggcagtgatggagtgtcgcaatgtcacccatctcctgcaacaagagctgaccgaggcccagaagggctttcaggatgtggaggcccaggccgccacctgcaacccacactgwrnatggccctaatggcttccctggatgcagagaaggcccaaggacaaaagaaagtggaggagcttgagggagagatcactacattwaaccatargcttcaggacgcgtctgcagaggtggagcg

SEQ ID NO: 8283 - DNA, 526 bp, Homo sapiens
  misc_feature 38: y=c or t
  misc_feature 372: w=a or t
  misc_feature 373: n=a, g, c or t
ctcctcggccggcaggggcgcacattttaattcatatytgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggcagctgagtatgtcccagagaaggtgaagaaagcggaaaagaaattagaagagaatccatatgaccttgatgcttggagcattctcattcgagaggcacaggtttagtgatataggattacatttccttctctatgggtccaatcacactacttggttctwngtgaataatattttcataatcctaacattgtaaatgctgtttattggttttcaattttagaatcaacctatagacaaagcacggaagacttatgaacgccttgttgccagttccccagttctggcagattctggaaactgtacattgaagcag

SEQ ID NO: 8284 - DNA, 622 bp, Homo sapiens
  misc_feature 359: r=a or g
  misc_feature 362: n=a, g, c or t
  misc_feature 363: n=a, g, c or t
  misc_feature 382: r=a or g
  misc_feature 383: n=a, g, c or t
ctcctcggccggcaggggcgcacattttaattcatatttgagtgggcggtggcgattggtgttggcggtctggctcagctgggcagggggtaactttactgatttgggggtggtttttagtttaatttttcttttctagcttcccatcgacggtcagtgcgcacgttgtaatcagctgaggccatgtcaggagacggagccacggagcaggtagagacgaggtctcactgtgtttcccaggctggtcttgaactcctggacttaagtgatcctcctgcctcagccttccaaactgttggattacaggcagctgagtatgtcccagagaaggtgaagaaagcggaaaagaaattagaagrganncatatgaccttgatgcttrnagcattctcattcgagaggcacaggtttagtgatataggattacatttccttctctatgggtccaatcacactacttggttctgcagtgaataatattttcataatcctaacattgtaaatgctgtttattggttttcaattttagaatcaacctatagacaaagcacggaagacttatgaacgccttgttgccagttccccagttctggcagattctggaaactgtacattgaagcag

SEQ ID NO: 8285 - DNA, 444 bp, Homo sapiens
  misc_feature 107: r=a or g
agtggttccggttcggctccagccgcccctcggctcctcgccttccccctcccgtccgccttctcccctccctcccgctcctgggaaagagagaaaccaccgctgcrggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagac

SEQ ID NO: 8286 - DNA, 363 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttaggg

SEQ ID NO: 8287 - DNA, 272 bp, Homo sapiens
taatgttagctattattatcatcataatcgttgtgttaaatatattgcccaagataatatgtgggggaatgtttgttttatatgcatattgtatcctgactgtgtgcagaacacattatgtgtattgcatatatgtaaaagaagtgtacaaggaagtggccatccttgttcaagttacgtatctagttagaacaacttcccagtccattggagttctttgagaagcctcagggaagtagctctgggtccttctaatcaacctcccattactg

SEQ ID NO: 8288 - DNA, 362 bp, Homo sapiens
actgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgacacactgaagtcttgaaagggcattcagaagtttcctggcatcaacctacccagtcctggaccccaaatttgaaag

SEQ ID NO: 8289 - DNA, 441 bp, Homo sapiens
  misc_feature 17: w=a or t
  misc_feature 18: w=a or t
  misc_feature 167: w=a or t
  misc_feature 346: s=g or c
ataatggcataaagccwwctagaggatgttgtattttgcacatcagatgtttactagtggctttagtatttttctttgttttaaatggccaaaagaatccagaaacattaaggcagggacagcagtcagaatcgacataaagctttaaaaactcaaggttttttcawcctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaasaggatttcactacctctcttaaggtttagcaaacttctaaatagcccattttaagggagaacttactaactttattgtgaaaggtctaaatgccc

SEQ ID NO: 8290 - DNA, 554 bp, Homo sapiens
  misc_feature 485: n=a, g, c or t
  misc_feature 486: n=a, g, c or t
  misc_feature 487: n=a, g, c or t
  misc_feature 538: w=a or t
tacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgtttnnngctttggttattgtttttttcccttttcttagctatgagctgatcattgcwccttctcacctcctgc

SEQ ID NO: 8291 - DNA, 424 bp, Homo sapiens
  misc_feature 314: n=a, g, c or t
  misc_feature 315: n=a, g, c or t
  misc_feature 317: y=c or t
  misc_feature 423: r=a or g
agtcttctctgcagacaccagcctggtgtcctccttcatcccaggctgccaggctaggcaggggacagcggctgccctggtcctcacagccctggctacggggctggtgacagccagatcctcatgcttctgcgacctgagcgctgccttcagacacctctctgctggcgtgttcctgggtccatgatggaagaaggaaaagtatttttaaaagacaatctgaagctcatactgtgactgcaacataaaatgtgttcacctgaggagactgctttcatcgccagtgtgtcacagatggtggaaacctcagaagnngyacagtccagagtaggggctcaatgcaagctgctggaactgaataaagggcagctgatccaggaccgtccacttccaagccagcaggaggatggaaaagcagaatgra

SEQ ID NO: 8292 - DNA, 453 bp, Homo sapiens
attttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaac

SEQ ID NO: 8293 - DNA, 380 bp, Homo sapiens
  misc_feature 220: w=a or t
  misc_feature 377: y=c or t
ctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggwgatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctcctycca

SEQ ID NO: 8294 - DNA, 354 bp, Homo sapiens
  misc_feature 339: r=a or g
ttttttccctcccttggcccagctttctcaggtttgctttttaattccctcggtttcctgttccggaggcgcgggcggtgccactgtcttggtacctgcggtagtagcctggctttgctctgacggcgatctcgcggcccgagagccttttataggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcaggraacacatgtcacaga

SEQ ID NO: 8295 - DNA, 453 bp, Homo sapiens
  misc_feature 284: n=a, g, c or t
  misc_feature 410: k=g or t
ccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacntcagctggtcccctgggtcgtccacccgatgtcccccattctccccacttggcctcccccacaggctctcggcaaaggaccgtgggaggcacctgtgacactgcccttttcctgtgcagctgtttktcttcttcattcttttcactcctcgttactcttttttttttca

SEQ ID NO: 8296 - DNA, 587 bp, Homo sapiens
  misc_feature 357: r=a or g
  misc_feature 358: k=g or t
  misc_feature 544: k=g or t
ccccttgtggccaagcctggaacatcacatctgtacgttgcaatctgtggatcagctacgagactgagagaaaggaatgaaaggatggaagaattacaagatcaggcactgctgtctgtctgttccacggatgtaaccacagcacacgcgtggctcacggtactagtgtgataaatgcttgttacatgaaggcgtgaacagggatgagaagagacttcctggagaaacaaaaggactaacaatcaggaaggggaggtgatcggggcaggagtaaagtggacacctcagcaaagccattcgctgtgatctctgattgtgcagtgtcatgtcctgtcaccagagccccctcgtgtttgrkgttggccaatgccgccagcatgatctagcaggccaaatcctaatctaccattctctgacaccagctggtcccctgggtcgtccacccgatgtcccccattctccccacttggcctcccccacaggctctcggcaaaggaccgtgggaggcacctgtgacactgcccttttcctgtgcagctgtttktcttcttcattcttttcactcctcgttactcttttttttttca

SEQ ID NO: 8297 - DNA, 190 bp, Homo sapiens
cttcgtccagacgccgccgctgcttccaatctcagtcctcctcctcttccagggccgtctgccgggatctcctccccttctaaacctggtcctccagcggctctggcgccttgttttacatgtggcacccataaaagatgaggctgagaacacggaaagcttctcagcagtcaaatcaaatccaaacaca

SEQ ID NO: 8298 - DNA, 270 bp, Homo sapiens
catgtttttaaccacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgaactccccaacccactgtg

SEQ ID NO: 8299 - DNA, 363 bp, Homo sapiens
  misc_feature 175: r=a or g
  misc_feature 176: r=a or g
  misc_feature 188: n=a, g, c or t
  misc_feature 214: r=a or g
  misc_feature 215: n=a, g, c or t
cacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccrrgggcgcccttcncctggatacggtcactttctacaagrntatggtgacaagctgaacatggagctgagtgagaaatacaagctggacaaagagagctacccagtcttctacctcttccgggatggggactttgagaacccagtcccatacactggggcagttaaaggttggagccatccagcgctgg

SEQ ID NO: 8300 - DNA, 477 bp, Homo sapiens
cagaagaagtttctaggcgcgcgtgccctgggtttattaagctcctggctccgctctagacctcagcggttctggctgccagcctgggcagcctgggaagcctgggaggacggtggcttgccggtctgtcgtgaggcagtgcggacggggaccctctgggattctgctggatctgccccgggggttacctttgggggctgggaccccagtcgaggggacacaaccgtccctggcagtggttggttctgcttctccctgcagaaaagcagcattttcggaagctgaagaataagctagcccagccacaccaccttgttgtgtgaccttgggcaggtggttctgtctctctgagcctctgtttctctctgagctgagcagccaccatggctgacggtcagatgcccttctcctgccactacccaagccgcctgcgccgagaccccttccgggactctcccctctcctctcgcctgctgg

SEQ ID NO: 8301 - DNA, 162 bp, Homo sapiens
aaaaaagaacattaggaatgcctttagtgccttgcttcctgaactagctcacagtagcccggcggcccagggcaatccgaccacatttcactctcaccgctgtaggaatccagatgcaggccaagtacagcagcacgagggacatgctggatgatgatgggg

SEQ ID NO: 8302 - DNA, 209 bp, Homo sapiens
tcagagcttaggacacagagcacatcaaaagttcccaaagagggcttgctctctcttcacctgctctgttctacagcacactaccagaagacagcagaaatgaaaagcatttactttgtggctggattatttgtaatgctggtacaaggcagctggcaacgttcccttcaagacacagaggagaaatccagatcattctcagcttccca

SEQ ID NO: 8303 - DNA, 302 bp, Homo sapiens
catcagcaaatcctgtcgctcgctattccttcaatatgtatccagggtctgaccacttctctctgttcccatcagcaacactttggaacaaactaccaccatctctcatgtctcctcctctgcttccttcacatctgtttccacacgtgtctaccttaagctattctcaacacagtagagattcttttcacatgtaattctgatcatgtcactcctctgctcagaaccttccagtgggtcccaaatcacccagggtaaaagcccaaatccccataaggacctctgaggtcctgtgatgcgac

SEQ ID NO: 8304 - DNA, 620 bp, Homo sapiens
  misc_feature 512: w=a or t
cctttcctgttgcctgccatccctgctgcgagcagggacaagctgggtgctcactcatggcatcttatctgttgcagatagtccactgtgtgcagaggcatgggagttgtcatgttgggaacatgctagacctcagtatccttgagggatgctgccttgggtctggaaactgttagaggaaaccccaagaggtgcaggcactgagcctctcaggacaatgacctggggtcccagctcccctggaggggcctcctcatgattgtttgggggttgatcacagaccaagagtgacgagtgatgtcaccctgtgactcatggccggaccttcttgcccctattgtctcagcacaacattattcgacttttccctcagcgtgtgggcagaggaaaagccctgtggctctggggacttgggatccagagttgaagacccttcagctggctctgccctgccagtgccacagagtgccatggcccaggaagacaggttttcttccatctaggccaggccwtccagtggccatcctccgtgtcctcccgcctcctcctggtgtgacttctgaaaaccaagaatttgttcctgttgactttttctgtgctatggaccattgtcctctcac

SEQ ID NO: 8305 - DNA, 381 bp, Homo sapiens
  misc_feature 190: k=g or t
  misc_feature 375: k=g or t
actcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtkaagaacttgatgtcttatgtggtaaccaagacaaaagcgattaatgggaaataccatcgtttcttgggtcgtcatttcccccgcttctatatcctgtacacaatcttcatgaaaggtacctgtttcccaggcaactactgatcaggcatttctggaccccaaaacaacaaactgatttcttagakatctat

SEQ ID NO: 8306 - DNA, 387 bp, Homo sapiens
actcttctctcccgcttctctcgctgtgaagatggcgctctccagggtgtgctgggctcggtcggctgtgtggggctcggcagtcacccctggacattttgtcacccggaggctgcaacttggtcgctctggcctggcttggggggcccctcggtcttcaaagcttcacctttctccaaaggcagatgtgaagaacttgatgtcttatgtggtaaccaagacaaaagcgattaatgggaaataccatcgtttcttgggtcgtcatttcccccgcttctatatcctgtacacaatcttcatgaaagaaagccttgagccgggccatgcttctcacatcttacctgcctcctcccttgttgagacatcgtttgaagactcatacaactg

SEQ ID NO: 8307 - DNA, 425 bp, Homo sapiens
acttcctctccaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgc

SEQ ID NO: 8308 - DNA, 155 bp, Homo sapiens
  misc_feature 134: k=g or t
  misc_feature 135: w=a or t
tcaagtcattttattgtggttctctgaaccacacacaccactgctttaccttgctatatgccttttcaaaagctgctagtaatgtcttgatagtaacgtccttccttaactcactggccttgtgcattttcctkwgagatccaattcagacaccc

SEQ ID NO: 8309 - DNA, 241 bp, Homo sapiens
agtgacagtcatggtcataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattcc

SEQ ID NO: 8310 - DNA, 493 bp, Homo sapiens
  misc_feature 124: s=g or c
  misc_feature 309: m=a or c
  misc_feature 447: m=a or c
acaagtatgttacgatggctcgattgcttttgcctagcggaaaccattcactaaggaccgagcaccaaataaccaaggaaaaggaagtgagttaaggacgtactcgtcttggtgagagcgtgasctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgmtatgaagtgtgggtcaatgaagaaattgagaaggaaattgaaaaatttcgtgaaataaatgattaaggaaacacaacataccgaaacccagcaaaagcagtacaaagagggaagtttatagctataactgtctacatmaaaaaaggagaactcaaataaccttctaatgatgcatcttaaaaaa

SEQ ID NO: 8311 - DNA, 357 bp, Homo sapiens
  misc_feature 223: w=a or t
  misc_feature 240: n=a, g, c or t
agtacctgtctataaggagtcctgcttatcacaatgaatgttctcctgggcagcgttgtgatctttgccaccttcgtgactttatgcaatgcatcatgctatttcatacctaatgagggagttccaggagattcaaccaggatgtttctacacctgtgggttatgacaaagacaactgccaaagaatcttcaagaaggaggactgcaagtatatcgtggtggwgaagaaggacccaaaanagacctgttctgtcagtgaatggataatctaatgtgcttctagtaggcacagggctcccaggccaggcctcattctcctctggcctctaatagtcaatgattgtgtagccatgcact

SEQ ID NO: 8312 - DNA, 484 bp, Homo sapiens
  misc_feature 468: s=g or c
actcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgttccacgtgctggtggccagccaggacttcgtggagagtgtgctggtgaggaccatcctgcccaagaacaacccacccaccatcgtgcatgacaaagtgctcaacctcatccagtcctggstgacgttccgcagctc

SEQ ID NO: 8313 - DNA, 395 bp, Homo sapiens
caaagagccagggcagaaagaatatgaaacatgttatgactgtgtaaaagttgctaattactgtgttgctgctcctggggttatttcagcctttcatttacagatacctattattttataggtttacatttagaaatgttggtttctggcgcaaattcaatagctttccagatagcaactgtacttttaaaatgctgtttgcttttaaaaggcagtttttcagtcaaagggaagaacttactgtttcggtatatttttatgctgcttgtctgcttgctgactcaaagcgaacccccttatgactttcataagtaatattttgagattatcagcgtaatttgtggggtcttcctgcacagaacctgagctctgtttccttttgcatccttagttcc

SEQ ID NO: 8314 - DNA, 284 bp, Homo sapiens
  misc_feature 198: y=c or t
ggccggtgcagccgcagctgccatcttaggggcgcctggcgctacgggtttctcgttggaggcggccttcgtggcagctgtagacgccgggaaaaggcataaagtccgttggccgacacctttctttcctccggcctcggtagaaccgccagcccgcgtccgaaggcggaggcgaggggaactggccgcgtgaggggyctgaggcgagcggttagagcgtctcccggaaggatgggccggtctcggagccggagctcgtcccgctccaagcacaccaagagcac

SEQ ID NO: 8315 - DNA, 460 bp, Homo sapiens
atttctagtatatttcagagtctcttagaagacttgtgtgggaagtttcactttgttttcagtgaagatcacaaacctccttcttcctttactcaagaggaaaggtcccagtatacatatttgaatggttgatggttttcaagaccttcagggagctccctgcattttacctagaaacagaaaaggcccgcaaaatcttaagtttcctggcctgcatttcccgggtaggggcaaatgactccaagctggtctctaagccaatacccttataaaccagagcccaggaaagacagctcgagtgtataattctctggagctcaattctatgcagttgtgctgatatttcattaagtcactgtgtatttttaagtgttgatacattaaaagtcgctttatggaagatgagtaaattttttaaatacttggaaattttatttccttgttaacttctacagatcag

SEQ ID NO: 8316 - DNA, 337 bp, Homo sapiens
  misc_feature 334: r=a or g
attttgaggcagcagaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttgatgaagactggcccatttgcagagcactccaaccagctgtggaacatcagcrccg

SEQ ID NO: 8317 - DNA, 228 bp, Homo sapiens
acagcgaagagcggctgcgctcggacctcgcagcactcagcctcctaagtgggaggaataacctcacgcaagtcatcaaacaagaggacttcagtgttgcaacgaaggcaagagaaagggcccctgagaaggcgacattcgcactgcagcggcgcagggaccagccaggcggctgagggcaaggtcgttcccagcagcgggaaccgaagggcaaaaggctcggagggg

SEQ ID NO: 8318 - DNA, 502 bp, Homo sapiens
  misc_feature 398: n=a, g, c or t
acttcttctcatctgggcttcctgtcgtcacagcatgatcatattttttcacccttcacttctccttttacacaaatagccccggatatctgtgttaccagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttctgtgntgcatgggctctatcatgggaacaagtgtctgcttatgtcgttcttcatcctgctgctgattatcctccttgctgaggtgaccttggccatcctgctctttgta

SEQ ID NO: 8319 - DNA, 267 bp, Homo sapiens
  misc_feature 130: s=g or c
  misc_feature 131: r=a or g
ttttttctgctccatttcgtgccaaggctaaaagggcatgcccacttgatccctggactctcttgggacgacttccaccctgcatcctcttgcacctcagggcacagtgcgcagatgggcttgccttagsrcccccagccagatttttgaggcctctgtcacacacacccctacaatcccctcccccagccccgagagacttttcttgacttccaccagttgctccggcgggtgagagtggaggagcccctccttcatcccccaggc

SEQ ID NO: 8320 - DNA, 504 bp, Homo sapiens
  misc_feature 322: m=a or c
  misc_feature 389: n=a, g, c or t
  misc_feature 448: w=a or t
  misc_feature 457: n=a, g, c or t
  misc_feature 458: n=a, g, c or t
  misc_feature 459: n=a, g, c or t
  misc_feature 468: w=a or t
agaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcamaaagaggggtgtaaaggggaaaatcagttgcctgattcaagataatttcctctataagctccagatngtgaaacgttgaactgaccatggctgtgctttttacattacttgaaaaataatcgcgtwatgtgtgannnttaagagtwctgtggttaagataagatgttcttgtactaacttgt

SEQ ID NO: 8321 - DNA, 377 bp, Homo sapiens
  misc_feature 55: s=g or c
  misc_feature 87: s=g or c
  misc_feature 313: s=g or c
ctctgtctcctccccctcccgcccttacctccacgcgggaccgcccgcgccagtsaactcctcgcactttgcccctgcttggcagcsgataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatcsgagagccaagatgccggcccacttgctgcaggacgatatctctagctcctataccaccaccacc

SEQ ID NO: 8322 - DNA, 336 bp, Homo sapiens
tatactagcagaggacacagaggaaaagtcaaataaacaacatcatttcagagaatggacacagaaagctcagtcaatcagagactagctcctaaccccatctttctcatggcaaaggatattctgtcccctctctcactgtcctggaatgaaatccgtggccatttcccttttctcatagccaaagacaccaccaagttctccaatccctgactctgattcctgacatcaatctattgctccttgtataatcagtcaatgaatcaaaaaaaatttttttggatatctactatctcctcaggatgaggctctgtcaggggaaaagtaagaacccag

SEQ ID NO: 8323 - DNA, 400 bp, Homo sapiens
  misc_feature 209: r=a or g
  misc_feature 213: r=a or g
  misc_feature 329: w=a or t
  misc_feature 330: s=g or c
aaaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcarcatragcggaggcattttccttttcttcgtggccaatgccataatccacctcttctgcttcagttgaggtgacacgtctcagccttagccctgtgccccctgaaacagctgccaccatcwstcgcaagagaatcccctccatctttgggaggggttgatgccagacatcaccaggttgtagaagttgacag

SEQ ID NO: 8324 - DNA, 278 bp, Homo sapiens
  misc_feature 45: s=g or c
  misc_feature 79: n=a, g, c or t
ccttttagctatgaaatattttggattgcgtagggtcttgcgcascgcgaaaagtagcgtgggccaggacagcgggagnggtcttgcccttggcctggtgtggtggttcatggctgcgatcccggcacattgcggggcggaggcgggaggattgcttgaactcctgacgctgtgatccacctgcctgggtctcccaaagtgctgggattgcaggtgtgagctaccgtgcccagccggcaactagtgttctcatgggagaagaagactttttggaagac

SEQ ID NO: 8325 - DNA, 446 bp, Homo sapiens
cattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggtttgcaggcatgaaatagtgattatatctgtggaaaagcataggaaggcatt

SEQ ID NO: 8326 - DNA, 168 bp, Homo sapiens
agtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttctttttt

SEQ ID NO: 8327 - DNA, 292 bp, Homo sapiens
  misc_feature 285: n=a, g, c or t
aataatcagattggcaaaagtgttaagaaagaaatagggaggatgatctggtacagtgcaatgaagggagctagaggacttctttagacagccatgtgtaccttagaatttgtacagtatacaaatggatagcactgtaagccctcacagcatcacccaggtacacttatttttatttccaagcatctgtggactttccccagcgctcacgctatgctatcatttgcccagaagattcactctccctatcccatcccccagccactctgtgatcattatctaganatatgag

SEQ ID NO: 8328 - DNA, 456 bp, Homo sapiens
  misc_feature 253: k=g or t
  misc_feature 346: w=a or t
  misc_feature 347: w=a or t
caatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtktaaagatgaatgaaaaactgcttcttagtttactacatggtataggcccttttttcttaaacccagggatatgattattttgtcatataattwwgtttcaggctaaaaggtaaatgtgtttgcttcagaaacttgttaacttcagttttttgaatgcaacaggatacctcccttccaaactgaactgtagaagcagagcagca

SEQ ID NO: 8329 - DNA, 395 bp, Homo sapiens
  misc_feature 330: k=g or t
  misc_feature 354: s=g or c
  misc_feature 367: m=a or c
  misc_feature 372: r=a or g
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggagtagaaatgtgctggttcctgggcttcagagggtactcaagggcacagtggggttttatcaactaaatckattgatgcctgcatcttcctcctstggtgttttgtgmatatraaaggcagagcataatctgaaat

SEQ ID NO: 8330 - DNA, 137 bp, Homo sapiens
aaaaacggacggccatctttgatgagggcagagctcacgttgcattgaagacgaaacctcggggaggtcaggcgctgtctttccttccctccctgctcggcggctccaccacagttgcagatcttggtggtagtagc

SEQ ID NO: 8331 - DNA, 455 bp, Homo sapiens
  misc_feature 390: k=g or t
  misc_feature 414: s=g or c
  misc_feature 427: m=a or c
  misc_feature 432: r=a or g
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggactttgcagacccctcagttccctgggattgagacagcacttcctgactgttaccttgggtccagagccaaacccgtcactgaccccccagcccaggcgcccagccactccccaccgctaccatggccgaagacgcagacatgcgcaatgagctggagtagaaatgtgctggttcctgggcttcagagggtactcaagggcacagtggggttttatcaactaaatckattgatgcctgcatcttcctcctstggtgttttgtgmatatraaaggcagagcataatctgaaat

SEQ ID NO: 8332 - DNA, 485 bp, Homo sapiens
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggactttgcagacccctcagttccctgggattgagacagcacttcctgactgttaccttgggtccagagccaaacccgtcactgaccccccagcccaggcgcccagccactccccaccgctaccatggccgaagacggggttggctctggaacctgggctgagatggattcggggagaggctgggtggagcttggcctctacggtctgttcttgcagattcaggagagaaagtggtatgagagcagtgtggtttgtaagttccccaacttccccgctggctcacactgtctccccagaccaatggcctattagcccccaaaaag

SEQ ID NO: 8333 - DNA, 415 bp, Homo sapiens
  misc_feature 349: r=a or g
  misc_feature 350: k=g or t
  misc_feature 409: k=g or t
aggggccgcaacggtgacgactgtggcagagaaggcccggagggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcacrkctcacttccgaaccggggaagaagacaagaaaattaatgaagaactggagtctcaatakcagcaa

SEQ ID NO: 8334 - DNA, 383 bp, Homo sapiens
  misc_feature 321: n=a, g, c or t
  misc_feature 372: n=a, g, c or t
accttttagaaataaggtacaaacaacatccaacccaacctgttcctctgggctagagtcccagacagaaataagggatacacctgacctgcagtaaggaaagcagaacccagtctctggggtggtgaggcccacccagtgtggagctcaaaggtgccactgttctgctcctctttataaagggagctgccatggttctcccagcacagagttgggagtgactccagagcctccagcaagatgctactgattctgctgtcggtggccctgctggccctgagctcagctcagagcttaaatgaagatgtcagccaggaagantctccctccgtaatatcaggaaagccagaaggacgacgcccacaaggaggnaaccagcccca

SEQ ID NO: 8335 - DNA, 405 bp, Homo sapiens
  misc_feature 356: y=c or t
  misc_feature 360: n=a, g, c or t
ttattgaagtctgcccatcatgcaaggcccatctcaaatcttaccttttccttgcattcttcctagatctccccaaccgaatatgatttcttcctcatttgaactctcttgggacaatctacatctcctgatgtttgtataatgcttggtattatgcactcatcttcactactacattggatgctcttggaagataaaagttgtctcttagtagtcttgtatcactgtacaattgtgttactgtacaattgcgttactgtacaattgtgttacggtacaatttgaaacttagggccttgtgtgtatcaggcttttagaaagtattgtggaattgagtagagttttattagctttcyttgnaatcctggtagtctatctagaatctttctagagcgggccaaatgc

SEQ ID NO: 8336 - DNA, 301 bp, Homo sapiens
gtatttaattggatggtggaagacgttgcttattctgtgttttttgctttactgtgacttaaaagttttgcctcttttctctttatattaatgtctgggatttcggacgctttccatgttgttggtagtcaagttgatgtctcctggaggtagtggcaacatccagccctgggaggagagtgcgtgcaggttggagtgcaatggcgtgatcttggttcactgcagcctccacttccccggttcaagcaattctcctgcctcagcctcctgagtaactgggattacaggcacctgacaccaa

SEQ ID NO: 8337 - DNA, 600 bp, Homo sapiens
  misc_feature 247: n=a, g, c or t
  misc_feature 422: r=a or g
  misc_feature 436: k=g or t
actttttttttccaagcggctgccgaagatggcggaggtgcaggtcctggtgcttgatggtcgaggccatctcctgggccgcctggcggcatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagcnactcttccccagggttggggactccaggctcaagaagtaattatgtattaggctagtttttcatttaaacaggaacttagctctggcaagtactgcgctgtgtctggagggtgactgcataggcagtggtgggacctcaggcggctcggccctgctaagcctttcctccctctargccggaaggtggtkgtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgcc

SEQ ID NO: 8338 - DNA, 555 bp, Homo sapiens
  misc_feature 247: n=a, g, c or t
  misc_feature 422: r=a or g
  misc_feature 436: k=g or t
actttttttttccaagcggctgccgaagatggcggaggtgcaggtcctggtgcttgatggtcgaggccatctcctgggccgcctggcggcatcgtggctaaacaggtactgctgggtaagtcgctgctcgtggcccctctgtcatgggcccccgctggaggtcagtgatgagcaacattcaccatctttcgtttgagtctcacggccatgagatcaaccccatgcaccgctctgagacctgccagcnactcttccccagggttggggactccaggctcaagaagtaattatgtattaggctagtttttcatttaaacaggaacttagctctggcaagtactgcgctgtgtctggagggtgactgcataggcagtggtgggacctcaggcggctcggccctgctaagcctttcctccctctargccggaaggtggtkgtcgtacgctgtgaaggcatcatcctccgcaagcggatgaacaccaacccttcccgaggcccctaccacttccgggcccccagccgcatcttctggcggaccgtgcgaggtatgctgcc

SEQ ID NO: 8339 - DNA, 346 bp, Homo sapiens
aacacacttcctgctgcgaaagacccacatgctacaagacgggcaaaataaagtgacagatgaccaccctgcagctctccagcttcctctctgaaatcccagtcccaaaatccagtttcctggccgcctcctggctcagagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacc

SEQ ID NO: 8340 - DNA, 581 bp, Homo sapiens
  misc_feature 578: m=a or c
  misc_feature 579: n=a, g, c or t
actgattcatgtgcatggctgacaggagtactggttcactaccaatgcctgagcttttctcttacatagaaaaactgtccgctctcagtaatcacaagcagcatccgttttgttttctcttcttgggagacatctgtcaaagccaggaatattcttgaaaagaacgtgagcaggaaaaactgctggtgatactttttttaagttttgtttttatcttgcctgttggcttcaatacatttgagaatacgctgaagagggaaaattcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtmntg

SEQ ID NO: 8341 - DNA, 160 bp, Homo sapiens
tagaagaagaaaataatgaagagtttagtattctggaaaccaaattaagaaagtgtttcaagcaggagcaggtgataactctgctttttgaactgtgctttctgggaggctgggtaacatggggtctgagaatcagctgttagatttcactggtgacctg

SEQ ID NO: 8342 - DNA, 562 bp, Homo sapiens
  misc_feature 234: y=c or t
  misc_feature 237: n=a, g, c or t
ctttattcctcaagatgcaacttggatgccagttcttccatgtaggcttccccagttttcatcctcccatttatgattttaagttcctagagggtagtactttgttttgttctttgctgtatcttcagtatcttgatcagtgcctggcatgtagtaggctcttaatacatatttgttgaaagactgaataaaataatttacttttgcactccctcgacatatattcatcaaacyttncttgaattttcgtagtactctctccgtcctttgcactataattagtattgaagttcatttgttatctatagggacttataaaattagcccccactcaaacattcctccctgctcaccagtaaggtctgtacattcacccctctttgtcagtaagtgctcttctaatggtaggattattaacattgaacaatgtaatgcaagtggattctaaaatgaatgttgaaaaaatttaggaagttgaaataaggcaatattggataatggcctgaatcacacgcacaaaaatcactgacaaatgaggattaggtaaatttagaccaattta

SEQ ID NO: 8343 - DNA, 445 bp, Homo sapiens
  misc_feature 94: k=g or t
  misc_feature 117: s=g or c
  misc_feature 121: r=a or g
  misc_feature 123: s=g or c
gacggaagtgctctatcttgttgccggaagtgggaagagagaaaggttgtgatggcggctatagctgcatccgaggtgctggtggacagcgcgkaggaggggtccctcgctgcggcsgcgrastggccgctcagaagcgcgaacagagactgcgcaaattccgggagctgcacctgatgcgggtgagtagtcttggaggccggcttagatccgtcatctggccaagcctgtgcgcttttgtagaggggtcgtgctgccttgacctcccaggttaaggcgatcctcccacctccaagtagctgggactacaggccatcgccaccacacctggctaatttatttatttatttatttaggtagagacgaggtctcactatgttgccctggctggtctcaaaattcctaggctcaagagatcccctgaactcggtctcagcctcccaaa

SEQ ID NO: 8344 - DNA, 268 bp, Homo sapiens
caactctgctgttttgtaggaagccacatggaggtcatttacggttactagttatcttagtcagcttgggcagccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaa

SEQ ID NO: 8345 - DNA, 425 bp, Homo sapiens
ttttttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaacacgaaagtagaaatcacagccagtcagcccaccagcaccatcatcctgcatagtcaccacctgcagatatctagggccaccctcaggaagg

SEQ ID NO: 8346 - DNA, 285 bp, Homo sapiens
cccgcctgcctggccactcttcctccatcagcctggctggcagcagccttggactccgcccgtggagccctgggcctgttgacccaccagcttaggagcacccaccaagctctgggtcaacgtggaggtaccaggccactcaggtactgctcatcatcgttatgtttggtgatcacagttactttctcagcacccttggttggctgcacactgggatcacctgagaagctgtaaattataatggaattctgtgggatgcccacaaatatgagggtagaagacaga

SEQ ID NO: 8347 - DNA, 354 bp, Homo sapiens
  misc_feature 25: s=g or c
  misc_feature 26: s=g or c
cccgcctgcctggccactcttcctssatcagcctggctggcagcagccttggactccgcccgtggagccctgggcctgttgacccaccagcttaggagcacccaccaagctctgggtgttctgggaagatggcatcatgtctggctaccgcacgcgtcgggccctgcggagctggattcgcagctcagatgccttctcgaagctcgctcggtctgtgattgagtagacaatcaggtatgcgtccccgacctgcatgcagtggtcatggagccattcattttcccccttattttcccacatatccaggagtataatcgttgcactttccccatcaaccatcagggttcgttcata

SEQ ID NO: 8348 - DNA, 556 bp, Homo sapiens
  misc_feature 271: n=a, g, c or t
  misc_feature 349: s=g or c
  misc_feature 360: r=a or g
  misc_feature 371: y=c or t
  misc_feature 375: w=a or t
  misc_feature 469: n=a, g, c or t
gatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcanaacaaaatagtgaagtgttggagcggcgaaaaattttgggggtggtatggagagataatgggcgatgtttctcagggstgcttcaagcrggattaggggyggcwtgggaatctagagtgggagagattaagctgaaagaagattttgtggtaaggggtgatattgtgggattgttagaagaaacatttgtcgtataanatgattggtgagggcctggatatggttttgtattaattgagaaactaaacagaagacacaaggtccaaataagagaaggagaaaaac

SEQ ID NO: 8349 - DNA, 215 bp, Homo sapiens
aaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcgg

SEQ ID NO: 8350 - DNA, 396 bp, Homo sapiens
  misc_feature 272: s=g or c
  misc_feature 273: s=g or c
  misc_feature 333: w=a or t
gcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccggtaggaccccggggcgggttcgcgcgtccssgcgagactagagctctcctcagtcgggcaagagtcgcggggcggggctcacagcaggccwgtgcctgtttggggacagggttctctgaggggtgcagtgctcagatcccgggggtatgtggcg

SEQ ID NO: 8351 - DNA, 277 bp, Homo sapiens
gcccccggcccagccggctcttctttgcctctgctggagtccggggagtggcgttggctgctagagcgatgccgggccggagttgcgtcgccttagtcctcctggctgccgccgtcagctgtgccgtcgcgcagacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggca

SEQ ID NO: 8352 - DNA, 195 bp, Homo sapiens
cagtcagtccgcgaggagagtccgcggtggcggcgacggtggcgagagccgcgggggccgtagaagccaaccttccctgcttctccggggccctcgccccctcctccccacaaaatcagggatggaggcgcctccccggcaccctcttagcagccctccccaggaaaagtgtcccccctgagctcctaacactcc

SEQ ID NO: 8353 - DNA, 460 bp, Homo sapiens
  misc_feature 11: w=a or t
  misc_feature 416: r=a or g
acttcctcttwggtgctaggagtgtgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtarcgagcacccccgaagacgacctgagcggccccgaggaagacccg

SEQ ID NO: 8354 - DNA, 527 bp, Homo sapiens
  misc_feature 43: n=a, g, c or t
  misc_feature 49: y=c or t
  misc_feature 71: y=c or t
  misc_feature 105: r=a or g
  misc_feature 133: k=g or t
  misc_feature 163: k=g or t
  misc_feature 186: r=a or g
  misc_feature 202: k=g or t
  misc_feature 225: s=g or c
  misc_feature 235: m=a or c
  misc_feature 281: r=a or g
  misc_feature 318: r=a or g
  misc_feature 320: s=g or c
  misc_feature 328: w=a or t
  misc_feature 336: n=a, g, c or t
  misc_feature 339: m=a or c
  misc_feature 341: s=g or c
  misc_feature 358: w=a or t
  misc_feature 361: r=a or g
  misc_feature 371: m=a or c
  misc_feature 380: n=a, g, c or t
  misc_feature 381: n=a, g, c or t
  misc_feature 382: n=a, g, c or t
  misc_feature 412: s=g or c
  misc_feature 413: n=a, g, c or t
agtcccggttctaaagtccccagtcacccacccggactcggantctccycagacgccgagatgcgggtcayggcgccccgaaccctcctcctgctgctctcgggrgccctggccctgaccgagacctgggcckgctcccactccatgaggtatttctacacckccgtgtcccggcccggccgcggrgagccccgcttcatckcagtgggctacgtggacgacacscagttcgtgmggttcgacagcgacgccgcgagtccgaggaggagccgcgggcgccrtggatagagcaggaggggccggagtattgggaccggrasacacagawctacaagnccmasgcacagactgaccgagwgarcctgcggaamctgcgcggnnnctacaaccagagcgaggccgggtctcacasnctccagagcatgtacggctgcgacgtggggccggacgggcgcctcctccgcgggcatgaccagtacgcctacgacggcaaggattacatcgccctgaaagaggacctgcgctct

SEQ ID NO: 8355 - DNA, 165 bp, Homo sapiens
ctcaggactcagaggctgggatcatggtagatggaaccctccttttactcctctcggaggccctggcccttacccagacctgggcgggtgagtgcggggtcgggatggaaacggcctctaccgggagtagagaggggccggcccggcgggggcgaaggactcggg

SEQ ID NO: 8356 - DNA, 378 bp, Homo sapiens
cttattatccttttaatgtctttaggatctgtaatgatgctctctatgttggttatcttttgctgctatttacttcaaaccttagtggcttaaaacaaaaacaattattgtctcactgtttctgtggatttgaaatttgcgaacaacttggatggtagttcttgatcaaaatctctcatgatcttgcaatcaagatatttgccaagactttgatggtctaaaacagggtgtccaatcttttggcttccctgggtcacattggaagaagaagaattgtcttgggcacacataaaatacactaatgatagctgataagctaaaaaaaaatcacaaaaaatcccataatgttttaagaaagtttattaatttgtgttgggc

SEQ ID NO: 8357 - DNA, 471 bp, Homo sapiens
tcccgacttctagaaacaaaattccttttggggcgctttccctgtgtgtccccagagaggcctctagccaggagccttcagttgggattaggtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgc

SEQ ID NO: 8358 - DNA, 282 bp, Homo sapiens
  misc_feature 58: k=g or t
  misc_feature 250: n=a, g, c or t
ttcttgctggatcagaggctttaaaatcttttttcatcttctagctgtagctcgggckgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaaganaaaaaataataaagagagccaagcagaagagg

SEQ ID NO: 8359 - DNA, 239 bp, Homo sapiens
atgcgctcgcatcatggcggctgagtgggcttctcgtttctggctttgggctacgctgctgattcctgcggccgcggtctacgaagaccaagtgggcaagtttgattggtgcgtacgtgtggaacatattcgagagataagtggctgtttccccagtacctgtctcctacctgctaaaggttgtcacttaacaggattggccgcataatttgcaggacagtacaaaatgaaaacgtggg

SEQ ID NO: 8360 - DNA, 401 bp, Homo sapiens
  misc_feature 336: n=a, g, c or t
cccccttgccctagccttcctgtgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttgnacacaccctggccagagccagctgtttgcagactgagccgagaggagctgacggctgtgatgcgc

SEQ ID NO: 8361 - DNA, 297 bp, Homo sapiens
gaaagaatgcgggggctgagcgcagaagcggctcgaggctggaagaggatcctgggcgccgccaggttctgtggacaatcacaatgggaatccaaggagggtctgtcctgttcgggctgctgctcgtcctggctgtcgtctgccattcaggtgagtgctccagtctcaggacatagatctaggctgccttggccatgaactcccttcttaagcctcagtttcagccccagctgctcctccaggcctggctttggttcttttgccttccagtgttacaggtctggggttgtatgacag

SEQ ID NO: 8362 - DNA, 250 bp, Homo sapiens
  misc_feature 190: m=a or c
  misc_feature 205: r=a or g
  misc_feature 209: r=a or g
  misc_feature 213: r=a or g
  misc_feature 221: y=c or t
  misc_feature 224: w=a or t
  misc_feature 226: s=g or c
  misc_feature 232: r=a or g
gtttgttgtcattggcggctcccaagatggcgtccatcatggaagggccgctgagcaaatggactaacgtgatgaagggctggcagtaccgttggttccgtgctggactacaatgcaggactgctctcctactacacgtccaaggacaaaatgatgagaggctctcgcagaggatgtgttagactcagamccgtgatgctgatgrgcgrgagragtggatycawgscttagragaaacaattcttcgaca

SEQ ID NO: 8363 - DNA, 453 bp, Homo sapiens
  misc_feature 213: w=a or t
  misc_feature 214: w=a or t
ggcgtgtggaacctgacggaactgccacgatgctgccactttggactctttcactgctgctgggagcagtagcaggaaaagaagtttgctacgaaagactcggctgcttcagtgatgactccccatggtcaggaattacggaaagacccctccatatattgccttggtctccaaaagatgtcaacacccgcttcctcctatatactaatgagwwcccaaacgtaactccttccatttcttgatctgattatgagtatcgttactcaagttaacataatccttccctctctacaaacatgttcttttaaaattttccaactcttgggaagaatgatatcaaatctcttgcagtggtgaatacaagagttactttctgcttacagcagaactaaatacaatgaaggtaacatgctctgagtggtagagaaaaaaagaataaaagatatggattat

SEQ ID NO: 8364 - DNA, 429 bp, Homo sapiens
  misc_feature 196: n=a, g, c or t
agttacctctcccctttcacgtagttttcatttgtggtgagattctctcccaggccacaagacatttcctgctcggaaccttgtttactaattgtctctgtggcacattttgtttcccgtgccttgggtgtcaagttgcagctgatatgaatgaatgctgtctgtgtggaacaagcgtcgcaatgaggactctctncaggacccgatatggcatccctggatctatttgtgatgactatatggcaactctttgctgtcctcattgtactctttgccaaatcaagagagatatcaacagaaggagagccatgcgtactttctaaaaactgatggtgaaaagctcttaccgaagcaacaaaattcagcagacacctcttcagcttgagttcttcaccatcttttgcaactgaaatatgatggatatgctta

SEQ ID NO: 8365 - DNA, 343 bp, Homo sapiens
  misc_feature 13: n=a, g, c or t
attccctacccancagccctcgcgcggtccggcacagcggacaccaggactccaaaatggcgtcagttgtaccagtgaaggacaagaaacttctggaggtcaaactgggggagctgccaagctggatcttgatgcgggacttcagtcctagtggcattttcggagcgtttcaaagagagcacgagcggctccgcaaataccactgaagaggacacactctgcacccccccaccccacgacttggcccgagcccctccgtgaggaacacaatctcaatcgttgctgaatcctttcatatcctaataggaattaacctccaaataaaacatgactggtacgtgtg

SEQ ID NO: 8366 - DNA, 133 bp, Homo sapiens
  misc_feature 30: s=g or c
  misc_feature 132: w=a or t
gaggttctagtctgttctgtcttgcggcascgcccccttctgcgcggtcacgccgagccagcgcctgggcctggaaccgggccgtagcccccccagtttcgcccaccaccaccctaccacacattcgaagawc

SEQ ID NO: 8367 - DNA, 412 bp, Homo sapiens
  misc_feature 254: r=a or g
tcagttagaaagatatagcttaccagttttccatgtgcttaaggaagtcaagaatatttcaggttgttgagaactgttgtaaaatggaattgaagctagtgtctctcaccttcttaggtgtatcagagagaggaagtggaaggccagtagtagcatcttcatacttacttttgccagcccagcctccatttcaaagactttgtcttccatcctatccaatgacatggtcagggatgggctctgaggaggcagtraggccccaccttggtttgctccactggtgtgtagtctccaaacagcttaagggtttttaagttttctcacgattacctccactccactcatctactatcagcatcagaaaggttaacatccctgggaccattctacttataaaagagatgaactagtg

SEQ ID NO: 8368 - DNA, 276 bp, Homo sapiens
ccatcaacaccacaacaggagtcttcgaaaccgttgggaggaattcagccttcttctcagaccatccagcctaaagtggagactgatgctgcccaggcggctgtgcagagtgcatttgcagttctgttgactcagttaataaaggctcagcagtcaaagcagaaagatgtgctactagaagagagggaaaatggatcgggacatgaagcgtcattacaactcaggccacctccagaacctagcactccggtgtcgggacaagatgacctcatccag

SEQ ID NO: 8369 - DNA, 383 bp, Homo sapiens
  misc_feature 185: s=g or c
  misc_feature 212: k=g or t
agttccaaaatggcggcaggggtggccgggtggggggttgaggcagaggagttcgaagatgctcctgatgtggagccgctggagcctacacttagcaacatcatcgagcagcgcacctgaagtggatcttcgtcgggggcaagggtggtgtgggcaagaccacctgcagctgcagcctggcagtscagctctccaaggggcgtgagagtgtkctgatcatctccacagacccagcacacaacatctcagatgcttttgaccagaagttctcaaaggtgcctaccaaggtcaaaggctatgacaacctctttgctatggagattgaccccagcctgggcgtggcggagctgcctgaccttagctctcaccatcgctcttctact

SEQ ID NO: 8370 - DNA, 240 bp, Homo sapiens
acactacggtgtttccggcttcaagatggtcgcctaagctgtttagtgaaacttcttccacctttctccattcctctaggtgctttttctgaacctggatgtgaggcattaaaggatccgacggaaatagaattgaaggcattctaaaatggctaaccgtacagtgaaggatgcgcacagcatccatggcaccaaccctcaatatctggtggagaagatcattcgaacgcgaatctatga

SEQ ID NO: 8371 - DNA, 652 bp, Homo sapiens
gtcattttcttgctcttgagctctggcacttctctgctgcgtctgctgctgaggcctgcagagattaatataaacggcagccttgaaccttcggagggtgttcctttgagatgtttcatcagtgacatcacagtgattgccagcttccacggactactttaggcgctgcccagagtccaggagtccagacagcctgggaggggagaaggagttggagctcaagttggagacagcgaggagaaacctgccatagccagggtgtgtctttgatcctcttcaggaggtgaggacaagccagaggtccttggtgtgccctcagaaatctgcctgcagttctcaccaagccgctgtgaaaatggggataaacacccgggagctgtttctcaacttcactattgtcttgattacggttattcttatgtggctccttgtgaggtcctatcagtactgagaggccatgccatggtcctgggattgactgagatgctccggagctgcctgctctatgccctgagaccccactgctgtcattgtcacaggatgccattctccatccgagggcacctgtgacctgcactcacaatatctgctatgctgtagtgctaggattgattatgtgttctccaaagatgctgctcccaagggctgccaa

SEQ ID NO: 8372 - DNA, 199 bp, Homo sapiens
  misc_feature 165: n=a, g, c or t
aacgtcatctaggagcaccgagcagcttggctaaaagtaagggtgtcgtgctgatggccctgtgcgcactgacccgcgctctgcgctctctgaacctggcgcccccgaccgtcgccgcccctgccccgagtctgttccccgccgcccagatgatgaacaatggcntcctccaacagccctctgccttgatgttgctccc

SEQ ID NO: 8373 - DNA, 448 bp, Homo sapiens
  misc_feature 96: y=c or t
  misc_feature 165: n=a, g, c or t
  misc_feature 362: n=a, g, c or t
  misc_feature 411: n=a, g, c or t
aacgtcatctaggagcaccgagcagcttggctaaaagtaagggtgtcgtgctgatggccctgtgcgcactgacccgcgctctgcgctctctgaacytggcgcccccgaccgtcgccgcccctgccccgagtctgttccccgccgcccaggtaatccatcttaccngggaagaaggctgcttccattcgggctgccggagatggggtctgcgggcatgcgaggcgggagttgcgagtctggtcaggagtcatgcaggtccgtgaccttggataaggcacacttagcctcagctttttcctctacaagtgttgctttctcatagggcgaaattcttcagacgagatacttaaggtgaaagtgcnttgcagatcaccggttgtgcaggtttcagtaataacgtttcgaggtgcntatgataagccaggttataggtaatagacgtttcaaa

SEQ ID NO: 8374 - DNA, 256 bp, Homo sapiens
  misc_feature 13: n=a, g, c or t
  misc_feature 14: m=a or c
  misc_feature 196: w=a or t
cttgaatatgtanmtgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgawactttggttgctgagtcttgttttaagtggccttgatatttaaaactattcctgccaccg

SEQ ID NO: 8375 - DNA, 354 bp, Homo sapiens
cgatgagctaacaattttactagatgttttgaagtcattaccttatttatcctcacagtagcccattttactattcccattttacaggagagagtattgaagctcagggaggctacaaatcttaaataaaattactcagacaagcagtggcagaactccgaatcaggtctttatatgtctaaatctggagcctggggcccttaccccttccaccagaagttacaaatcaggctagactgcagttctcggttgtgttttgtttggcctacacagtggtgttttactattttttgtttctttttgagatggagtcttgctctgtgcccaggttgaagtggaatggtgcatctcggc

SEQ ID NO: 8376 - DNA, 244 bp, Homo sapiens
catagtcagtttacttaggttcattcacatatttatgtttattttactcttcattctttgctgtatctttgactttctatccggggtagttttccttctgcctgaagtatcctttagaaatttgtgtagtgtggatctgctatgacaaactctctgtattgtcttaagtttactttcatcattgaagattattttccctggttataaaattatttggatggcactttattttagctcatcaggc

SEQ ID NO: 8377 - DNA, 305 bp, Homo sapiens
  misc_feature 278: k=g or t
gtaaagtggctggtgccggtgccaattaggatgaggcgcttgccttcaggaagagtcccaaagccaagctctgactccaggaccagggttctggtccgtctctctagctggttcagctctgaatccacacctgagaagcatgaacgcccgcccagggacaagggctacaaggctggtgtatatttacatgcacagaaaccggagccatgaatcagtgagccagagtggtagcttttaaaattcaggaagcgaattggggcttcattaaagcagtatckttgccgtgtgcctggcccgatgtccac

SEQ ID NO: 8378 - DNA, 343 bp, Homo sapiens
tgaaggaaggatagttgcctacggcctgctgaagacagggttgggatcatctgcatctgtctagggtgatattttttcattggcatattgttagaagctgaaatctcaatgatgaaaattcccagggcagcctttgagaatttcagggttcagtagctagtcagagagggcagcaaacagctgtcgtgggggatgcattggctgcagctgggccagaccaggtctcagcggaggagttgggtgttctgtttcagaggcctggcatcttgcatattcagcctgcaaggcagtgatcaggtcttaagtaaatcacctagccaagagaggccccacggttgaaaag

SEQ ID NO: 8379 - DNA, 265 bp, Homo sapiens
cattaccacaatgcctcatctctacctcctttccccctgtagttccaacgtgggtatctttgccatctctggcccgaagactttctgacctacatgtataaataccccctcacaatatatattacttttcctataagtgacttctctactggattactggttgctcatacacctcatattttactcgtaaatctactactccctgtctgcctactccattctcatttgctgtagaaaattctcttaccatcccaactttcaccca

SEQ ID NO: 8380 - DNA, 536 bp, Homo sapiens
  misc_feature 414: r=a or g
aaaaaaatttacatgacattatttacataccaaacctgccctacgcttcctggaaactttactacttatgagtgtggctcctccttccctttcaatcccttaattaaatagcttcccctctacaggcttttgaagtggtagcagttcctcctaactcctgccagaaacagctctcctcaacatgagagctgcacccctcctcctggccagggcagcaagccttagccttggcttcttgtttctgctttttttctggctagaccgaagtgtactagccaaggagttgaagtttgtgactttggtgtttcggcatggagaccgaagtcccattgacacctttcccactgaccccataaaggaatcctcatggccacaaggatttggccaactcacccagctgggcatggagcagcrtaattctgcaagagttcataagattgacaaagcgatgaggttttacatttacctgtaaaatatcttcttggaaacagtctgcagactgataggttttagtagctgagcatgtcttgaagaac

SEQ ID NO: 8381 - DNA, 535 bp, Homo sapiens
  misc_feature 5: r=a or g
  misc_feature 120: r=a or g
  misc_feature 240: s=g or c
  misc_feature 289: k=g or t
  misc_feature 418: k=g or t
  misc_feature 477: k=g or t
acgartccggaactggtcttctgtgattttcattcgccctggtctctgttccctttcgtactcaaagctcgtgcatccagggaggggaaaccggagatagggtcttcgggccccgggcaraccctctgtgccgctgcaaaccgttgcagcctgaggctgtcaggtcctcccccagacacctgcggaccctccctctcctggcttcccgtctggtcatggcgagattctgggtctgcgtascggtgctggcttctttcttgcatttttggttttgcattcgcgtttttgkggctctccagttttgaggaactttacttttgcagtttcctggagaactgagaaaattctttaccggctggatgtgggttggcctaagcacccagaatattttaccggaacaacattttgtgttgcagtkgactccctcaatggattggtttacataggtcaaagaggggataacatcccaaagatatkagtgttcacagaggatggatatttcctacgagcctggaattatacagttgacacacct

SEQ ID NO: 8382 - DNA, 361 bp, Homo sapiens
tcatcagtaaatatcggagaacagaaccagcggtggtcttccatttactttttttactcttggctgcattcaggaagaaatttgataagtactctcatattacaagggttgagttgtctttgtagttttaatttgaggccaatatctgaggcctagaattgcacgagcagaggctagagggcatgtggcagaatttattgtggtgtgcagtttgcagttattgctttggtctttttcccagttggaagtcctaagcaataggatggcacatttgtggggaaagaacactgtcctggcattctcagggatcttcggggttttaaaatttggttcatatccactgctgttacttacgcaaaag

SEQ ID NO: 8383 - DNA, 359 bp, Homo sapiens
  misc_feature 320: m=a or c
attcatctgtgcacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgmtgctgctgctgctcgccccgtcgttacaccaacccgagg

SEQ ID NO: 8384 - DNA, 162 bp, Homo sapiens
  misc_feature 161: m=a or c
gagaggaaacaaagtgctgcgagcaggagacggcggcggcgcgaaccctgctgggcctccagtcaccctcgtcttgcattttcccgcgtgcgtgtgtgagtgggtgtgtgtgttttcttacaaagggtatttcgcgatcgatcgattgattcgtagttccmc

SEQ ID NO: 8385 - DNA, 390 bp, Homo sapiens
  misc_feature 111: r=a or g
  misc_feature 354: k=g or t
gtttgctgcatagattacaacggtgatggcgggcaagcggtccggctggagccgggcggctctcctccagctccttctcggcgtgaacctggtggtgatgccgcccacccrggcccggagtctgcgcttcgttaccttgctgtaccgccatggagaccgttcaccagtgaagacatatcccaaggacccctatcaggaagaagaatggccccaggggtttggtcagttaaccaaggaggggatgcagcggccttccaaattcttctaactcttccaaaagccttctgccttagttttttttaaattacaccagtccttttagtagctttttgatgtgatttttaaccaacttakagtgcctgggcttcacccctgaacatcagcgagact

SEQ ID NO: 8386 - DNA, 432 bp, Homo sapiens
gtcacctccgctctacgccaaatttaagactcatttcttaaggatgtctctattttctgctttatttgcacattgatggctctgctgctcagctggccacggccgcccggcgtctgagatagaattgtgttaatatgagaaagggaacggccgatcatgattagcaggcagacggcatgcagatagcatctggcgggttttctccgtttttatatgaaagcgttcacttgtttgctggtaaacacgaggttttaactttttatctgggtagtggtgaccgtttgtttcactctcccctcctttttacttcctattcattagcttttccgtttggaaagctgcatacttgttagcggtagtttggtgtcttgactctgaagctttctcttccagcagaggtgggatctgtatccctcccatcctaggttacca

SEQ ID NO: 8387 - DNA, 404 bp, Homo sapiens
ccttcttattcttcatgccttcttaggaaacacttccttccagataacccctaagccaggttatgtgttgttgctatatgtagttggaacactgtattttttccttatcacttatataatttttggttatttatttagttatctatctgtaggtctatgaggagaagtacataccttgttcatttttatatccctgtatcctgcacaaagcctagatcaaattatgcttaataaacatttattgaattaataaatatcatatttttgaatttggaaaattagtatttgtaaaattccatcatgacactgactatgaagttctttcaaactatattctcttaccttcagtgggttaatatatttcagaaccctaggtcaatttcagtactaggtatcagagggca

SEQ ID NO: 8388 - DNA, 312 bp, Homo sapiens
  misc_feature 256: r=a or g
gaaaatagctgagggattactgtcttcttaataaaactggttaggcattacatggaaatttaaaactgaaaacaaagccctttgtttttaaatttttacttttcaagtaaaattatgatttacagattatttacagattgcttttggaaggagatactgggtggtgtacatctcatcctcctccccttccctttgttgttcttctacgtaaacacttggtcaagagaaagtagaactagagaactgcaactccgcrccaagttacatttgatttgaagaacgggtgttaatttcatggtgacatattagcgg

SEQ ID NO: 8389 - DNA, 1056 bp, Homo sapiens
attaaaaaaaatcaatgcggtctctttacagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcttttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgc

SEQ ID NO: 8390 - DNA, 437 bp, Homo sapiens
  misc_feature 159: r=a or g
  misc_feature 216: r=a or g
  misc_feature 267: m=a or c
  misc_feature 321: n=a, g, c or t
  misc_feature 359: r=a or g
agacttcctccttcacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccargcccaggcccagagcgattgcagttgctctacggtgagcccgggcgtgctggcaggratcgtgatgggagacctggtgctgacagtgctcattgccctggccgtgtamttcctgggccggctggtccctcgggggcgaggggctgcggagggagctccaggntcagaggtcggatgtcctacagcgacctcaacacacaraggccgtaattacaaatgagcccgaatcatgacagtcagcaacatgatacctggatccagccattcctgaagcccacc

SEQ ID NO: 8391 - DNA, 438 bp, Homo sapiens
  misc_feature 326: s=g or c
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcaccagcatcgtgcctgaagccatgcctgctgccaccatgccagtcctgctcctcactggcctttttctcttggtgtggaattatgagggcacatcctcaataccaggtcctggctactgcatgggaattggacccctcatctcccasggcagattcctgtggatggggatcggcagtgcctgcaactactacaaccgggtgcgttgccctccgactttcgatcttgattaatgaaacattcttggcaaatgctttcgct

SEQ ID NO: 8392 - DNA, 257 bp, Homo sapiens
agatacgcgacgcgtacaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcaggacgacggcggcagcagcctcccccaccccgatccccacagtcaccgcc

SEQ ID NO: 8393 - DNA, 267 bp, Homo sapiens
catgacttgtttctttgttcctctgttactgcgttattttgtgttaaatagatattttctagtgtactactataacttgctgtttattttagttttttggggggaattattcgcagttgctctggggcttgcaattaacatcttaactttaaacagtctagtttaaattgatactatttaatttcagtattaaaaacttctacttagctctgttttcttctttttttgctattgtcatgcaaattacatctttatacattataagcc

SEQ ID NO: 8394 - DNA, 182 bp, Homo sapiens
gcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtaagcacatctttctgacctacagc

SEQ ID NO: 8395 - DNA, 516 bp, Homo sapiens
  misc_feature 21: y=c or t
  misc_feature 36: r=a or g
cttccccgcgctcaggttcgygcgtccgcgccccartgtcgggtctgcgtggatcggtccttccaggacaccgtcgccttcccggccgcgtcggagtccggcggcgacctgcctctgaaacatggcaggctcggatgctggtgagtgtctccctggggtcccagtatgtgtggactgaaaccgtccacctccagggaggcctcgggctagcccggactgggtctgggctgtcggcggggctcgtgaccttcagacgccgcgtcgcgctggcgggttccctggatagggtctctcagcttcaccacctcttcgcttcgaggccgtggaacagcagtatgctgtgggagagagagaggcactggggcgaggccggtaggacacttgggtcctggctgtaaaaagagcggtcagaagggtcgtccccggacttgtctttctgtggggcgtctagcgctgtccgtgtgccctccgcccttgcactatgggccctgatgtcgtacctgcttttgtattggt

SEQ ID NO: 8396 - DNA, 568 bp, Homo sapiens
  misc_feature 91: k=g or t
  misc_feature 92: k=g or t
  misc_feature 508: r=a or g
  misc_feature 510: s=g or c
  misc_feature 525: m=a or c
  misc_feature 551: r=a or g
  misc_feature 556: r=a or g
gaattgcttctatggctccatcctgctttccggctgtcgccctcatgcgataggctctcagcgttacttgactcttctcgcgataattttkktttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccagggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgrasaggcttccatccaamcatccagaatgcaattgatacggagragtcrcaacaggcactg

SEQ ID NO: 8397 - DNA, 549 bp, Homo sapiens
  misc_feature 439: m=a or c
gactctgtggtcagggaactgctcgctgagcacagctgcacagtgctgtcagaacggccgatctccagcccaagatgattccagcagtggtcttgctcttactccttttggttgaacaagcagcggccctgggagagcctcagctctgctatatcctggatgccatcctgtttctgtatggaattgtcctcaccctcctctactgtcgactgaagatccaagtgcgaaaggcagctataaccagctatgagaaatcagatggtgtttacacgggcctgagcaccaggaaccaggagacttacgagactctgaagcatgagaaaccaccacagtagctttagaatagatgcggtcatattcttctttggcttctggttcttccagccctcatggttggcatcacatatgcctgcatgccattaacaccagctggccctamccctataatgatcctgtgtcctaaattaatatacaccagtggttcctcctccctgttaaagactaatgctcagatgctgtttacggatatttatattctagtctcactct

SEQ ID NO: 8398 - DNA, 159 bp, Homo sapiens
taccttccagtcaggatgacggtattatgcttcttggagtcttccaaaccaccttccctcatctttcatcaatcattgtacagtttgtttacacacgtgcaatttgtttgtgcttctaatatttattgctttataaataaaccagaccaggacttgcaa

SEQ ID NO: 8399 - DNA, 458 bp, Homo sapiens
  misc_feature 438: m=a or c
agctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgattcttccgaaccctcatagcggcaatcctctacctgatcamctccattgttgtccttgttg

SEQ ID NO: 8400 - DNA, 292 bp, Homo sapiens
  misc_feature 193: s=g or c
ggattctctggtaaggcaccggaagtgaccgcctcgcgctgcttcctctcctggagtccagagtcccgctgctccgccgcgatattcagtaaaccactgggagtccggcagcatggaggcagcgcgccctcccccgacggcagggaagttcgtggtggtcggcggcggcatcgcgggcgtcacttgtgcggasagttggctactcactttccatcggaagatattctcttggtaacagcttctcctgttattaaagcagttacaaatttcaagcagatttctaaaatattgg

SEQ ID NO: 8401 - DNA, 391 bp, Homo sapiens
  misc_feature 88: s=g or c
  misc_feature 326: s=g or c
  misc_feature 337: m=a or c
  misc_feature 343: k=g or t
  misc_feature 364: k=g or t
  misc_feature 383: m=a or c
gtccggcccggtcctgtcccgcagcgtcccgccagccagctccttgcacccttcgcggccgaggcgctccctggtgctccccgcgcascatggctcagcacttctccctggccgcctgcgacgtggtcggattcgacctggaccacactctgtgtcgctacaacctgcccgaggagcgccccgctcatttataatagctttgcccagttcctagttaaggagaaagggtacgataaggaattgctcaatgtgaccccagaggattgggatttctgttgcaaaggtttggcattggatctagaagatgggaacttccttaaacttgsaaataatggcmctgttkctcaggtaataaaacttaagktgtgaagtctaaactttamcttctctg

SEQ ID NO: 8402 - DNA, 398 bp, Homo sapiens
  misc_feature 378: m=a or c
  misc_feature 390: k=g or t
tccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatattttataggctattttctcaaggtgtttctagattccacatatctattttatataacaagttattatgttatgtgtgtgamtcccttgtgtgkatctgtgc

SEQ ID NO: 8403 - DNA, 570 bp, Homo sapiens
  misc_feature 462: r=a or g
  misc_feature 469: k=g or t
  misc_feature 518: k=g or t
  misc_feature 519: n=a, g, c or t
  misc_feature 520: n=a, g, c or t
  misc_feature 541: n=a, g, c or t
atttttttttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgatgatcggctgaatgtaacagaggaactaacgtccaacgacaagacgaggattctcaacgtccagtccaggctcacagacgccaracgcatkaactggcgaacagtgctgagtggcggcagctctacatcgagatcccggknngcgcgctgctcgaggggagcnaggacagctttgcagttctcctggagttc

SEQ ID NO: 8404 - DNA, 270 bp, Homo sapiens
atttttttttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagaggtaagtgccccgcccccgtccgaagcttccagaagcgccg

SEQ ID NO: 8405 - DNA, 478 bp, Homo sapiens
atttttttttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggctgctggggctgctctggggccacaggtacttcttgtgcaaccttgctgccgtactgtgattgaatgtaatcgtgggaacctgag

SEQ ID NO: 8406 - DNA, 353 bp, Homo sapiens
atttctaaagcctcctttggagttactactgattgtaatttggaactgataataggtagagattgctaacactgttttttttcctggatcttttttatgccagaaattaaacaggttctgctaactcttttttttctcttggttatctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcc

SEQ ID NO: 8407 - DNA, 178 bp, Homo sapiens
  misc_feature 32: m=a or c
gatttaaacccgggcagcctggagtgcagctmatactccatgcccagaattcctgcctcgccactgtcctgctgccctccagacatgctggggccctgcatgctgctgctgctgctgctgctgggcctgaggctacagctctccctgggcatcatcccagttgaggaggagaacccgg

SEQ ID NO: 8408 - DNA, 406 bp, Homo sapiens
aatactagcccaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtcacgccac

SEQ ID NO: 8409 - DNA, 422 bp, Homo sapiens
  misc_feature 10: s=g or c
  misc_feature 11: n=a, g, c or t
  misc_feature 34: k=g or t
  misc_feature 388: y=c or t
aaggaaggtsngacgttggaggggtggccgcatkgagtgagtactgtctctggccaccgagcagagccagtgacagcagcgtcctggtaggcaggcaggcgtatcaggtttcagaggatgcggctgggaacgggagtagaggtgaggggtcgttgcatctgtcgcggtgtgtatcttttgggggttcagcgccaccagcgacttgggcctcattcatcgcgcttacatttctccacctcatttgaagaacgagcttcgtagcccacggagctgaggtatatgagctccctgaaagcacaaagcagttatttccatcttcagatcattcagagattatgaaggcacaaaccctgccttcaatttgcttatagtcaagtggagcagacayaagtcaatgattgcagtatagccactgaagtaat

SEQ ID NO: 8410 - DNA, 280 bp, Homo sapiens
  misc_feature 18: n=a, g, c or t
  misc_feature 220: m=a or c
gtgtgcgagcgtgtgtgnctgggggaagccattgcctgtttaatagttgctgttgctgcacttccgcttctctcccagcgagagagagacacgagtggccaggcccagccgcagccgcagcagcagccgccgcggcgcacggaggagccagacacaaagagaggggctgtttgcggggtggggtggggggttcgctatgtcggatgacgattcgagggcmagcaccagctcctcctcatcttcgtcttccaaccagcaaaccgagaaagacacaaacacc

SEQ ID NO: 8411 - DNA, 230 bp, Homo sapiens
  misc_feature 54: s=g or c
attcgtcgctctgcatctggtttgtcagatccgagaggctctgaaactgcggasggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgcc

SEQ ID NO: 8412 - DNA, 287 bp, Homo sapiens
  misc_feature 136: n=a, g, c or t
ggaagctctgcctgtgcgaccgccgcccacccgagcctatctgggctgcgtcttctcgccgctgctcttcgtggcccaacgccccaatccttgcgtgtccttgcagtcccaccccacactcagccttgtgtccctncgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttc

SEQ ID NO: 8413 - DNA, 195 bp, Homo sapiens
gtccttctcgcgcctcgctctggccctgcaggttgtgtttccgcctctaccccgcctccattccgttgctctctcagtctcagacccgggctctcggtccgccgcttcaggtcttggcgcactcagagagttggcgcggctctgtgttgaccaaacctagtggatgcagttagcgccggagcccggccccgcccg

SEQ ID NO: 8414 - DNA, 279 bp, Homo sapiens
agaacccaacatggatttgatcaacctgctcacggtgagttccaaggagccaagtttgggctcaataattatcacatccttctgtatgtcctccagtcatctgctcctctttatcctcactgcactgctttggctgaagcctggagtaatgcaaggaccttatctgtgatccccctgttcccattatgaacctcccaaacctccaggatgtagtttacagtctggcattcgaggttcttgaagactcagtctccaaccttctttgccatcaccctaacc

SEQ ID NO: 8415 - DNA, 466 bp, Homo sapiens
  misc_feature 298: m=a or c
  misc_feature 301: m=a or c
  misc_feature 368: r=a or g
  misc_feature 380: r=a or g
  misc_feature 389: n=a, g, c or t
  misc_feature 444: k=g or t
atttccggctccctgtcaccgggagtgggcgggccatttcttgttctctctcccgctctcggaagctttcgtctcgtgggtgcgaaaggtaaccgaagcggctcaggaaggcagctgtcactgagcccctggaacagagcgagagtatcgtagtgggcagcagtcagtgacaggtgtaacctctgtggatgacagcaacagttactggaggatacgggggaagagtgccacagtgtgtgagaggggaacccccatcaagtgtggccagcccatccggctgacacatgtcaacactggmcgmaacctccatagtcaccacttcacttcacctctttctggaaaccaggaagtgagtgcttttggtgagraggtgaaggtgrttatctggntgactggacagtgctctgtaatggacctactgggtgagagatggtgaggtgcggktcaaacactcttccactgaggt

SEQ ID NO: 8416 - DNA, 149 bp, Homo sapiens
  misc_feature 142: s=g or c
attttctctctgtcattcccctctcaatctttgatcaatgtacttgccagggagagcccaagtccttcaaacctcctccttttcaccttcatccttaactttgtgctagagcgagacccacacaacaacagccgaccctccscgcccca

SEQ ID NO: 8417 - DNA, 153 bp, Homo sapiens
  misc_feature 91: s=g or c
gcctctccgcatggcggcgaccgcggctcctcctccactcaagatggcgaaacctcggccgccgcggctatattcgccgcggcgtcactgscttcctggcttggtggtgagaggaagccgggccgcgaaagcttcctgaggagaaaatggagg

SEQ ID NO: 8418 - DNA, 447 bp, Homo sapiens
  misc_feature 115: r=a or g
caaataaataaattcattcttctgctctcctgacttagagaaatggtttgcttaaaatgctagtaacaaacatcacagtcaacaggagcttgcttcatgcgaaggatcaatgtgrtttgtggatggagatgatagtgatgaaattcctgtttcatggggctgtttttcttttcatctcactgggcagcgtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtg

SEQ ID NO: 8419 - DNA, 228 bp, Homo sapiens
  misc_feature 158: s=g or c
aatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagstgtgcatcaccttcgaccaggccaacctgaccgtcaagctgccagatggatacgaattcaagttccccaa

SEQ ID NO: 8420 - DNA, 251 bp, Homo sapiens
  misc_feature 228: w=a or t
  misc_feature 229: k=g or t
  misc_feature 250: s=g or c
aggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgwkgcctggaggggaaagagagasc

SEQ ID NO: 8421 - DNA, 261 bp, Homo sapiens
  misc_feature 134: m=a or c
  misc_feature 208: k=g or t
cctcaagctctgtcaaggcaagccctggactcggaggaagaggaagaggatgtggcagctaaggaaaccttgttgcggctctcatcccccctccactttgtgaacacgcacttcaatggggcagggtccccccmagatggagtgaaatgctcccctggaggaccagtggagacactgagccccgagacagtgagtggtggcctcactkctctgcccggcaccctgtcacctccactttgccttgttggaagtgacccagcc

SEQ ID NO: 8422 - DNA, 444 bp, Homo sapiens
  misc_feature 284: n=a, g, c or t
  misc_feature 383: r=a or g
cgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagngctcgctgagccctgattttttgagtgtctttgttccgggagagtttgtgagttgaaagtatctctgctgggctttctgggccgaaaaccgttccgggrggagccgccatttgctttcctgttccctagctagctagctagctctctccgcgttgtccgg

SEQ ID NO: 8423 - DNA, 139 bp, Homo sapiens
gcttgtgcttcagaaaggccctttcaagactcctttactgaaatcctaggcctgtccactcaaacgcacagtcacagggtgaatcaggggtgttcacagttatccccagccaccgtgcctggccttttttccttttttt

SEQ ID NO: 8424 - DNA, 181 bp, Homo sapiens
ggtgggggaagctgagcgctgagaccaagggctaaagctgggagactgaaaaaatgcagaccgccggggcattattcatttctccagctctgatccgctgttgtaccaggggtctaatcaggcctgtgtctgcctccttcttgaatagcccagtgaattcatctaaacagccttcctacaa

SEQ ID NO: 8425 - DNA, 199 bp, Homo sapiens
  misc_feature 5: n=a, g, c or t
tccanaaggctccttgcctccttccctggcccacctgaagccaagtcccaggtgtcctggctgctctcctgggcggggtgggatttttgcataagcactttgctgccctccagtggctgcttgaggaaacgcagggcctggtttgggagagtcaccgagggcccatgtggctggaggttgggggcaggatctggcccga

SEQ ID NO: 8426 - DNA, 396 bp, Homo sapiens
  misc_feature 18: r=a or g
  misc_feature 311: s=g or c
  misc_feature 312: n=a, g, c or t
cggggagggggaggcggratgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgctcaagggagagaggagagtggcagggaccagaagctgggattccaggcgtgasnaccatgcccggcctgatttgtaactattctacctgcacttaggtttggtttctttctccgtgtgcttatttcaaaattccaaaa

SEQ ID NO: 8427 - DNA, 265 bp, Homo sapiens
gcagcaggccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaac

SEQ ID NO: 8428 - DNA, 283 bp, Homo sapiens
acttcctccggcctcccgctctcacttccttctcgagcccggagccgctgccgccgcccccagctcccccgcctcggggagggcaccaggtcactgcagccagaggggtccagaagagagaggaggcactgcctccactacagcaactgcacccacgatgcagagcatcaagtgcgtggtggtgggtgatggggctgtgggcaagacgtgcctgctcatctgctacacaactaacgctttccccaaagagtacatccccaccgtgttcgacaattacagcgcg

SEQ ID NO: 8429 - DNA, 327 bp, Homo sapiens
agtcccagctcagagccgcaacctgcacagccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcacaccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagag

SEQ ID NO: 8430 - DNA, 427 bp, Homo sapiens
  misc_feature 170: s=g or c
  misc_feature 189: r=a or g
  misc_feature 223: y=c or t
  misc_feature 282: s=g or c
  misc_feature 300: w=a or t
  misc_feature 333: s=g or c
  misc_feature 345: n=a, g, c or t
  misc_feature 386: k=g or t
  misc_feature 410: k=g or t
ttgtaagtaccttagtatgtagtagtggctaaaaaatggaaaggaagagagtaggtgggaaaggagatgttcaggcccagttatggagtgtaccacacgttactggaaatgcaggaactttttcatgttttcattttttttttttgagatggagtctcactgtcacccascctggagtgcagtggtgaracatcggctcactgcaggctccgcctcctgagtycatgccattctcctgcctcagcctcctgagtagctgggactgcaggcgtctgccaccasgcccggctaattttttgwatttttagtaaagatggggtttcaccatgttasccaggatggtcncgatctcctgaccttgtgatctgcccgcctcggcctctcakgtttccatttttattaccacaatkgttcttaaccagtccct

SEQ ID NO: 8431 - DNA, 519 bp, Homo sapiens
ctttctctctctctctctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggatgggacttaagttgaacggcagatatatttcactgatcctcgcggtgcaaatagcgtatctggtgcaggccgtgagagcagcgggcaagtgcgatgcggtcttcaagggcttttcggactgtttgctcaagctgggcgacagcatggccaactacccgcaggcctggacgacaagacgaacatcaagaccgtgtgcacatactgggaggatttccacagctgcacggtcacagcccttacggattgccaggaaggggcgaaagatatgtgggataaactgagaaaagaatccaaaaacctcaacatccaaggcagcttattcgaac

SEQ ID NO: 8432 - DNA, 436 bp, Homo sapiens
agaaatccggcaatcgacctgaggacttgcgagccgctcagctcccgggacgtttggagctgctgctaaataatttctgctcagccatgtcgccggctccagatgcagccccggctcctgcgtcgatctccctgtttgacctcagcgcggatgctccggtctttcagggcctgagcctggtgagccacgcgcctggggaggctctggcccgggctccgcgtacttcctgttcaggtatcctggaaggtttcgtgtgaaacgtgacagggctccttacagcgtattgcccgttcagggaacacattcttattggtattcccgagcttaggaggccaattgatttatctttctgcttgattaaattcacttaatctctgggtaatgtccagcacagcccttgttttcaaacaagtctttttgccattgcatgtatccc

SEQ ID NO: 8433 - DNA, 161 bp, Homo sapiens
ttttccctccatttagaagggaaagtaaagaaaaatattttcttaccaaattcttttgctctctcactttttctgcattgacacagcaaccaagccagctgtcagcagaggctgcttggtgctttagaaacgtgtatcagcagaacacattctgtccttgt

SEQ ID NO: 8434 - DNA, 239 bp, Homo sapiens
  misc_feature 16: r=a or g
  misc_feature 17: r=a or g
catggagccaaagacrragatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccag

SEQ ID NO: 8435 - DNA, 359 bp, Homo sapiens
  misc_feature 297: r=a or g
agttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtrggcaatggacacgcaactgatctctggcagaactgtagcacctcttcctcaggaaatgtcca

SEQ ID NO: 8436 - DNA, 185 bp, Homo sapiens
ccttttctctgatcttcttcccacccttcctcttctttggctttgctttcacagctgctcacccttcaccagtgttcctgcgaatcctattgtaaggaaatcaccagcattcttcatcttaaaatacaagccaacactacacagcagtataggttaccaaataaactcctttaattctcacaatc

SEQ ID NO: 8437 - DNA, 328 bp, Homo sapiens
  misc_feature 49: s=g or c
  misc_feature 150: s=g or c
  misc_feature 155: s=g or c
atgggattcgtcagaaggtggaaatctctctgtgagaagctgccatctscccgccacccgctcgtccccttctctttctgccaccctcctttccttcctccctcgctccactccactccctccctcttttctcagtaccctcctctttastctcsgagttaactgagagccgacctgacatctccaacattttcaccctcttcccccacccccatcaccgagaatggagtcagggtttccggagagaccgaactctgctctcagcacctttcccagccgctgttgctaaactgacctcggaggacgagaggggaaggaggtgcgacgc

SEQ ID NO: 8438 - DNA, 416 bp, Homo sapiens
  misc_feature 315: s=g or c
  misc_feature 316: s=g or c
actctctccacaaactgcccaggagtgagtagctgctttcggtccgccggacacaccggacagatagacgtgcggacggcccaccaccccagccctccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacassacctacagcgccatgtgtcctttcggctgccactgccacctgcgggtggttcagtgctccgacctgggtctgaagtctgtgcccaaagagatctcccctg

SEQ ID NO: 8439 - DNA, 398 bp, Homo sapiens
  misc_feature 347: n=a, g, c or t
  misc_feature 348: n=a, g, c or t
atgtctccgggtcccttattcacgatgccttgtgccgcctccttcccaggagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaacctnnggcaagttcctcaactctctgtgtcttcgtaccctcatctgtacatgcgt

SEQ ID NO: 8440 - DNA, 314 bp, Homo sapiens
tttcagaactcttgccctccctctcattcccatccttcctggtactgcagtcaaccaaagatggcatgacttacctgcgcagatttggaagcattgaacttagagtgctggctctgctatatggtacaactaatgctagacctactttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagta

SEQ ID NO: 8441 - DNA, 327 bp, Homo sapiens
atactttcatcctggccagtttcaagctacaacgtgatgtcattgaatgcaaacttgggtgagatgcacccacttggctgctgagagctggtatgaatggtaggagccagccccagaatattactgcttctaactctgacatctgcaaatttcttccactattatccagataagtgtcatccagtattcatctgctatattacagatgcaatacagcatctatattacatatatagatatttatctgtacctgtatgggtataaccagagctggctacattatttgctggccctagtacaaaataaaaatgtagtcccttcttcaaa

SEQ ID NO: 8442 - DNA, 409 bp, Homo sapiens
  misc_feature 11: k=g or t
  misc_feature 32: n=a, g, c or t
  misc_feature 381: s=g or c
aaaaaccactkcctccggcttcttcacctctnaggaaatctcggggcttcgctctatcgagagtgctcgtcaagggtgattcttgatcaccaccatccagtagtgctggcgtccgaatgcatatccttttgccttgcaaagaagagtcatgaacttcaaaacccccgagacggatcattaatcctgctttgcagaaaggaaaaccctccattcccagccaccggccacccctctccgcagactgcaaccgcggaggcgctcggagccggaaggggacgctttgggaatgaccatgctccaccgagggacggagccggcccccagcttctccacacagagcctcctccactaacgctccaaaaaccaaaaaccgtaattgcscagaagaagcgttaaaaatctattccag

SEQ ID NO: 8443 - DNA, 218 bp, Homo sapiens
acaaaaaatgtttcaactttcagatatactacttaataaaaactaactagtggattcaccatgtcttctacctggggaaaaaggatcaaattaggatgcttgcacctaggagagaattgggttgtgaatctccacgagattgctacatgtatatgtttcctcttctgttttccaaagaagataattggttttagtaagaacttctgacttgattaggg

SEQ ID NO: 8444 - DNA, 660 bp, Homo sapiens
  misc_feature 112: s=g or c
  misc_feature 113: n=a, g, c or t
  misc_feature 328: n=a, g, c or t
  misc_feature 333: r=a or g
  misc_feature 337: n=a, g, c or t
  misc_feature 338: n=a, g, c or t
  misc_feature 344: n=a, g, c or t
  misc_feature 350: r=a or g
  misc_feature 422: r=a or g
  misc_feature 470: n=a, g, c or t
  misc_feature 496: m=a or c
  misc_feature 497: n=a, g, c or t
  misc_feature 498: s=g or c
  misc_feature 501: n=a, g, c or t
  misc_feature 520: r=a or g
  misc_feature 521: k=g or t
  misc_feature 605: r=a or g
  misc_feature 633: n=a, g, c or t
  misc_feature 634: s=g or c
  misc_feature 641: s=g or c
agaagtttcagggctggacctggggaggcagcctgagcctgagccggctgtcctgagcctgagtactctagctgccttgtcgtcatcgcatctggctgccatccagcgccasnacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagnccccragcnncctctnagcccrgactctgggtcacccagcccagattctgggtcagccagcccagtggaagaagaggacgtgggctcctcggaraagcttggcagggagacggaggaacaggacagcgactctgcagagcanggggatcctgctggtgaggggaaatmnstcntgtgtgacttctgccttgrkgacaccagaagagtgaaggcagtgaagtcctgtctaacctgcatggtgattactgtgaagagcacttgcagccgcatcaggtgracatcaaactgcaaagccacctgctggnsgagccastgaaggaccacaactggcg

SEQ ID NO: 8445 - DNA, 159 bp, Homo sapiens
aaagcgcgggttgtcccgggccaggctgtcgctgagccccaggtctcgtttttgcagagggtcgccgcttcatctccgaccagagccggagaaaggacctctccgaccggccactgccggaaagacgaagcccaaatccccaactactaactattccgg

SEQ ID NO: 8446 - DNA, 263 bp, Homo sapiens
  misc_feature 66: v=a or c or g
aggcgccatctttgacgctggcagtcttggttttctgctagtgctgctgctgctgggaggacgacvgacggcagcggccaagcaagaagaaagacgtggcagcaagcgggagtcggggatagtgtcatcggttcgggtcccggtactttggagcttgtctcaaactccacatacagaaagccaccgaccttattccggtatcctacacccattccccactctcattacactccgacgctgagggccaggggtgggagtgtaat

SEQ ID NO: 8447 - DNA, 377 bp, Homo sapiens
  misc_feature 268: r=a or g
  misc_feature 289: n=a, g, c or t
  misc_feature 290: n=a, g, c or t
  misc_feature 307: k=g or t
  misc_feature 308: k=g or t
aggcgccatctttgacgctggcagtcttggttttctgctagtgctgctgctgctgggaggacgacggacggcagcggccaagcaagaagaaagacgtggcagcaagcgggagtcggggatagtgtcatcggttcggtaaagtttctgttctctgggtcccggtactttggagcttgtctcaaactccacatacagaaagccaccgaccttattccggtatcctacacccattccccactctcattacactcccacccctggccctcarcgtcggagtcaagagcaacanngacacttccgttctcckkgtaggactggtgaaacgtaatgaagaacacccctaaactcccataatcggtgcggattcctatggggaa

SEQ ID NO: 8448 - DNA, 262 bp, Homo sapiens
  misc_feature 122: r=a or g
aggcgccatctttgacgctggcagtcttggttttctgctagtgctgctgctgctgggaggacgacggacggcagcggccaagcaagaagaaagacgtggcagcaagcgggagtcggggatartgtcatcggttcggtaaagtttctgttctctgatttggggatattccctgcccaaaaaattcctggaaaattgactagtattaagtgtgagtaaaaggtgtccacttttttttaagttttgattttagttttgtcttgga

SEQ ID NO: 8449 - DNA, 280 bp, Homo sapiens
  misc_feature 127: n=a, g, c or t
  misc_feature 272: n=a, g, c or t
  misc_feature 273: m=a or c
agtcagttctctgtagtgtttgccaatgttggagccgtctgcaaagtgtccccggcaagaagaggctgcctaccacaaggactttagcttactttttaaagattgaagaaaaaaaaagaagacaganaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtganmagacatg

SEQ ID NO: 8450 - DNA, 288 bp, Homo sapiens
gagcccgaggggtggaagccggcggcggccgagcggggtcagttctctgtagtgtttgccaatgttggagccgtctgcaaagtgtccccggcaagaagtttttggagcgtgagggatacagcagtttggtcaatattgtcttaacatgcttcaaataaatcagatgttctcagtgcagctgagtcttggtgagcagacatgggaatccgaagcagcagtataaagaaggctcagcaggctgttgccaataaagctttgactgaatctacgcttcccaaaccagttcag

SEQ ID NO: 8451 - DNA, 492 bp, Homo sapiens
  misc_feature 300: k=g or t
  misc_feature 301: h=a or c or t
  misc_feature 302: n=a, g, c or t
  misc_feature 377: b=c or g or t
  misc_feature 378: m=a or c
  misc_feature 379: n=a, g, c or t
  misc_feature 380: m=a or c
  misc_feature 400: s=g or c
agttctgtgggctctattcggccatattaataaagagaaagggaaggctgaccgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaatttgggccttttcctttctacctcccctgtgacctttcctagcctcagatctgttaattcttttkhnccccagccctgtccctcactgtcctctgtccttggaccagaaccctggggtcagacccatctcctgtagctgtcbmnmcacactgacaggcttcttcstgagatatcctcaggttttctcagccagagagctgcctttagagtccaactgttgtacgtatgtcaccttcactagaaatgtcccatcatcg

SEQ ID NO: 8452 - DNA, 349 bp, Homo sapiens
  misc_feature 277: s=g or c
agacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagstactgaggcctgacgggccagtacattgaactgaatgcactacaggaagagcttgcaccattcggtctggtc

SEQ ID NO: 8453 - DNA, 521 bp, Homo sapiens
  misc_feature 371: r=a or g
  misc_feature 447: r=a or g
ttttttcacctttatttgccgtctttcaactggcaagagtcattttgaccagcagattaatcaactgtaagacggatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccargttatccacagcctccttcccgaccaagaccctatccacctggacctccatttttccctgtaaattctccaactgrtcctaccctccctactcctgcaccccaaatatgaacaactgcagcaggtgccaccaccaccacaaaagacacca

SEQ ID NO: 8454 - DNA, 205 bp, Homo sapiens
  misc_feature 9: r=a or g
  misc_feature 11: r=a or g
  misc_feature 19: r=a or g
  misc_feature 21: s=g or c
  misc_feature 25: r=a or g
  misc_feature 34: y=c or t
  misc_feature 69: r=a or g
  misc_feature 80: m=a or c
  misc_feature 81: s=g or c
  misc_feature 112: y=c or t
  misc_feature 155: y=c or t
agaaggacrcrggcagcarasagtrgtcagtccyttcttggctctgctgacactcgagcccacattccrtcacctgctcmsaatcatgcaggtctccactgctgcccttgcygtcctcctctgcaccatggctctctgcaaccagttctctgcaycacttgctgctgacacgccgaccgcctgctgcttcagctacacccccggc

SEQ ID NO: 8455 - DNA, 475 bp, Homo sapiens
  misc_feature 35: s=g or c
  misc_feature 428: n=a, g, c or t
  misc_feature 429: n=a, g, c or t
  misc_feature 431: s=g or c
  misc_feature 437: m=a or c
acaaacacaaacacacaccccaacacacacgcccsgtcccctttctccaccctgcaagctagttgcatttagctcacagagcctgggctgcgacttgaaagagtttaggcagcaacagagtgaccctgggggtgctcttgaccgacagccgcacccccggcgtctaggacctccgagcagggatgcatctggaggtctagggaagcacttccaccccctcctctcctcaatcctggcaggatggctactgctgcttcaagacagtgacgtttctctccggtcagctgtcaggagcgctgctgggtcttactggggatctggccagccttgggggcccttggagcctggcccagtggaagctcgtgcctgaggaacatggaggccacgctaatgagttacttccagagtcttcaagagtgccaactggnngscaggamcccagaccacagccccccacaccgtcctggacctggat

SEQ ID NO: 8456 - DNA, 229 bp, Homo sapiens
cactgtctccaagatggcggccgtgtcagtttggggcatctccgcggtccggcccggggccccgggatctcggctgtccttcctcccggattctttctactaatccagatacttgttgaagtgctgactagtttcttggggaaagatgtcaaggaagagttgaaattcctagactggtgagcagagattgcggagtacagacttctgaaaatatctattgaaaatgagc

SEQ ID NO: 8457 - DNA, 263 bp, Homo sapiens
  misc_feature 39: r=a or g
  misc_feature 129: w=a or t
  misc_feature 186: w=a or t
gtcggccattttgtgtctgcttcctgtgggacgtggtgrtagccgttgggttgggaaagtgagggatttttggcctcgtttctcctgcttcttttctcctcccttttactttgccggtagaacacagtwatgggtcgcaagaagaagaagcagctgaagccgtggtgctggtatcctttgtcggtwtgaagtcgaggtcgcgttggggtgccggttgttggggcctgggactaggaggcctggatttggcttacggcgtggag

SEQ ID NO: 8458 - DNA, 487 bp, Homo sapiens
  misc_feature 82: r=a or g
  misc_feature 215: s=g or c
  misc_feature 445: s=g or c
  misc_feature 447: n=a, g, c or t
agctgggaggaggtgtgcgcgctgcgccgcgagctcccgggctcggcaaccgtggcatgcttaggattggccatatttaaargttctgaagtagaacctgcgcctcctctctgcttctccctcctcctcagtaatttatttcgagcttccaggcaagggccacggaagaagggaaagcaagaaattagatgcctgtgtggtaactcctcgcggastaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtasanggggcaggtgccttacaactacaaccagctggaaggcaga

SEQ ID NO: 8459 - DNA, 233 bp, Homo sapiens
acattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgc

SEQ ID NO: 8460 - DNA, 322 bp, Homo sapiens
aagggatgttttgctgagcagcctgaaagcagactctaggattcccctgagatgagataaggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagca

SEQ ID NO: 8461 - DNA, 414 bp, Homo sapiens
  misc_feature 120: r=a or g
  misc_feature 121: r=a or g
  misc_feature 128: w=a or t
  misc_feature 349: y=c or t
atttttccgttcctcggggtttactattgcagagagacaccagacgccatggagttggtgctggtcttcctctgcagcctgctggcccccatggtcctggccagtgcagctgaaaaggarragggaawtggacccttttcattatgattaccagaccctgaggattgggggactggtgttcgctgtggtcctcttctcggttgggatcctccttatcctaagtcgcaggtgcaagtgcagtttcaatcagaagccccgggccccaggagatgaggaagcccaggtggagaacctcatcaccgccaatgcaacagagccccagaaagcagagaactgaagtgcagccatyaggtggaagcctctggaaccctgaggcggctgcttgaacctttggatgcaaatgtcgatgcttaa

SEQ ID NO: 8462 - DNA, 176 bp, Homo sapiens
tctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccagg

SEQ ID NO: 8463 - DNA, 401 bp, Homo sapiens
  misc_feature 94: s=g or c
  misc_feature 369: n=a, g, c or t
  misc_feature 370: n=a, g, c or t
  misc_feature 371: n=a, g, c or t
  misc_feature 372: n=a, g, c or t
agttggtccttagtactgcggccgtgtgggtgagttggctgccggtgagttgggtgccggtggagtcgtgttggtcctcagaatccccgcgtascgctgcctcctcctaccctcgccatgtttcttacccggtctgagtacgacaggggcgtgaatactttttctcccgaagaagattatttcaagtggaatatgccattgaggctatcaagcttggttctacagccattgggatccagacatcagagggtgtgtgcctagctgtggagaagagaattacttccccactgatggagcccagcagcattgagaaaattgtagagattgatgctcacatagaaccactggttcacctacaatgagacaatnnnngtggagagtgtgaccaagctgtgtccaat

SEQ ID NO: 8464 - DNA, 164 bp, Homo sapiens
aagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgcc

SEQ ID NO: 8465 - DNA, 873 bp, Homo sapiens
  misc_feature 8: m=a or c
  misc_feature 30: m=a or c
  misc_feature 65: y=c or t
  misc_feature 204: n=a, g, c or t
  misc_feature 205: w=a or t
  misc_feature 287: k=g or t
  misc_feature 568: w=a or t
actctccmaacacatacgcagcagtgttamagctcttttagaatttgtctagtaggctttctggytttttaccggaaagcccctcttatgatgtttgttgccaatgatagattgttttcactgtgcagaaattatgggtagttttggtggtcttgatgcagttgtaagcttggggtatgaaggtttgggccccgcctgggcgcnwccggctgcgccggatgctgtttcctttccgctcccaggggcgttgggaacggttgtaggacgtggctctttattcgtgagtkttccatttacctccgctgaacctagagcttcagacgccctatggcgtccgcctcgacccaaccggcggccttgagcgctgagcaagcaaaggcctcaatccactaattccttgcgctctccgctgggcccgctgtctgttctccgacgcctacccgggacgcctccctgggatgcttctggcgcgcagtggtcctcgcggaggtgatccaggcgttctccgccccggagaatgcagtgcgcatggacgaggctcgggataacgcctgcaacgacatgggtwagatgctgcaattcgtgctgcccgtggccacgcagatccagcaggaggttatcaaagcctatggcttcagctgcgacggggaaggtgtccttaagtttgctcgcttggtcaagtcctacgaagcccaggatcctgagatcgccagcctgtcaggcaagctgaaggcgctgtttcttccgcccatgaccctgccaccccatgggcctgctgctggtggcagcgtggccgcctcctgagagttggccctcccttgtgccactgccaggggaggaaaggccttgatgttccagacaataataaatgcg

SEQ ID NO: 8466 - DNA, 333 bp, Homo sapiens
  misc_feature 40: r=a or g
  misc_feature 79: r=a or g
  misc_feature 131: k=g or t
  misc_feature 161: s=g or c
  misc_feature 182: s=g or c
  misc_feature 189: k=g or t
  misc_feature 209: n=a, g, c or t
  misc_feature 272: y=c or t
  misc_feature 282: r=a or g
aggatgagtaataatggaagcaatttgtaactttcagtarctctctaggcctgggtaccggagggagggaggcgggcaraggaggggagatgggcacccccagtctttccatcctcctcattcgtctaggkgcacccgaatcccctattccttatttcccstatcactcaggcactggcagsgtccttkgcccactcctgttggccgcngcggctccaaagcgagctgggcagatgtgcctgagacaggtttgaccaggcaactgaaaagayatccctaagrgaacaaagcaaaggtatgaaaggaacacacgtccctgactgactaggagga

SEQ ID NO: 8467 - DNA, 220 bp, Homo sapiens
tcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagc

SEQ ID NO: 8468 - DNA, 387 bp, Homo sapiens
  misc_feature 121: s=g or c
  misc_feature 369: y=c or t
  misc_feature 377: s=g or c
tcttttagtttccggtgtctctgcaatggcggctctagactccctgtcgctcttcactagcctcggcctgagcgagcagaaggcccgcgagacgctcaagaactcggctctgagcgcgcastgcgcgaggccgctactcaggctcagcagaccctgggttccaccattgacaaagctaccgggatcctgttatatggcttggcctcccgactcagggatacccggcgtctctccttccttgtaagctacatagccagtaagaagatccacactgagccccagctaagcgctgcccttgagtatgtgcggagtcaccccttggaccccatcgacactgtggacttcgagcgggaatgtggcgtgggtgtyattgtgascccagagcag

SEQ ID NO: 8469 - DNA, 285 bp, Homo sapiens
acagacagacttcatactttgcagctctctagctctgctttgagtagacacctccagcggggccgtcctacccaaggggcactgtggggactgtctgcagccaccccagctcatacctctctgcctccccgctctcaaggagggtctgccgcatgtgatgaaagtgtctactctcagggaaagctcagccatggcttccccactgccccgggagatggaggaggagctggtgcctactggctctgagccaggtgacactcgggccaaaccccctgtcaagcccaa

SEQ ID NO: 8470 - DNA, 477 bp, Homo sapiens
  misc_feature 170: m=a or c
  misc_feature 193: r=a or g
  misc_feature 203: w=a or t
  misc_feature 210: k=g or t
  misc_feature 287: r=a or g
  misc_feature 392: m=a or c
  misc_feature 406: r=a or g
  misc_feature 414: w=a or t
  misc_feature 459: k=g or t
ctttttattttggaaaatttcaaacatatatgaaagaagagataatgtacttactcatcacccagcttcaacatttatcaacatcttgccaatcttactgaatctatccttccttaccttttttaaaaatgtttcctagagtgtgtcaaagctcatcccagatgtcctamtgtttctagtaaatgcttctgcrcaattctaawagacaakgatgtttttaaacccagccccgacactatcatacctcacaagattcatgctaattcctcagtgtcttctagtcccargtccatgctcaagtgtccccccctgtccaggcaccctcttcaggggtcctccatgtttcatagcgagaaggggccctgagagttgggcaccccgggcaggctggmtggagggggctttrgaaaggawggctttggccagcgtgtgagggtgcaggtctcaccagctcctgtktggtctgtttcaggaaca

SEQ ID NO: 8471 - DNA, 394 bp, Homo sapiens
  misc_feature 101: k=g or t
  misc_feature 291: k=g or t
  misc_feature 360: s=g or c
aacgcacgttacacgcatcgcggagggagcggaggtggttgggtttctgagtttgagtctgtcgctcctggctctcccgacacaacagcggcgcccacctkcccgcaacggactcccaggagcctcgagctcctcatttccaaagctgaactgccccgtgtctgattccgatttctcttgagcgcgtttcggagccggcccagaacagagggaagccagacacaccatacccggcccaacagtggcagggcggctgcgggtgctggtcaagctgggtcacccggcactgaktgacgatcagcaaatactcagtggacgaaatatttgcagtgcagtgaggtgaggggcataaccgcggasgtattcgagatgagagagactggggattaggcca

SEQ ID NO: 8472 - DNA, 453 bp, Homo sapiens
  misc_feature 7: r=a or g
  misc_feature 415: m=a or c
  misc_feature 421: n=a, g, c or t
  misc_feature 422: w=a or t
  misc_feature 441: y=c or t
agccggrgaggcggggtccttctctggggcggtcgcgttggcagcggatgcgggaagccggactctgggcgtcatgtactacaagtttagtggcttcacgcagaagttggcaggagcatgggcttcggaggcctatagcccgcaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctaacatggcttcgcagcccaaaaacaamtgagtnwaggctgccagaggactggyttgttttttggc

SEQ ID NO: 8473 - DNA, 134 bp, Homo sapiens
atcagcgttgcggctcgaggcaaagctggtcctgtgcctgctgtccattgccgctaaggcctgctgctgccattcaggcgtgtctctctctctctctctctttcatgccgctctctccaccccatcttgggacg

SEQ ID NO: 8474 - DNA, 397 bp, Homo sapiens
agtgctccagactcaacaggtgattggcccagagaggggaggtgaccccaggccccaggaaagggagcgaggacagcgctggttcccggctccccgcaccatcatggctttgcctctgaggcccctgacccggggcttggccagcgctgccaaaggaggccacggaggagcaggagctcgtacctggcgtctgctgaccttcgtgctggcgctgcccagcgtggccctctgcaccttcaactcctatctccactcgggccaccgcccgcgccccgagttccgtccctaccaacacctccgcatccgcaccaagccctacccctggggggacggcaaccacactctgttccacaatagccacgtgaaccctctgcccacgggctacgaacacccctga

SEQ ID NO: 8475 - DNA, 480 bp, Homo sapiens
ccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgca

SEQ ID NO: 8476 - DNA, 507 bp, Homo sapiens
  misc_feature 430: s=g or c
  misc_feature 438: r=a or g
  misc_feature 466: r=a or g
  misc_feature 502: r=a or g
ttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggagctgcatgggaagtctgcatacagcaaagtgacctgcatgcctcaccttatggaaaggatggtgggctctggcctcctgtggctggccttggtctcctgcattctgacccaggcatctgcagtgcagcgaggttatggaaaccccattgaagccagttcgtatgggctggacctggactgcggagtcctggcaccccagaggctcatgtctgttttgacccctgtcagaattacaccctcctggatgaacccttccgaagsacagagarctcagcagggtcccaggggtgcgataaraacatgagcggctggtaccgctttgtaggggaaggrggagt

SEQ ID NO: 8477 - DNA, 459 bp, Homo sapiens
  misc_feature 268: k=g or t
  misc_feature 326: n=a, g, c or t
  misc_feature 416: r=a or g
  misc_feature 431: s=g or c
ccctagttgtgtaaccctgcaggccatgaacagttattattcaatgttgtttcctacacatctttaataaaagtttgttgcatttaaatctgatcttattctctcatttcacagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagakgcactcagctgtcctctcttctgctcttcctcctacaaactgggcaactggaatcagnacagagactttggatgagcatccagtgtaacccagcctagtttttcaccacgacttccagatctacatttaacatccgacagcaactatrattctactttctgasctccagggaagttgcttcttgtcctttc

SEQ ID NO: 8478 - DNA, 218 bp, Homo sapiens
  misc_feature 3: w=a or t
ggwcaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggctttgtgccttgggcaaagggcagcttactcctggaagaggactgactcaaggacccc

SEQ ID NO: 8479 - DNA, 399 bp, Homo sapiens
  misc_feature 259: s=g or c
  misc_feature 335: n=a, g, c or t
  misc_feature 363: n=a, g, c or t
  misc_feature 364: n=a, g, c or t
  misc_feature 390: r=a or g
  misc_feature 392: k=g or t
gagaaggtcgggcgcatgcgcagtgctcggattttttgcttggctacccggagtgaagcgaccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtscgggacgtgagtccttccccatgccaggcgaatggtgtggccttgagctggtccaggagccggctcgacgtgtctnagggaggccccggaggggcggggaggtnncccacagaacgcgggttctgtagatraktttgttg

SEQ ID NO: 8480 - DNA, 382 bp, Homo sapiens
  misc_feature 104: n=a, g, c or t
gctggtgcccaacggcacctcttaggatgaacccagccagctgcgttcctggcctctgcagaatggcatacagaaggcattttaagcaagcgagctgagctcgncgcaggactccgactaccaggcaccggtggcagcacgcaaagggtgtccctgtccctcaaggggtcatggcctccatgttgctcgcccagcgcctggcctgcagcttccagcacagctaccgcctgctggtgcctggatccaatccaggatccagacacattagtcaagctgcagccaaagtcgacgttgaatttgattatgatgggcctctgatgaagacggaagtcccagggctagatctcgggagttaatgaaacagctgaatataattcagaat

SEQ ID NO: 8481 - DNA, 282 bp, Homo sapiens
agagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcg

SEQ ID NO: 8482 - DNA, 203 bp, Homo sapiens
  misc_feature 87: y=c or t
  misc_feature 88: k=g or t
agagaaagtatgaaagtaggttggttgcaagggtgcaacgggcagatcagcaagagagaagctgactgccaggagacaatggcttgykgggcatgttacaggatgatgcttctgctgtgtgctgcagagagggctatgtgcagtactgataaggccaaggttgcagtgagctaacttgcatttttctgtcagctgagagtctg

SEQ ID NO: 8483 - DNA, 336 bp, Homo sapiens
  misc_feature 80: n=a, g, c or t
  misc_feature 81: s=g or c
  misc_feature 83: m=a or c
acctccctcttcccggctccagctccgccgccagctccagcctttgctccccctcccaaagtcccctccccggagcgganscmacctagggtccctcttccgtccccccagcccagctacccgttcagaccagcagcctcggggggcaccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactg

SEQ ID NO: 8484 - DNA, 280 bp, Homo sapiens
ttagtggagacagggattcaccatattggtcaggctggtctctaacacttgcctcaagtgatccgcccgtctcggcctcccaaagtgctgggattacagatgtgagccatggcacctggtcagatgtctgctgtgatctttttcactggataggtcaagcacttttccacattgcctcatagtgttcattatgatcacctttaatgggctgggggaaagtctgtcaagtggctgtcccatacgttcacttaccccttaaatagtgtcatagtatatagca

SEQ ID NO: 8485 - DNA, 219 bp, Homo sapiens
tccacttcgtgttcttcctagcttccctgtatgtgatgatgaccgtcaccaactggttcaactatgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggc

SEQ ID NO: 8486 - DNA, 321 bp, Homo sapiens
  misc_feature 314: m=a or c
  misc_feature 315: s=g or c
aggaagttatatgctttttctggagtcctgtagagaaagtgctctctgccgcattgatagcagcgagagctggaggtgttgggtcgggagaccagccattcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgmscctgcc

SEQ ID NO: 8487 - DNA, 369 bp, Homo sapiens
  misc_feature 19: s=g or c
  misc_feature 70: s=g or c
  misc_feature 127: n=a, g, c or t
  misc_feature 309: n=a, g, c or t
gacgtgtctctcggcggastgctgtgcagtggaacgcgctgggccgcgggcagcgtcgcctcacgcggasagagctgagctgaagcgggacccggagcccgagcagccgccgccatggcaatcaaanttctggaagtcatcaagcccttctgtgtcatcctgccggaaattcagaagccagagaggaagattcagtttaaggagaaagtgctgtggaccgctatcaccctctttatcttcttagtgtgctgccagattcccctgtttgggatcatgtcttcagattcagctgaccctttctattggatnaagtgattctagcctctaacagaggcacattgatggagctagggatctctcctattgtca

SEQ ID NO: 8488 - DNA, 350 bp, Homo sapiens
  misc_feature 79: w=a or t
ctcccatttccggaagcctggcgcaaggttggtctgcaggtggcctccaggtgcaaagtgggaagtgtgagtcctcagwcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaa

SEQ ID NO: 8489 - DNA, 197 bp, Homo sapiens
ctacaggaaccctcaaataaatttaatccccatttgggattatccctcaaatgtagctctgagtacttattagttattattctggcatccctacatctaataagatatagagtagagtccacacggtctccaggaaccagccagcctgtaaatgagtgaagtcttctggtgatatatcagcaccatgataaatgacc

SEQ ID NO: 8490 - DNA, 217 bp, Homo sapiens
cccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactg

SEQ ID NO: 8491 - DNA, 268 bp, Homo sapiens
actgcaaggattactgatcgcattgcagcttcctcaaataatctgactatatctgttcttttgcataaccctctccccaggaatcacaatacccagagtatacagatggccaagcttagattaggtgcctatgttttcattgccaggctgtatccctgcatccctcttagcttccatagtgtcttacctacttttggattcccccaaatagtaaatattcacttcagagcacagtgtaaaacagtgtaactcctgagctcaagtgatt

SEQ ID NO: 8492 - DNA, 312 bp, Homo sapiens
catcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaatttaagacccttatggaactggaagacgtcttgtagtgctacattgggtgaaaccgttggtccattttgtctgtttctatgagataaataattggggg

SEQ ID NO: 8493 - DNA, 658 bp, Homo sapiens
  misc_feature 2: y=c or t
  misc_feature 437: k=g or t
  misc_feature 454: n=a, g, c or t
  misc_feature 629: r=a or g
  misc_feature 650: n=a, g, c or t
tyttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttkgcagtgtagccataacnttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgttatttttttttcagtgratgtctggcacattgcaatcntcaaacat

SEQ ID NO: 8494 - DNA, 513 bp, Homo sapiens
  misc_feature 348: r=a or g
  misc_feature 398: k=g or t
  misc_feature 400: r=a or g
  misc_feature 483: r=a or g
aacaatgatgtcttaagtgctcctaactagacacataatgtttagtgtgctgccattttttctgagtgttagttttaaatagactattgacaaattacagatttttttcacgtattgaaattatattccagatgattttgagatttactggtataatattctcctcatgaggtaggatggaagggaagaaatagagaaaaaatgttctgctctgaaataaatgtggtgtttcctgacagcgtttgtcaagagatggggttccaccatgtagccccggctggtcttgagctcatgagctcaagcgattcacctgcctcagcctcccaaagtgctgggattacaagtgtragccaccattcctgcctctatacctctaaaggtgttgaataatttgaatkgraatttgaaggtccatggcttccaaaccagcaggagttaaggcttaattgcttggaaatacattttcatggctgataccagtarcagaaaatgtctgttatgtcaagaggctct

SEQ ID NO: 8495 - DNA, 281 bp, Homo sapiens
gatgggagagacgcatcaacactggcatgcacggacaggtggagacgcaggtcgccaacctcgctctccacctgggcagtgataactgccaccttcccactccagctcacccgccgctctccctgatttgggttgcacttctttccttctcccaccaccctttttctaatccagcaaatattcgcctatttgctgcaagtacaagttttgctttgctaactggcgccccgcttcttgcatttaatctttaacatttatgtttcttttttccttgttttctc

SEQ ID NO: 8496 - DNA, 222 bp, Homo sapiens
attggccccattctagagacggtggagggcagagagaaatgacatggaactaaccttaaggaatgcactatctagccaggagacagacatacagccaaatattctgcttttagcgtcttcacattcatggcttgaaggtggccatggtgggagtatttacaccacagaaatcagcaaatgctatgcatcagggccctaggaaggccaattatgaaacaccag

SEQ ID NO: 8497 - DNA, 277 bp, Homo sapiens
catattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcag

SEQ ID NO: 8498 - DNA, 306 bp, Homo sapiens
  misc_feature 197: m=a or c
  misc_feature 230: n=a, g, c or t
  misc_feature 232: y=c or t
gcggaggcttggggcagccgggtagctcggaggtcgtggcgctgggggctagcaccagcgctctgtcgggaggcgcacggttaggtggaccggtcagcggactcaccggccagggcgctcggtgctggaatttgatattcattgatccgggttttatccctcttcttttttcttaaacatttttttttaaaactgtmttgtttctcgttttaatttatttttgcttgccntyccccacttgaatcgggccgacggcttggggagattgctctacttccccaaatcactgtggattttggaaaccag

SEQ ID NO: 8499 - DNA, 296 bp, Homo sapiens
  misc_feature 200: s=g or c
actcgcatcccagggcgtctccggctgctcctattgagctgtctgctcgctgtgcccgctgtgcctgctgtgcccgcgctgtcgccgctgctaccgcgtctgctggacgcgggagacgccagcgagctggtgattggagccctgcggagattgggtcttatccccaagatatctcattatgtacatgcaaatcagcggasatcgtcatgacaccaggaggacaccccgtgacgccgattaccgcactctcaacctcaacccagcgtcagagttttctggcatctcttctttgagcc

SEQ ID NO: 8500 - DNA, 410 bp, Homo sapiens
  misc_feature 99: y=c or t
  misc_feature 284: y=c or t
  misc_feature 290: y=c or t
  misc_feature 321: s=g or c
  misc_feature 324: k=g or t
  misc_feature 328: w=a or t
  misc_feature 338: n=a, g, c or t
  misc_feature 360: k=g or t
  misc_feature 382: k=g or t
  misc_feature 383: k=g or t
  misc_feature 386: k=g or t
ctttctgatgtcattggcctacctcaggccacgttcttacacctggagtgaaatccagtcatgctgcctggctgccagccttccgtgttagtgctggcytctctctctgtcattctctgcctgctcttctgctcactgtgctcaagtagttcatgggaaggttgcagagtgttgtggatggtttcaagatgcagtgtttggtctcccaattaaaagaattactaatacaaagaaaaaaaaaagacaaggtatttagtcaaatgtgagtaaacttggaaaatgayttaggyctctcagatgtggtcacctcattcccatttscckgtgwagccaagagncctgaggccacccatccatgtkgttgtacaccatgtttatgttkkgtkgatttctcccacatgtctgtaatt

SEQ ID NO: 8501 - DNA, 271 bp, Homo sapiens
  misc_feature 173: n=a, g, c or t
ggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcagagntcccgcggcagcaggatcacaggtgaacagatggcgggcctgggccctcccttggggctgcgttctctggcgatcaggaggggcgcttccggcgaggc

SEQ ID NO: 8502 - DNA, 411 bp, Homo sapiens
  misc_feature 276: r=a or g
ttgaaactaaaaatttagactcttatcgtcatcttaagttcttcatgctactcttaacctcccaaaaagcagtatctaagtcacatacatgatgtcttgggcattttctgagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacaggracagttaaattgggagcctttcttacaaccttgatgggatttttccccccaagtttccttctccactgaaatgccacactaatgcttgttggattcatgaggtggccagccaatgtgttgttttgttgttgtttt

SEQ ID NO: 8503 - DNA, 454 bp, Homo sapiens
  misc_feature 194: r=a or g
  misc_feature 359: n=a, g, c or t
aggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcrggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaangcagaatacaagggccgagttactctgagagcaatacccacgcaagaatctgttcctagtggaggtaacacagctgacagaaagtgacagcggag

SEQ ID NO: 8504 - DNA, 174 bp, Homo sapiens
gagaaaatcttggtggtggtggtggtggggcggcctgagaagatattatggctgctgccacggagcataatcgcccgagcagcggtgacaggaacctggagcgaagatgcagccccaacctctcccgagaggtgctctacgaaatctttcgctccctacacaccctggttggac

SEQ ID NO: 8505 - DNA, 186 bp, Homo sapiens
  misc_feature 48: n=a, g, c or t
  misc_feature 50: m=a or c
  misc_feature 118: n=a, g, c or t
  misc_feature 122: n=a, g, c or t
  misc_feature 133: r=a or g
  misc_feature 134: m=a or c
  misc_feature 145: n=a, g, c or t
ggagaacgggcggagggcgcggccgaccgggcgcaccgaccatggccncmaatgccccaagtgcgacaagaccgtgtacttcgccgagaaggtgagctccctgaggaaggagcaaagntagncccggcactgrmctgggtttctncttgtgtcacccagtctttaacaagatgcagggaatcaact

SEQ ID NO: 8506 - DNA, 291 bp, Homo sapiens
  misc_feature 208: w=a or t
  misc_feature 209: m=a or c
atttatttgatctttgttatttctcctgtttttcctcttcttccatttgtgttttaacttttacctgaagaaatgtatgaatatggatttcattcctgactgcttcagttacttcaccatttttgtaatttgtttgctctttgagttagctgctttcactgtatctttgacttgttgtctcatatccttctggcagttgatattttcwmttgtttttttctttcttagactttttgttttatttagtgagtcagaattattcttggaggcttgattcagtataaaagcgga

SEQ ID NO: 8507 - DNA, 358 bp, Homo sapiens
  misc_feature 132: m=a or c
  misc_feature 228: y=c or t
  misc_feature 293: w=a or t
  misc_feature 305: y=c or t
  misc_feature 335: n=a, g, c or t
  misc_feature 338: n=a, g, c or t
  misc_feature 356: s=g or c
aacatccgggccgcgcggggaaggggagacgtggggtagaggggagcattgcttccttctctcgcagtgaccatgacgaaattagcgcagtggctttggggactagcgatcctgggctccacctgggtggcmctgaccacgggagccttgggcctggagctgcccttgtcctgccaggaagtcctgtggccactgcccgcctacttgctggtgtccgccggctgctaygccctgggcactgtgggctatcgtgtggccacttttcatgactgcgaggacgccgcacgcgagcwgcagagccagayacaggaggcccgagccgacttagcccgcanggngctgcgcttctgacagcsta

SEQ ID NO: 8508 - DNA, 192 bp, Homo sapiens
agtctttgttcattttttttatttttttttatttttctttgatggattgggttaattcgaaagccttgtcttcaagctctgaaattctttcttgtgcttgtttgattctattgtcaagactttccagtgcattttgcatttttttaagtgtccttgattttcagaagttgtgattgtttttcatttatgcta

SEQ ID NO: 8509 - DNA, 227 bp, Homo sapiens
gaaattgctttaagaataatacgttttttaaataaatgctattgtctgtttcctgaatcatttctgtttcttctagggttatggatttccttgttttatttattctggtcttgcccttgggactggaaggctgctcaggtctcaccgtaagcactgggacaatgccttttgactgacaggcataatattagggtgaatgggttgggagctagcttttaagggaaagg

SEQ ID NO: 8510 - DNA, 228 bp, Homo sapiens
aaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggctcggtgaaggcttttggttactccccttcccac

SEQ ID NO: 8511 - DNA, 156 bp, Homo sapiens
  misc_feature 106: s=g or c
  misc_feature 107: s=g or c
gcagtgatcgggcggccggggtcctgtgcgcgtgcgcacgaatcagctgtcacctagtgcggaacaagtctcccaaatttcccaaatctccctgggccggaggcasstgtcttctcttcctcctccaccgagtcgtgctctcgccccaacccgcgc

SEQ ID NO: 8512 - DNA, 169 bp, Homo sapiens
tcttcagcagattttctgacctgcggttgcagaatgaaatttggggatctctctgtccctctctgcatgcatccacctggctcccagcgtcccagctccttgctggtctcactgtccctctctgtccctctcgctccgagcgtcccagcacctcgacgtactcactgtc

SEQ ID NO: 8513 - DNA, 322 bp, Homo sapiens
tcactagttctctctttatctcgttgtcttcaacacatccttttacttctctttgcagatttatctgtattccacctcctgttctctggggttacacagcttctgcctttccccactgtatggggatgtgcagcctgtaaattttcactttgcttaaggatcaccacgaatcaccccccaccattccccacccccccatataaagcattttcacattctgctttcttgccttgggggttcgtggctctctgtgtaactggtttttacttggttacatgccaccaggaactgctgattattttaaagtcctactaccctgcag

SEQ ID NO: 8514 - DNA, 242 bp, Homo sapiens
  misc_feature 63: n=a, g, c or t
  misc_feature 91: r=a or g
  misc_feature 96: n=a, g, c or t
  misc_feature 99: n=a, g, c or t
  misc_feature 100: n=a, g, c or t
  misc_feature 101: n=a, g, c or t
  misc_feature 155: m=a or c
  misc_feature 186: m=a or c
  misc_feature 190: n=a, g, c or t
  misc_feature 191: w=a or t
  misc_feature 215: w=a or t
  misc_feature 216: r=a or g
  misc_feature 235: r=a or g
  misc_feature 236: w=a or t
gttctggccttcccaaactgcttttgatcttttgattcctcttgggctgaagcagaccaagtnccccccaggcaccccagttgtgggggarcctgnatnnnttttaacaacatccccattccccacctggtcctcccccttcccatgctgccaamttctaaccgcaatagtgactctgtgcttgtmtgtnwagttctgtgtataaatggaatgtwrtggagatgacccctccctrwgccggc

SEQ ID NO: 8515 - DNA, 135 bp, Homo sapiens
atctccacacgggcacttctggctgacccggatcgtgctcctgaaggccctagccttcgtgtacttcgtggcattcctggtggctttccatcagaacaagcagctcatcggtgacagggggctgcttccctgcag

SEQ ID NO: 8516 - DNA, 431 bp, Homo sapiens
  misc_feature 12: y=c or t
atcaacattctycccccacgtcttgacgctgggttccggcctagggttctggctttcctcctgggctagtgaacgcggcgaagtcctcctctttctaatctccagagccgcagttccatcctctgggtcagcggcttaccctgactgggctgcggtatctgccttccttcccccaacaaggcgacaggtagtcggggctggggccggaactgactgagtgggccgcaactgactgagtgggccgcggctcccgcctgaggaggctaggaaggactgaacagcagccgacttcccaggctctaaaaatcgtgcctctgagttagagctacctcaaaagcaagaccaagcatgagaaatggagtcttttggccagtattggggtgttcggaattcaagcgtatgagagagtggacggtagcgttgagaatttt

SEQ ID NO: 8517 - DNA, 285 bp, Homo sapiens
  misc_feature 35: s=g or c
  misc_feature 159: n=a, g, c or t
  misc_feature 164: s=g or c
gtcgccttttggtgacgccagagagtgcgcgtcasagtttattagagagctctgtagccagcctcttctgcgcacccacctgctgcatcttagttcagtcggctcttagagtagtaaccgccagaaaggagtcggaagaggtctcacgaggctgtcatnaccgscatgcccaagaataaaggtaaaggaggtaaaaacaggcgcaggggtaaaaatgagaatgaatctgaaaaaagtgagctggttgtctaagtgaggggacagagaagttggctcgaaaggagg

SEQ ID NO: 8518 - DNA, 431 bp, Homo sapiens
ttattgagttatgtggaaaagatggcttgtatttttcagattattacaacacactgtgcagaattagacagatgttccgtggtgtttggtttccctttcttctctctcctgctcactctgcattatagcagcagcttatttctctaaggctggacagcctggctctcggcagtgacgtcctcccacacctggtcacaagtagtagtggctgtgctatacccagcatcatgcttaacagcgtgttgcccttctgagcctgttgtactcactgatctctttaaaaacaaaaaatagctcttgtaaaaggtcacaataactctatgcacctgatactgcagtggttcctaggccattcttcatctgctctggacatctcagtcatacccaatgctcagtggatcatgaccaaactcctgtcatgtggatgcacg

SEQ ID NO: 8519 - DNA, 246 bp, Homo sapiens
acgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagag

SEQ ID NO: 8520 - DNA, 415 bp, Homo sapiens
  misc_feature 88: m=a or c
  misc_feature 108: r=a or g
atcaatctgacaaaatgggtatttatttgtgcctctcaagcgtgtggcttggacatgatgttccgcatcgtggaagtggccgtgcacmaagtggaatatctgttactrtagtaacagttcctttttattgataccagaataaacaggaatgcaaaggctgtctcacttgttggcacatttcagcagcctccgttcccaggggtttaagaaccgcactctagaggcagccctccttgctagtctgggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggcc

SEQ ID NO: 8521 - DNA, 469 bp, Homo sapiens
  misc_feature 343: w=a or t
  misc_feature 375: k=g or t
  misc_feature 414: k=g or t
  misc_feature 440: m=a or c
  misc_feature 458: s=g or c
gtatcagatgttccaggagtgggtctccctgctcgcgcttgctcactggtgctcttacttttgcttcatgttcactcactctgtcctgacttgtgtcctttctctaggttatacttaacactcttctcgccttatatagcaaggtctggtcgttaatgttaacagaaatctaacaacagggaaggctgccagatagcattaatcaggccagtgtttggaatttcataaatgctctgactttgggtacaaattgaacattaagaacaatatgaaaactgtcttccttcctctctcttcttctctcctctccccctccccagcctatccagtttctctctctgtwtctctgtgaattcctctgctttgccatatgcktgctgcattggaactttgttgatttttgccacgtttaaktttttatttctctgtctctccgtcamtccaagacacaggcggasagcagcagccg

SEQ ID NO: 8522 - DNA, 191 bp, Homo sapiens
  misc_feature 178: n=a, g, c or t
aggatttctctcctccctgggggtctcagtgcatctccttctcctctctgcctgcctcctccctcaccgaaggttagcggacacccatccttttctgcttggggaccccaccaccacccgcaacactgccgctgtctcttcttcaccgtatccttctctacccaccctcttctctctnctcttctccctcc

SEQ ID NO: 8523 - DNA, 176 bp, Homo sapiens
ccttccagccctctcagcctctgcagcaacacttcgctgcctccatctctccgccggaatctcgcaggctcgcgcctttcctcggctcagccccgctcccctcctctcctatcccctcctctcctatcccttcattcccccctcacccggatttgcttcccttcccccttctcccg

SEQ ID NO: 8524 - DNA, 369 bp, Homo sapiens
acaacagacccggccctgccagcgggcggtggcgcctccagatcagagccctcgggaaggaggcctgggcgggcctggcccgttcacctgtgtgccctgcagttctgcccgaggctcaactctcaagggcctgggaggggtgctgccggccaagagggtccaggacctcactggactgtgccccacagggagatcccgaagagcctgtttctgtccctcggggagccaggagggaaccaggaccatgttccagtaaatgaggactgcagcaggagccgtgagccctgactcccggccagagacacgacgtcagaccagaaagaatgaggaggccgcgtggggcccgcgggtgtgcagggcagagaggga

SEQ ID NO: 8525 - DNA, 176 bp, Homo sapiens
  misc_feature 116: r=a or g
  misc_feature 117: n=a, g, c or t
atctgggcccattggactgcggattctcgctcaacagcccttgtctgtgacctgcttcagcctggcactgcccagccctccagccgtagctgtggcctcccctgcccctgctccarntccatcccctgctccggctcgagctcaggctccagcttcagcccgggatccagctccag

SEQ ID NO: 8526 - DNA, 169 bp, Homo sapiens
gagaaggagagacggctggccaccatgcacggctcctgcagtttcctgatgcttctgctgccgctactgctactgctggtggccaccacaggccccgttggagccctcacagatgaggagaaacgtttgatggtggaggctgcacaacctctaccgggcccaggtatcc

SEQ ID NO: 8527 - DNA, 165 bp, Homo sapiens
atgccgtatactctcaacaggttttctcatttgctccttgggacagctcggtaaggatgatacagtcagttctatctcacagataatcaagctcaggctttcagagcctaagtcaccttcccagaacaggcccggcaccacctctgcgcacaaccccgcgggcct

SEQ ID NO: 8528 - DNA, 388 bp, Homo sapiens
  misc_feature 126: n=a, g, c or t
  misc_feature 127: r=a or g
  misc_feature 129: s=g or c
gctatgacaacagggcgaagatggctcagagttaggctggagaggggaggtgtcccttccgctgcggccgtcgggtttctgctacatcccattcaccgcctcctccatcctttcctcctcggtgtnrascagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgc

SEQ ID NO: 8529 - DNA, 395 bp, Homo sapiens
tctcgttctttctcccttctctgcctctctctcctccacgctgctttgatttcgctcttgcctctcttcttgcgctgctcagctgggaacatcgtctcaccaggggcagcagcgacgcgctgcacagccagacaggagctggctgcggggcatggaagcagcctccttggcagccgggagaggagcaagcgcacgccactgcccgtgacccaggcgtccggctgctgtcccctgccggggagctcatccacgcagaggtctctccctgtcctccctgcgagcttttcctctgcagagcccagtggagccagtccccacaggagacaaccctgacgggagcatggagctgctgtccacgccccacagcattgagatcaacaacatcacctgcgact

SEQ ID NO: 8530 - DNA, 155 bp, Homo sapiens
attgttcctggcacttgacacccagttgctgatgggtaaccgacgccactcgctgagccctgaggagtatatttttggagccctcaacatttacctagacatcatctatatcttcaccttcttcctgcagctttttggcactaaccgagaatgag

SEQ ID NO: 8531 - DNA, 289 bp, Homo sapiens
atttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagatggagctacaaattctcagatggcgaccgtgtaaatggtattagcggccga

SEQ ID NO: 8532 - DNA, 430 bp, Homo sapiens
agggatgccgtgactactaagctctatggtaggagttggggcaggaggaaacaactttagaagacacctgtgtgtccctccctgcttgcatctagcttcttcgtctgcccaggtggactgctcttaccgttgcaaatctgggagcactcagttgtggaacccagccaccatgttgtgaagaagccctgtgcagtggtccaagtgaccaggagtcaaagctcccagtcaatagccagcactaacttgtcagcagtgtcatggagcccacttgaaagaggattctaattatgctgcccaagctgtggccacatggaggagagatatacagtccctgctgaaccctgctctaattacagggagacttgaaaaccagtggtggcgagactccaagactattatttttatttccggacaaaaacatctgcttcac

SEQ ID NO: 8533 - DNA, 424 bp, Homo sapiens
  misc_feature 347: n=a, g, c or t
  misc_feature 348: k=g or t
  misc_feature 360: r=a or g
  misc_feature 385: r=a or g
  misc_feature 401: y=c or t
  misc_feature 403: y=c or t
ctcagttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttankagcaacctcagrgacttgagccctactaagtgactgrccactgtttagagtgycyggtatctgatgtcatttattc

SEQ ID NO: 8534 - DNA, 313 bp, Homo sapiens
  misc_feature 252: w=a or t
  misc_feature 286: n=a, g, c or t
gacggaagtggcctctctgcttctgcagggctggggaagatgctgcgtccagcgttaccgtggctgtaccttggcctctgcagcctcctggtgggggaggcagaggccccgagccccgtggatccgctggagcggagccggccgtacgcggtgctgcgagggcagaacctggtgttgatgggaaccattttcagcatcctgctggtgactgtcatccttatggcattttgtgtctacaagcccattcggcgwcggtgacagccagacaagttcttcaatgagtatntgggaataataagttgtgttgcacaca

SEQ ID NO: 8535 - DNA, 375 bp, Homo sapiens
  misc_feature 237: n=a, g, c or t
  misc_feature 271: k=g or t
  misc_feature 281: n=a, g, c or t
  misc_feature 282: n=a, g, c or t
  misc_feature 305: y=c or t
  misc_feature 306: n=a, g, c or t
  misc_feature 308: s=g or c
cagttcctggtcccccactttctcaaccccacagatgctccgggcccctgcccctgccccagctatggctcctggggctccctcatccagccccagccctatcctggctgtgctgctcttctcttctttggtgctgtccccggcccaggccatcgtggtttacaccgacagggaggtccatggtgctgtgggctcccgggtgaccctgcactgctccttctggtccagtgagtgggnctcagatgacatctccttcacctggcgctaccakcccgaagggnncagagatgccaatttcgatcttynastatgccaagggacaaccctacattgacgaggtggggaccttcaaagagcgcatccagtgggtagggg

SEQ ID NO: 8536 - DNA, 316 bp, Homo sapiens
  misc_feature 85: s=g or c
  misc_feature 86: m=a or c
  misc_feature 90: s=g or c
  misc_feature 142: k=g or t
  misc_feature 244: r=a or g
  misc_feature 245: r=a or g
caccactacaatcttcctaggaacaacatatgacggccatggtagcggtggggagtggctgggcgcctgggctggggggtcagtsmcggstttggctctggaccttccttcacccctgacttctgcttcacctttgacctckgccccccatgaatcccattttacctctagacctataagttctggtttatgtttgacccctccctctgagctgcacttcaccgctgaccttgcctcacctttrrccccccacctgagccccagctcctacctctgaccccaacttctctttgatctctgaatcccctctgactcc

SEQ ID NO: 8537 - DNA, 190 bp, Homo sapiens
gaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggc

SEQ ID NO: 8538 - DNA, 138 bp, Homo sapiens
  misc_feature 90: n=a, g, c or t
agcagtagcagaggctgtagcatcggacaccctcctctctcccgcaatccggttcctcttccccctccttctcactgtttgttgtgtgtntgatgtgttaaagcaggagcgagaacccgagcagcgccatgagcaaca

SEQ ID NO: 8539 - DNA, 277 bp, Homo sapiens
agcagaggtaccaactatagctccacggccagaagataccagcagctctgcctttactgaaatttcagctggagaaaggtccacagcacaattaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctg

SEQ ID NO: 8540 - DNA, 477 bp, Homo sapiens
  misc_feature 199: r=a or g
  misc_feature 454: s=g or c
  misc_feature 471: s=g or c
  misc_feature 472: y=c or t
cacagggcccctttattcggcaaaaatgtcagtcagcgccccggggagcagccgagggtccctgagtgtccgcagcaatggcgctgagttcctctgctggagttcatcctgctagctgggttcccgagctgccggtctgagcctgaggcatggagcctcctggagactgggggcctcctccctggagatccacccccaraaccgacgtcttgaggctggtgctgtatctcaccttcctgggagccccctgctacgccccagctctgccgtcctgcaagaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagcsatgggcctgcgcgcgasyggaac

SEQ ID NO: 8541 - DNA, 294 bp, Homo sapiens
  misc_feature 149: k=g or t
ctgcgctctgggctgacggcgcttttgtctccggtgagttttgtggcgggaagcttctgcgctggtgcttagtaaccgactttcctccggactcctgcacgacctgctcctacagccggcgatccactcccggctgttcccccggaggktccagaggcctttcagaaggagaaggcagctctgtttctctgcagaggagtagggtcctttcagccatgaagcatgtgttgaacctctacctgttaggtgtggtactgaccctactctccatctttcgttagagtgatggagtcc

SEQ ID NO: 8542 - DNA, 136 bp, Homo sapiens
  misc_feature 37: n=a, g, c or t
  misc_feature 134: n=a, g, c or t
  misc_feature 136: m=a or c
cgcttttagtttctcttctttctaaagaaggctcgcngacccggctggagaacctcaccctcgccgagcctagaaccgagagggggccaccccaggcggtcaccagcagatttgcccgcgcgttctctttcttnam

SEQ ID NO: 8543 - DNA, 478 bp, Homo sapiens
  misc_feature 344: m=a or c
  misc_feature 457: m=a or c
  misc_feature 475: n=a, g, c or t
  misc_feature 476: n=a, g, c or t
ggaaattaggacacctcatcccaaaagacctttaaataggggaagtccacttgtgcacggctgctccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggmctgctattgcagaataccagcgtgcattgcaggagaacgtcgctatggaacctgcatctaccagggaagactctgggcattctgctgctgagcttgcagaaaaagaaaaatgmgctcaaaatttgctttgnnag

SEQ ID NO: 8544 - DNA, 229 bp, Homo sapiens
ccgaagcgtcgcggcctgaggagacccgttgggtcctcagcgtcttggcggcagttggtggaaccggagcttcgagtccgtccccggtgctgcctgcgcgttcacctgagtctcgctggagctcttctcgcccgcccacctcatctcaacccactttccgcggggagcggcgccaagctgggccttcctcggatcaggcgtcccctgaagtcggcacgcccctctgcgt

SEQ ID NO: 8545 - DNA, 287 bp, Homo sapiens
  misc_feature 120: s=g or c
  misc_feature 123: n=a, g, c or t
aggtggagcaagatggctgtggagctgggcgtgctgctcgtccggccccggcccggaaccgggctgggtagagtgatgcggaccctcctgctggtgctgtggctggcgacgcgcggaacsctnctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccag

SEQ ID NO: 8546 - DNA, 516 bp, Homo sapiens
  misc_feature 295: r=a or g
  misc_feature 298: y=c or t
  misc_feature 401: r=a or g
  misc_feature 496: w=a or t
  misc_feature 497: y=c or t
cagtggtttaccactttgttctatgttctggttttgtaaaggatagtactggaatttgcgtctgaagaccaatattggtgtaactcctgtcagtatattggtaaaatgtagcagaggcaggagtttggatgtttggatgggattcccttaggattctacagccaataaagatcctatttcctatgcatgtcccaggaatcagtaatcctcttttactctgttgggatgagtctttttttgtttctgttcagagtggttactaacttcaccttctttcctcttgctgtcatctgcrttygtgcttcccacctgttgttggcatgtcctttaccttctctttccctgccacatcaacctacacactgactcatcattgacgtggaagatgtggaagatgtcargtttgtgatcaactatgactatccaaacagctcagaggattatgtgcaccgtattggccgaacagcccgtagcaccaacaagggtaccgcctatwycttcttcaccccagggaac

SEQ ID NO: 8547 - DNA, 187 bp, Homo sapiens
  misc_feature 88: k=g or t
  misc_feature 130: k=g or t
  misc_feature 152: k=g or t
  misc_feature 167: k=g or t
tatttcagagccgggttcgccgtcggatcaacctccaggagctagcagcgggcgcggaccgggcagtttccgcgctcagcacaggcakctcgcggtcatgggcggctcagcctccagccagctggacgakggcaagtgcgcttacatccgakggaaaactgaggctkccatcaaaaacttcagtccc

SEQ ID NO: 8548 - DNA, 388 bp, Homo sapiens
  misc_feature 107: k=g or t
  misc_feature 116: n=a, g, c or t
  misc_feature 241: n=a, g, c or t
  misc_feature 372: w=a or t
  misc_feature 374: k=g or t
ctctggcacctcttccgtcggctgaattgcggccgtatgcgcggctctgtggagtgcacctggggttgggggcactgtgcccccagccccctgctcctttggactckacttctgtntgcagccccatttggcctgctgggggagaagacccgccagcaccctgagcgtcaactggagcctcctgctatcccctgagcccgatgggggcctgatggtgctccctaaggacagcattcagttnacttctgcccttgtttttaccaggctgcttgagtttgacagcaccaacgtgtccgatacggcagcaaagcctttgggaagaccatatcctccatactccttggccgatttctcttggaacaacatcactgwtkcattggatcctgcc

SEQ ID NO: 8549 - DNA, 155 bp, Homo sapiens
  misc_feature 32: w=a or t
ctccttactgtggtctatgaagctccaagtawtctggcccctgccacatcactgactttcctttgcctaacctggtggccacactggcttctccccagttcttcagacccagcagctccatcctgcctcaagacctttgtgcttgctgttccacc

SEQ ID NO: 8550 - DNA, 377 bp, Homo sapiens
ctccctctcctccgcccgcccgcctgccactagctcattgcgcctctcctgcagtctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagccatggctggtcccttctcccgtctgctgtccgcccgcccgggactcaggctcctggctttggccggagcggggtctctagccgctgggtttctgctccgaccggaacctgtacgagctgccagtgaacgacggaggctgtatcccccgag

SEQ ID NO: 8551 - DNA, 249 bp, Homo sapiens
  misc_feature 39: y=c or t
agtcgctatcggaggccgcgcgggtggctgagcagcggyctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccc

SEQ ID NO: 8552 - DNA, 388 bp, Homo sapiens
  misc_feature 224: m=a or c
  misc_feature 245: s=g or c
  misc_feature 246: m=a or c
  misc_feature 255: k=g or t
  misc_feature 259: r=a or g
  misc_feature 297: w=a or t
  misc_feature 298: y=c or t
ttcccaaacttctgtctgcccaaatgggctctgaccgtgctctgtcggcccgagacatttggaagtcctgggggatgctggcaaatctcagctgttgctgaggagggggctgggaccccttcccatcccaaccttgagccccaggagataccgcgcccacacccaatcttgggacactccctatctggttggaagagagtaaccagtttccagagagccagagmgtgagagagagaaagagagtsmgagagagakagaragagagagagagatgctgttgaatcagaaacagatcawyagcccaaagattttcctgtccctggagtgccagccccaggaagctccagggctgagtggtcaggagccagtttctccagcccctcctccc

SEQ ID NO: 8553 - DNA, 372 bp, Homo sapiens
  misc_feature 204: r=a or g
  misc_feature 289: s=g or c
  misc_feature 290: k=g or t
tataaaaatttgcttaggtctgtctacaagccagaaacctacaacaccaacctttgttacaagtgttacatttactttagcttaaaatgcacattagaagacaaacaccttgtcattttaactgttgttaaaagataattcaaatggttggtgtctttgttaagaattgtctcagtgtggccagcgcagtggctcacgcctgtratcccaacactttgggaggccgaggcaggcggatcacaaggtcaggagttcgagaccagcctggcacgtggcgaaaccccatctskactaaagatacaaaaaattagccgggtgtagtggcacgcacctgtaatcccagctactcgggaggctgaggcaggagaatcg

SEQ ID NO: 8554 - DNA, 199 bp, Homo sapiens
  misc_feature 135: k=g or t
  misc_feature 154: n=a, g, c or t
  misc_feature 155: k=g or t
agtctagggggtctcagattggcggggatgggcagcagcggcaggtggccttggcttttgctgcagccgtcaacgacctatcatcggggtcctgcgtaaggtccggctggctgggacttggctgtgggtgggatkgactggctgccggaccganktgcctgcagttggtaggagtatgaggcagagtgatgcacacccg

SEQ ID NO: 8555 - DNA, 156 bp, Homo sapiens
aatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgg

SEQ ID NO: 8556 - DNA, 473 bp, Homo sapiens
  misc_feature 396: n=a, g, c or t
  misc_feature 397: n=a, g, c or t
  misc_feature 418: m=a or c
  misc_feature 419: n=a, g, c or t
agctgtggttactggtgacaggtcgcctgactgggctcctccccgggcccgccccgacaggtttgtcttgtgaccgcgggcggccgctgcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacccaaccctgccagctgagcaaaggacagtcttacagcgtcaatgtcaccttcaccagcagtgcgtaaaagtggctcttaactcaaattcatgttacagcataacctaaatatcaagtgttggaataagcatgggaatggagnngaggggaattggcagtcatgmnttttatgatttcttttgcacctcatgcaaagctagggttcactgtgcccttgga

SEQ ID NO: 8557 - DNA, 322 bp, Homo sapiens
  misc_feature 126: m=a or c
  misc_feature 134: m=a or c
  misc_feature 261: m=a or c
  misc_feature 297: w=a or t
aacgcctcggggaaagggaagcggacgggcatctggaatcgctgcctctggctttctgttttctactaacaggatttggtcactggttcttcatcttttgtctgttgcacggcatcccgccctccmccacttgmttccccactccttggatccagccctgtgggcattcacgtcagttctctgaccccgccgtgagccccgctccgggtccccgggcgggcttggcacggaggcggtaactatggagaatatggcggaggmggagctgctgcccctggagaaggaggaggtggaggwggcccaggtccaggtcccgacccca

SEQ ID NO: 8558 - DNA, 541 bp, Homo sapiens
  misc_feature 91: r=a or g
  misc_feature 99: s=g or c
  misc_feature 114: k=g or t
  misc_feature 123: k=g or t
  misc_feature 139: r=a or g
  misc_feature 162: n=a, g, c or t
  misc_feature 165: n=a, g, c or t
  misc_feature 216: r=a or g
tttgttaaatctactaataaactgttctcttagtagattaagagagagtaatattaattgtgcatgtgcagttgtatttctcattaactgrcagtatgscccatttgtttttakggctttctkatctaaactgcactgrtgaactagattaaagccttgggnganttatactataaattcagtgatggcaagaaccaacactgtttttttgtgagrattgtcagtgtaactattacctaccagtattgttcagagagattgaaacagaataaactggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactg

SEQ ID NO: 8559 - DNA, 210 bp, Homo sapiens
ctattccttcacacccttcatcccagcctctttttgctttctcttggactgacccttacactcatcagtctcagcaactcacctggactgttcgccccaagggttcaaggagagcccacactactttggccaggccctttctcattatctgctttctgtttgctcacctgccttccaccttattcaatattttcatgatcttctttgtag

SEQ ID NO: 8560 - DNA, 353 bp, Homo sapiens
  misc_feature 187: n=a, g, c or t
agcgagtccttgcctcccggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacncaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctc

SEQ ID NO: 8561 - DNA, 150 bp, Homo sapiens
actgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcacc

SEQ ID NO: 8562 - DNA, 378 bp, Homo sapiens
  misc_feature 228: y=c or t
  misc_feature 245: r=a or g
gcagtgcccatggtggctcggatgggaggaaccaccgcggagcggggacagggggagcagggcagtgctctgctgggtgaggggcacccagctccagaggctagtgctggccggcgaggactgcctgtggtacctggaccggaatggctcctggcatccggggtttaactgcgagttcttcaccttctgctgcgggacctgctaccatcggtactgctgcagggaccygaccttgcttatcaccragaggcagcagaagcactgcctggccttcagccccaagaccatagcaggcatcgcctcagctgtgatcctctttgttgctgtggttgccaccaccatctgctgcttcctctgttcctgttgctacctgtaccg

SEQ ID NO: 8563 - DNA, 146 bp, Homo sapiens
  misc_feature 122: s=g or c
  misc_feature 140: r=a or g
acttcagagtttgaaaaaaaaaaattgggaagtagaggtgttgtgctgagcggcgctcggcgaactgtgtggaccgtctgctgggactccggccctgcgtccgctcagccccgtggccccgsgcacctactgccatggaracgcgg

SEQ ID NO: 8564 - DNA, 301 bp, Homo sapiens
atttccagtagtacctcctttcttaagtagcattgctggagtcccaaccacagcagcagccacagcaccagtccctgcaacaagcagccctcctaatgacatttccacatcagtaattcagtctgaggttacagtgcccactgaagaggggattgctggagttgccaccagcacaggtgtggtaacttcaggtggtctccccataccacctgtgtctgaatcaccagtactttccagcgtagtttcaagtatcacaatacctgcagttgtctcaatatctactacatccccgtcacttcaa

SEQ ID NO: 8565 - DNA, 511 bp, Homo sapiens
  misc_feature 36: s=g or c
ctgcttccccagctccagaacttccggccagcgcascattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgacctgaccagccccaccggcccatcctggtcatgttactgcatttgtggccggcctcccctggatcatgtcattcaattccagtcacctcttctgcaatcatgacctcttgatgtctccatggtgacctccttgggggtcactgacctgcttggtggggtcccccttgtaacaat

SEQ ID NO: 8566 - DNA, 222 bp, Homo sapiens
  misc_feature 118: s=g or c
gacaccccgcgggcctcggtgccagcctcccgcttacccggtcagcccctgggccgagtacccctgggagagaaagcgctaaattcccccaacactcccgtgatgggggcacagggascgcgggacacctgaggaaactgagcccaagtgttaattaacttgccctgatcacctagcacgtggagccacgacttgctcaagccctgcctgattccagccccg

SEQ ID NO: 8567 - DNA, 177 bp, Homo sapiens
  misc_feature 135: k=g or t
  misc_feature 147: s=g or c
  misc_feature 156: s=g or c
  misc_feature 168: s=g or c
  misc_feature 172: m=a or c
cttcctctccctcgctcctcctctccgcctcaacttgctccggcctcctcgctcctgcctgagttcggggcctggtctgggcttcgtcctggggctgggaagtttctgcgctccccgctgtccagtctgcatctkcggggcttccgscgggccccsgcggtcccctcscgcmcgctt

SEQ ID NO: 8568 - DNA, 474 bp, Homo sapiens
  misc_feature 115: y=c or t
  misc_feature 117: k=g or t
  misc_feature 122: k=g or t
  misc_feature 126: y=c or t
cttcgggagactacttctcgcggtatctgactcctaggctccgccctctgcacgccgctcacggtatctgacgctcaggctccgccccctgcatgtctttgttggcaaacagttytkggggktcgyccgatcctgcagagaccgtccaggctggacttgaactccttcctcggctgaagtgatcctcctgcctcagcgtcctgaataggaagtggagccagaatccacagatgtcattatccatctgcacactttgtttactacccagaaggcaagaatattgcattttaaaagtgcccggacttttgttctttcttatcacaaatgacttgggaagctccgaccactcatgtttaccccgagtgaaagtcccattcaaagccttgcttcctggagagctttgagattctggtacaaaaggcattttataagcacaaagtggaaaagcatcattcatattcatttgctgctgcg

SEQ ID NO: 8569 - DNA, 231 bp, Homo sapiens
  misc_feature 14: k=g or t
caggaatgacgtgktgactgtagtgagggttacagtgaagaattgcccactgtttggccttgctgaacagcaaatttgggccagcagtgggtctgttttctctcttttctttttatttatttatttttttgagacagaatcttgctctgtctcccaggctggagtgcagtggcgtgatctcggctcactgcaagctccatcctgggttcactccattctcctgcctcagcc

SEQ ID NO: 8570 - DNA, 465 bp, Homo sapiens
acataggcagtggctgtggtttctaccccgggtggccgggggcagtgctgagctgggactgttgtttgcccagcctgggctgcagaaagcagcagttaaagttcgtttctgttcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtacccacgtccttcatgagccttcgc

SEQ ID NO: 8571 - DNA, 360 bp, Homo sapiens
  misc_feature 120: s=g or c
  misc_feature 121: s=g or c
  misc_feature 352: m=a or c
ttttcctgtttgcgtgcttttgggggtgggggaggcgtccctccctggaccccggcgacttcctctctcggtctagctgcggggtggcagaggcaaagcggtggtgaggaaggctgggasstgaggggcaggagactgaagccaacctcgtactgaagagcagctgtcattgcaggggaggagccccagccccccgacgaggaggaagcggagcttggagctgctgaggcagtttgacctggcctggcagtacgggccctgcaccgggatcacacggctgcagcgctggtgtcgggccaagcagatgggcttggagcctcccccagaggtgtggcaggtgctgaagacccamcccggaga

SEQ ID NO: 8572 - DNA, 209 bp, Homo sapiens
  misc_feature 42: w=a or t
  misc_feature 81: r=a or g
  misc_feature 87: s=g or c
  misc_feature 146: k=g or t
ggatgtgaggcgatctggctgcgacatctgtcaccccattgwtcgccagggttgattcggctgatctggctggctaggcgrgtgtcsccttcctccctcaccgctccatgtgcgtccctcccgaagctgcgcgctcggtcgaagakgacgaccatccccgatagaggaggaccggtcttcggtcaagggtatacgagtagctgcgcacc

SEQ ID NO: 8573 - DNA, 315 bp, Homo sapiens
  misc_feature 264: n=a, g, c or t
aaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtaagtctgtgggcccgtcctcccttcgctggcccagatttcgggctccgactcctacctggagtgtgaatggcagtncttgacggacagccttcaccgtttgctgggcccctagcctggcccttggtt

SEQ ID NO: 8574 - DNA, 216 bp, Homo sapiens
ctcttttggggttcttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtacttcctcttcgttttcaacctcttcttcttcgtcctcggcagc

SEQ ID NO: 8575 - DNA, 311 bp, Homo sapiens
  misc_feature 176: k=g or t
  misc_feature 300: r=a or g
ttaaaattaaaaggaaaatgttttgatcctattgggatcaagcaagttttcttgcctatcaataatgaaaatgtgttttttaaaaaacaataccttctccttttcagaaattgttgagatattttggaagtgttttcatttttttccccccttggactgggcagacctttggattkcctttttctttctgtaccttctcatgtgcacaggatcactgcacatcctgccctttgctgaaaggccatagttcacatgaggtcttcagttctcccactttcagccactgtatacagtgttagrccatgctgtag

SEQ ID NO: 8576 - DNA, 398 bp, Homo sapiens
acacttagcagtgccgcagccgacggggtgcggttcggcgctcccaggttcctttcctcactgcacgctcttgcccctcctcttttctctcctgcccgtgttcttcccgccgcctgacctggcccgcccgcctttccagtctggccgggcgggggcctgaagcacggcggctcgggccgtgggaccgtgttcacaccctttccagaaattcttggctggtaaccgcgaaaccgactggagcaggagctgggagaactggagaaaactgctctaatctcacttgactccagctaggagctgatgctgcatcgtaataacatttgcagagcgctttcacaggcgctggagtgacttgtctgagattcctccagaactgagccctttgttggaaccatacc

SEQ ID NO: 8577 - DNA, 264 bp, Homo sapiens
  misc_feature 55: y=c or t
ctcttcatctcgcggctgtctgacttcctcccagcacattcctgcactctgccgygtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccacca

SEQ ID NO: 8578 - DNA, 173 bp, Homo sapiens
ctcagcgtccggccgaggcgcggtgtatgctgaaccgctgccgcagccggctgctccacgtcctgggccttagcttcctgctgcagacccgccggccgattctcctctgctctccacgtctcatgaagccgctggtcgtgttcgtcctcggcggccccggcgccggcaagggg

SEQ ID NO: 8579 - DNA, 270 bp, Homo sapiens
  misc_feature 203: r=a or g
aacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctcaacctgtgattgtgacatcacccctacctraggaagcctcttccagcctgctcaaggttgccgtagttaggtttaccctcccttccttccctcaccc

SEQ ID NO: 8580 - DNA, 221 bp, Homo sapiens
gattcgcgcagaccaggaagcggatagcgtggagtgacggtgccaccgcggcgcgtattgcccgggctgtgagtgcagtctcatgatcttgggtcactgcaacctctgtttcctgggttcaagtgattcttgtgcctcagcatcccacgtagctgagattacaggattgacttctaaagactcttggtacgtgaggaagaaacccggaagaggaagaggag

SEQ ID NO: 8581 - DNA, 194 bp, Homo sapiens
ttagttttcgcccgcgctgcgccgcctggttgctcctcccgtgcggtgagtcccgaagcccggagccaagtgggtctgggcaagcggggccttacctagggataccaccggacttggatcggagcagccttcaggggacgtggcgcagtcgaacagagccaccatggggacgacggccccagggcccattcacc

SEQ ID NO: 8582 - DNA, 293 bp, Homo sapiens
  misc_feature 12: s=g or c
actggtccctgsgtattggggcgtatgcgcatgctccgctcacagggtcgggctctgggcggcggagaccagccgcctgtgctccagttcccggtgagcctcggtactgtggcagcagtcagtgtgtctggcgggtgtcggcgtgaagcggggctgggccagcgggaggtagctctgtgggagtggaaggcctgtatttctctacctggaccgcacgctcctcgcgcaaggagggtagagctcaagttccgtgatgatggtctaagcaaagacccttcgtcctgttaaagata

SEQ ID NO: 8583 - DNA, 211 bp, Homo sapiens
  misc_feature 93: s=g or c
attgacgccatattggggccggcggcgggtgggagagttctacgagggaggggaagcggttggacgtgttcgcttgggttcctgctgcggcascacctcgcaatctctctgcatcgatcgccgctcgcaagctactgaccgtactcgggcgtaattaggggagccgcgttccagcctcacaccccacggtgctgttttcgacttcagaaag

SEQ ID NO: 8584 - DNA, 145 bp, Homo sapiens
tttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaag

SEQ ID NO: 8585 - DNA, 297 bp, Homo sapiens
  misc_feature 242: w=a or t
tgagcgagccgggccgttcgttactctgctgtgctgcctcagacgcggagggctgcgtgcagtgggagcgggctccaggagcccgagcctccagccgtcctcagagcaaggcagcaccgaggcctggccacagcaatatccatctggaagctcttcccttcactcccaactctgaggttgcctaactctttattaaaaattcagaagggggaatgccagcccctagcatggactgtgatgtwtccactctggttgcctgtgtggtggatgtcgaggtctttaccaatcaggaggtta

SEQ ID NO: 8586 - DNA, 353 bp, Homo sapiens
cgaaaaatttttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgt

SEQ ID NO: 8587 - DNA, 416 bp, Homo sapiens
agaaagctccgcttcccctcctgggtgttattgcccctttcctggtgcaggacgcggtagtggccagcgagagtgtcaggcctggggttttctgtgtccttccctgggtcagggacgagccagtgacttgactcttgggcgctaagcttgggagggagcgcaggaggccgctgtccttcctttccggttcacgtcacccttctctccctctgttgctccacctgcagccacttggacggctccgggactgattgcctggggcaggggtggcagtcgaggccgccggggccgaggtgaggctgcagctctccgggcggcggtagcgctggggaggaggaggagagaagatggcgtcggagctagagccagaggtgcaggccatcgaccggagcttgctggaatgttcggccgaggag

SEQ ID NO: 8588 - DNA, 247 bp, Homo sapiens
  misc_feature 196: r=a or g
tattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaratgaaataaagcatgtttggttttccaaaagaaaaaaaaaaaaaaaaaaaa

SEQ ID NO: 8589 - DNA, 401 bp, Homo sapiens
  misc_feature 189: w=a or t
  misc_feature 190: n=a, g, c or t
  misc_feature 191: n=a, g, c or t
  misc_feature 192: m=a or c
  misc_feature 291: k=g or t
acggcgcccgcgggctggggcggtcgcttcttccttctccgtggcctacgagggtctggatccttctctgccggctcgtgggccgtgcctttgcccttctgcgaggccctgaatctgatcccttcccttcatatccggatccgggctcctccctccaagcccggggttccggacacctcccccaagacwnnmcctctggcctcctctccttcagtacttggaatctgatctcttctccctaattctgcggatccggcccctaatattctttatcagaccctcagacaagakgctgacttctgcccccttgtcaaggagcgaggccactttcctctccaccccatgctagcgaggataacttatttctcttctggaattgcatcttatgcgctttccccacc

SEQ ID NO: 8590 - DNA, 161 bp, Homo sapiens
ctcctgagcaagcgtggctgaaccctcctacctgctcaagtgccctgccttgccccacccagcccagcctggccagagccccctggagaaggagctctcttcttgcttggcagctggaccaagggagccagtcttgggcgctggagggtgaggggctggga

SEQ ID NO: 8591 - DNA, 470 bp, Homo sapiens
  misc_feature 369: r=a or g
  misc_feature 389: n=a, g, c or t
  misc_feature 390: n=a, g, c or t
  misc_feature 424: w=a or t
tatttttctgtgtatttaggaagtttatgtatatttgggcagctaattttaaggaaacaaatgagaacctgcccggaatagacataataaaaactaatctatgccttgacctttcctcacccactttgttgccttttcacatgacgttcccgctatctcatctctgcttctcaatacattccttttccatggaggtgccaggctgtggcaagagaatgaggaattggatttggaatccccatggtgccagtctctaagtcactgtttgtgtccattcttagaggaccttggcatccagaaggagtaattatttaacaggtaatttagaagagaaagtcttgcaagcctgttcagccagttgtcagttgragtctgcgtggctaatgccnncccaaccaaaactcacgagaaatcatccattcawattgctcttccacagccactctggcattttaaatccccaagatgtt

SEQ ID NO: 8592 - DNA, 298 bp, Homo sapiens
agcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagc

SEQ ID NO: 8593 - DNA, 311 bp, Homo sapiens
  misc_feature 281: r=a or g
tttcccctcttccgagctgccttctcctcctagctacagtgtggcctccctcccgttccctactcctcctgactcccctcttgctcttcccaatccctcctctccagatttcccatttcgcccctgtgccagcctcatcctccctcatcctgcctcttgccttctctctgccctttaggcctcctgccagaagagatcctgacccccacactctaccatggctactatgtccggcctcgggccgccccagctggggagggcagcagggcaggggcctccgrgcttaggctcagtgagggcaagttccaggc

SEQ ID NO: 8594 - DNA, 379 bp, Homo sapiens
  misc_feature 66: y=c or t
  misc_feature 312: n=a, g, c or t
  misc_feature 313: n=a, g, c or t
  misc_feature 352: r=a or g
aagtcctgagcagaaagaacctcagaagtcggtctatggtctgttcaggttgatcccagcatacaytgggggctcctaagggacccgagcctaatggatttgtgggagttccagaccgtggggtgcagaggttgcggccacgggcgagaatccccatctgagaggagcgttgctgttttcggtgcgtcagggtaaattaccttttctctctatgcaaaagaatgcaaatgagcagaacttttaaagaagaatttaaagtaaaattacgtcaaaatgtagctgctttgacctcttcgtctcagatccgagcannggcttcccctttgtgctatttgaagggacttaggataartttgaaaagcctgaactaaagaaatgg

SEQ ID NO: 8595 - DNA, 263 bp, Homo sapiens
  misc_feature 32: s=g or c
  misc_feature 208: n=a, g, c or t
  misc_feature 210: n=a, g, c or t
  misc_feature 218: n=a, g, c or t
agattggccgccggtgacgggtggccgtgctsggggcgggagggcttctgtggtaggaagggaggtccgctcggccgggtgcgccgccccagtgctctgtgggatactggaagtctcgagcgtcggctccgggttcccagccctcctctggcccgcactcatagaaacattcacacaccccctgcctcccctctcttccctctccgcntnccccttcncccctcgcgataagaagacccggcggcaggagaggggatgaagat

SEQ ID NO: 8596 - DNA, 275 bp, Homo sapiens
gacattcgggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgtgacgcattcccagactcttc

SEQ ID NO: 8597 - DNA, 326 bp, Homo sapiens
  misc_feature 157: k=g or t
gacattcgggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactctkggcttcaagcgattctcccacctcagcctcccaaagtgctgggattacaggcgtgagccaccacgcctggcctcactcaaacagtaaacgagtcactgtatatatgccttatttcctgggtccatgggaagcatgagtctgttgggacttgggacaagaagaaaacaag

SEQ ID NO: 8598 - DNA, 339 bp, Homo sapiens
  misc_feature 299: r=a or g
  misc_feature 310: r=a or g
gtatttcttagcttgctgggctccatgggagtgggacccactgagcgagaccacttggctccctggcttagccccctttccagaggagtgaatggttctactgtctcactggagttcaaggtgctgctggagtatgaaaaagcttttgcagctcagtggctgcccaaacagtcacccagttttgtacttgaaacccaggaccttggtggtgtaggctcatgtagggagaccccctgaaactattgctatggaataaagatgaaatgctcctgattattgtaaatgcaaaattgcatgcrggattgtgtaragacaacgccaggttggattgccagaatg

SEQ ID NO: 8599 - DNA, 200 bp, Homo sapiens
  misc_feature 107: s=g or c
  misc_feature 108: s=g or c
ctgccccgccatgacccggctgacagtcctggccctgctggctggtctgctggcgtcctcgagggccggctccagcccccttttggacatcgttggcggccggaagssaggccccgccagttcccgttcctggcctccattcagaatcaaggcaggcacttctgcgggggtgccctgatccatgcccgcttcgtgatgac

SEQ ID NO: 8600 - DNA, 218 bp, Homo sapiens
  misc_feature 115: r=a or g
tcaggttccagaagtcctctgcagaagtgcttccctctctcatttccaggaccacaattcccagagacttcggcttcacgacgtttctctttttgcccgatctctcccggagctrgctgggcttcggccggccagaggcccacagcgacgacgtgatccgtcgtgagcgggtcccagggtttcctcggcggcccttttttctctcccctcggtcgtcc

SEQ ID NO: 8601 - DNA, 321 bp, Homo sapiens
  misc_feature 41: n=a, g, c or t
  misc_feature 44: n=a, g, c or t
aaagttctttccaactttttctcggcggagtgagcgcaggnggncgcagactcgggggcaggttgctgtgcttctccgggctcagccgcctgctctcctggctcaggtcctcggggagccctagacagacatcaagtggccactggcgctccttcccctcccagctgagccatcctccccggcctcctcgggcgggacagccccgtgcttaggtttttctccttttctcccccggtgcgcctctgctcggactctcgcgccgggatcgcggcggaaacctccctcccctttcgcctcctgcggctccttcccttcgcccct

SEQ ID NO: 8602 - DNA, 264 bp, Homo sapiens
  misc_feature 91: s=g or c
  misc_feature 99: n=a, g, c or t
  misc_feature 100: n=a, g, c or t
  misc_feature 117: m=a or c
  misc_feature 119: r=a or g
  misc_feature 124: y=c or t
  misc_feature 126: y=c or t
  misc_feature 128: y=c or t
  misc_feature 130: n=a, g, c or t
  misc_feature 154: n=a, g, c or t
  misc_feature 210: r=a or g
aggtccgtgccgggcgagagagatgctgcccggcccgcctcggctttgaggcgagagaagtgtcccagacccatttcgccttgctggcggsgtcgagcnntggccagacatgtccamarggttytycytncgggtccgggactctgggctccgncaccgtggccgccggcgggaccagcacaggcggcgttttctccttcggaacgggarcgtctagcaacccttctgtggggctcaattttggaaatcttggaagtactccaa

SEQ ID NO: 8603 - DNA, 188 bp, Homo sapiens
aagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctcc

SEQ ID NO: 8604 - DNA, 166 bp, Homo sapiens
aatacacgggtagggcttccgctttacccgtctccctcctggcgcttgtcctcctctcccagtcggcaccacagcggtggctgccgggcgtggtgtcggtgggtcggttggtttttgtctcaccgttggtgtccgtgccgttcagttgcccgccatggctgagctg

SEQ ID NO: 8605 - DNA, 630 bp, Homo sapiens
  misc_feature 88: r=a or g
  misc_feature 92: s=g or c
  misc_feature 383: w=a or t
  misc_feature 457: n=a, g, c or t
  misc_feature 472: w=a or t
  misc_feature 511: n=a, g, c or t
  misc_feature 614: m=a or c
  misc_feature 617: n=a, g, c or t
  misc_feature 618: n=a, g, c or t
cagctgatatattgagtcactaaatacgaagaaaacatgcactaaatctccctttttacatactactaataaacttgacatagagagraagsagtaaacatacaagtaatgaatacatgaaaacaaaaaacttttgggctattctttggacttcagtctttgctgcattaacactatttaagatttcctctaatttttattatacattggatagaactagcaacatgaacaatgacaatattttcaggtgcataatatgtacagatgagtgagtgtgtgtctgtgtgttaggcactgttctaagcactttatatggttaatcacatttaatcttcatacccaataaaataggtggcatttttatctccatgttatggatgtgwaaactgaggaacagggtacctaagtgatttatctaaggtcacacagtagcctggggtagaaccaaagtttgaancaaggccattcttgwttaattcactctataatattacccatggaaagttatggnatttatagagtactgtaagtcaatagacactgaaaacattttcttagagatggggtcttgctgtgttgcccaggccggtcttgaactcctgggctcaagcaamtanncctgcctcagcc

SEQ ID NO: 8606 - DNA, 451 bp, Homo sapiens
ctcagtgtctagggaagcttggggttctgctccttttacttcaggcgaacctgaactcagttaatgcaattttgaagcatgccctgaatagattcagtcattatcaagtcaaactaaaaacggtgaaaggttgcgactattaccaaataggaaaaacctgaagacataagaactacacatgaggaatatgtcatttagcactttcactttttgatctccacagaagacaatgagaagtcataccataacaatgacgacaacttcagtcagcagctggccttactcctcccacagaatgcgctttataaccaatcatagcgaccaaccgccacaaaacttctcagcaacaccaaatgttactacctgtcccatggatgaaaaattgctatctactgtgttaaccacatcctactctgttaagacatcgtgggactggttgggaacataatcg

SEQ ID NO: 8607 - DNA, 162 bp, Homo sapiens
  misc_feature 98: k=g or t
actggtggaatcccgatgtggctgaggggccgccaccgccagcagggaggcggagggctagcgagccaagcggtggggacgccgctgccttcctcttkgcctgtctcgccgccctcctagacacgctcctcatctacggatcctaccctccccgctcttgca

SEQ ID NO: 8608 - DNA, 162 bp, Homo sapiens
acgtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctcc

SEQ ID NO: 8609 - DNA, 372 bp, Homo sapiens
  misc_feature 269: m=a or c
tgactctaacttccctggctattgtttgaaactgttatgaccttcttgcttatcagcttgctggtttccttctcggggcgagctgggtgcctggagttttcggtaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgamtatttcatttgtttctaattgttactacagataatgctggggtgagcaactctgtgtacataggtttatctcctattggaatattttctttatataggcgttt

SEQ ID NO: 8610 - DNA, 159 bp, Homo sapiens
ctttctcccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgg

SEQ ID NO: 8611 - DNA, 423 bp, Homo sapiens
gattggatttaggtttcctttttattatttgttttctggttatttcttttttggggggtttcttctgtttcttttttctgcctatttttggattaactgaatattttttagtgttatgttttattaattggcttttggttatatctgtgctatgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaag

SEQ ID NO: 8612 - DNA, 185 bp, Homo sapiens
cctttttttaagtttcttgtatattcttgttattaatcccttgtcagatagattgtttgcaaatattttctcccactctgttagttgcttcttcacttcattgttgttgttgttttttcttttccaattcagaacaattttagcttaacataattcaatttgtctacatttgcttttcttgcctg

SEQ ID NO: 8613 - DNA, 280 bp, Homo sapiens
  misc_feature 104: n=a, g, c or t
  misc_feature 275: s=g or c
ttctttgggctcgggggctcccggagcagggcgagagctcgcgtcgccggaaaggaagacgggaagaaagggcaggcggctcggcgggcgtcttctccactccntgccgcgccccgtggctgcagggagccggcatggggcttctccagttgctagctttcagtttcttaggtaattccgtggaaacggtgcggggaggcggacggacttgggcatggggaaggaaaacccaaaagctgcttgctcaccttcgtgggatcctgggggcttgggasaggga

SEQ ID NO: 8614 - DNA, 183 bp, Homo sapiens
gctgctctcagggctgcgctcagcctcgtgttttcacttccttttcagagctgtatccgggtcgctgctttccctattgtctgaggcagccgccctcgcgctgtgcaatttctggtctttcgttgcttctggtccaggctaataaagtttttctttctttaattttttttcttctagttttaa

SEQ ID NO: 8615 - DNA, 163 bp, Homo sapiens
  misc_feature 160: w=a or t
aattttctcctcgcagctcgctgcctcctctatccctgcctccctctcccccctctgtttttctcccttccttccctctccgaccctcttcctctccctcccgatcctttccctcctcctctcatctttcccctgtctctccgttctagctcgtcccccwccc

SEQ ID NO: 8616 - DNA, 211 bp, Homo sapiens
aaagaaagatggcagtggcctgatccgggcccgttggcggcgtcactgacgcttcgctccggtcctcggatcccgagcgcggggaggcagaccgactgtgagctgcttgtccccatcctgcggccgtcctggggacacagagccctccgtggtgcccggggattggattggagccaggacctcacttcctcctctgcccctgcccctgccc

SEQ ID NO: 8617 - DNA, 140 bp, Homo sapiens
actcggagcgtctgctagggctgcagctctgcgcgtccatctctgcgctctgcgcagccttccccaccgggcccagcgagtttccacctgcagggccggtgctctcagcttttgttttctctggacaccttcttctctac

SEQ ID NO: 8618 - DNA, 197 bp, Homo sapiens
  misc_feature 117: s=g or c
aagtctcaggcttttctctctctcaatctctctctctctttcgggcggagtcgcccaccactgccagcccagcgctggggggacctgctccaggctgtagccgcaggaccccaccascccccatggctcccctggccttggtgggggtcacactcctcctggcggctcccccatgctccggggcagccaccccaacc

SEQ ID NO: 8619 - DNA, 189 bp, Homo sapiens
atgtctctcgccgtctccagcctcagtccctctctgtctctctctcagtctctctccctgtcctccccggccgctcctccgagatgacgccggggtcggtgccccgggcctgccctatcccctggctccagggctaggcgggaccgagggctgccccagacagacggacccgcggacccacagaccccg

SEQ ID NO: 8620 - DNA, 199 bp, Homo sapiens
atttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctga

SEQ ID NO: 8621 - DNA, 135 bp, Homo sapiens
ctatgaaagggggagttcaccttgttttactttctctctctctctcacgctctcgtttccttctaacttccaccatgagatggcacagcaagatggtcctcattagatgctggcaccttgatcttgaactaccca

SEQ ID NO: 8622 - DNA, 135 bp, Homo sapiens
  misc_feature 20: r=a or g
cttcttcctcttcttcctcrgcgtgtggctggtagcctatggcgtggccacggaggggctcctgaggccacgggacagtgacttcccaagtatcctgcgccgcgtcttctaccgtccctacctgcagatcttcgg

SEQ ID NO: 8623 - DNA, 326 bp, Homo sapiens
  misc_feature 7: k=g or t
  misc_feature 8: n=a, g, c or t
  misc_feature 9: m=a or c
  misc_feature 48: m=a or c
aagtgcknmcaactctctgaacttcggttcctcatctgccagttggcmgacgctcagcaaatcttcctagactcacggggcgaattgtacagttgggtaaatcgaggcccagagatggcaaaaggaccgtccaaggtcgtacagccacccggaattacaattcttttctgccgggtcacacgctgtcatccacgtgttacctaagagagctttccagcctgtgctaagaaaactgccccacatcatctgcagtaggacgggggagttggagccctggtcaggccactctgctactgaccacagttttctcatctctaaaaaggcgc

SEQ ID NO: 8624 - DNA, 329 bp, Homo sapiens
ttgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacttataacctccattgttcgagaccccaaactctgctcacatcttcctttccctatctctgcttgggctatgatcacggtgactctagcagcccttcatggacattatagtactctctgccattcacttttgctctaatctgacttcaacccccacttacttggtctctccttttacaacc

SEQ ID NO: 8625 - DNA, 152 bp, Homo sapiens
actttcccttttgcttacttcctagtcccgggcaggccggctcggaggcagcgagaaagcgcaccaggcggctgctcggcgttctctcaggtgactgctcggagttctcccaggtacgtcgtgcgctccccactcgtgtggtctctctgcac

SEQ ID NO: 8626 - DNA, 439 bp, Homo sapiens
  misc_feature 386: k=g or t
agtccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaktttaaagaggacatagactataggcattttaaagatgaagaaatgacaaggga

SEQ ID NO: 8627 - DNA, 209 bp, Homo sapiens
gcgagacttcaccgtctctgtcttttcctccttccagtgcccggcgttcctcccttccccctcgccgccgaccgagttcttccttttcagaccgggtcgccttgctgtcgtcgcggtgattttcctgctactgctactgctgctgctgccaccgccactaccactgggctcatttgccccgaccccttcccgccgccccgcccccagcc

SEQ ID NO: 8628 - DNA, 171 bp, Homo sapiens
  misc_feature 103: r=a or g
tttataaagggcgccgacgagtcggcattgtcaggcggcggcaccgcgcgggacggagcttggctgttggtcggtgggttcccgtgcggcggcggccaaggargaggagacacagttggagcagctccgtgggctgactggggcgaggcctcagcagcgcgagcttgagtg

SEQ ID NO: 8629 - DNA, 408 bp, Homo sapiens
  misc_feature 299: s=g or c
gcgtctgccaatgatccaggagccgctcctttccactcgggaaaccttcagaggagtctcagaaaggacacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatattctatgaatttcgttcttattaccttaagccctcaaagatgaatgagttcctggaaaattttgagaaaaacgctcatcttcggacagstcactctgaattggttggatactgtagaatttggaggcagaatgaatacagtgtttcatatttggaagtatgataattttgctcatcgaactgaagttcagaaagcctt

SEQ ID NO: 8630 - DNA, 171 bp, Homo sapiens
  misc_feature 12: n=a, g, c or t
agcgcgtgagtntcgctctgttttatgtgtgcttcccagtcctgtggtgctgctataccggggacgttgagtccccacagacctggaaattgcggcccctctttctcaacccagagcaaattgagacgtccgggctggagtgcaatggcgcgatcttggctcaccacaacc

SEQ ID NO: 8631 - DNA, 560 bp, Homo sapiens
tcgcgggaagctggcccaggtcaggtccgcaaaggcttctgaagaagaggaagggcgagtaggggcacctggacgctgatggtggccaggatgctcagctggccaggagggcagcacctgctggggacggtggccctgccttcatgcccaggacaccagctgggtccagctagcagccactgggaatcagaggaatggggcagagctgggcattcaggaccttgaggacaggtgaccccacccgcccaccgccactatcaggccccgggaccgcactgacaggaaaccttccgtcgtagggagcacttcccaggggccgcagggacgacactctccagggaggccccagcaaccacaccatcttcttgctgtgagaggtctcaccccgggctacctcctgtcactactcactgccctggggtccgtgggcaagttgcccagggtgggggtgcctagccaggtgcagtccccgccccgcctagtcctcggcgtcacgcaatgctcacctcgcctcttccccactaacatcccagactttaaaattcagtaaaccagatggc

SEQ ID NO: 8632 - DNA, 267 bp, Homo sapiens
agagtggcagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgcc

SEQ ID NO: 8633 - DNA, 455 bp, Homo sapiens
  misc_feature 162: n=a, g, c or t
actgcgccgagggccgccatcgctattgcggcattctccctcggctccggaggtaggggcaactcttctcttcctgtctgggaaaaagaccatagctcaaaaggaaggccgagggagaagttagaaagggatgatgaacgaagcgttttgaggggactgcancgccgcggcaatacccgcccctgagctgcgcgcactaccgcctcggtagctgtcatggccgccgggtcacgtgactccggcttggcgccgtcctggttttccgtcaccctggttctgtagtctcggttctccgactccctctttttctcgcttgtggactccgatatattgcccttcttcccttagaagaactgctgaaccgactctgagaaatttggtaagtatgtcagaggatgggtgtttctcagtaatatcccccgctacttccccggagtctcaagcaataggatcac

SEQ ID NO: 8634 - DNA, 132 bp, Homo sapiens
  misc_feature 42: y=c or t
  misc_feature 115: s=g or c
ggattgctttcagcactcgcagccgtggaccgccgtgcgtcytttcctctgcagtgagctgatttgctctgccagcagctgtcggtgccgcgctcgacaccgagtcctagctagscgctcacagaatacgcg

SEQ ID NO: 8635 - DNA, 222 bp, Homo sapiens
  misc_feature 22: s=g or c
  misc_feature 50: m=a or c
  misc_feature 163: y=c or t
  misc_feature 164: k=g or t
  misc_feature 193: s=g or c
agcagctttgcgcgggggcgasgaggtggaggagggcgaggaggtggagmagggcggggaggtgtagcgtggcgctcagtccgcctgctactcggtcccggcgctgggctgaggggaggggttgtcttaaaagtctctccttccccctgtaggggcggccggykagtcccagtgagagcggagggtgccagasgtagggggccgggaaacaaagttcccggg

SEQ ID NO: 8636 - DNA, 437 bp, Homo sapiens
  misc_feature 135: w=a or t
  misc_feature 139: m=a or c
  misc_feature 318: y=c or t
  misc_feature 370: s=g or c
ctttgtatcttcagtgttgaattgttttagctgatccatctttaacacaggagggatccttggctgaggattgtatttcagaaccaccaactgctcttgacaattgttaacccgctaggctcctttggttagagwagcmagtccttcagcctccaattggtgtcagtacttaggaagaccacagctagatggacaaacagcattgggaggccttagccctgctcctctcgattccatcctgtagagaacaggagtcaggagccgctggcaggagacagcatgtcacccaggactctgccggtgcagaatatgaacaaygccatgttcttgcagaaaacgcttagcctgagtttcataggaggtaattacscagacaactgcagaatgtagagcactgagcaggacaactgacctgtctccttcacatagtccatatc

SEQ ID NO: 8637 - DNA, 131 bp, Homo sapiens
tcagttctgcaagaaccagcttatccacgctctccgatctcgtgtctgtttctctttctctctccctctcttgcgctgtccctcattcatgcactcttccatgtgcttggctgaggagccaatggggcgaa

SEQ ID NO: 8638 - DNA, 186 bp, Homo sapiens
  misc_feature 116: n=a, g, c or t
  misc_feature 134: m=a or c
  misc_feature 154: r=a or g
ccgcctcttttgcagccagcgcgctaggatgccggggagtcttgggcgcgaggcttccggccgcgcggggccgacgggatgcggtgccttcgccttcggattgcgttgcagatggnagcctcacctctgtcacmaacccaagctgcgaatgcartggcgcgatctcggctcactgcaatctccacc

SEQ ID NO: 8639 - DNA, 216 bp, Homo sapiens
ttccttcccctccccatggcagcctgggtggagctcccagggagctgctgagctgctgaccaggcctggatcctacctttcctgctccccagttttcccctcctgccagtcctgccctagcccatctccctccaaacacctgaggcctgggtaggatcctggggctaggaggactcagcaggacaagatatgcagagagagactcatcctccacac

SEQ ID NO: 8640 - DNA, 345 bp, Homo sapiens
  misc_feature 73: n=a, g, c or t
  misc_feature 319: y=c or t
  misc_feature 320: k=g or t
  misc_feature 321: y=c or t
  misc_feature 336: k=g or t
  misc_feature 345: m=a or c
cctcccacctcagcctcgcaaatagctgggaccacaggtgcatgccaccatgccccgctaatttttgtatttnttttgtagagacagggttttgccatgttgtcgaggctggtctcaaattcctaggctcaagcgatcctcctgcctcagcctcccaaagtgctgggatgacaggtgtagccccgtgcctggcctggtcatttctcttgctgtgcccaacctgccattaatcccatccatcctgagcccgacgtggtcatttctctcaccacccagcctaccgcccgacgtggtcctttccctcaccacccagcctacykyccgacgtggtccttkcctcaccam

SEQ ID NO: 8641 - DNA, 194 bp, Homo sapiens
  misc_feature 7: n=a, g, c or t
  misc_feature 8: y=c or t
  misc_feature 13: s=g or c
  misc_feature 67: s=g or c
  misc_feature 132: w=a or t
  misc_feature 140: n=a, g, c or t
  misc_feature 143: m=a or c
  misc_feature 159: y=c or t
aggtgtnyccgcscctccccctcccgtgtcgctcgctttctgtcagcctctctccctctccctctascctctccttcctctcgcttcctctctcgcacctgagcgtacgcacctgcccgggcccggctcccwcctcctcnccmctccctctttccccgyccggccgcgggagcctcgtggctgcgtcaccgccg

SEQ ID NO: 8642 - DNA, 699 bp, Homo sapiens
actgctttcttcccccactttcatgtcccctctggattgtccagtgtaatgcatggcattgtggtgtctgtctaggaaggaaggggtgattgacaagagacaagtctggcccagttaatgctttctgcagtgggtctaaatggatctggactggaggagtctttcctttcctttctcccttcctctccagccaggtcctgtaagggccagcccagactacaggacatccacagaatattctggagcttgcaagtagacatagggtgagagttcttgcctcctttcatgagaaacagttctaagtcttcgatgccctgggagaatctggctctgagcatgtgggaaatgtcttggtttttatttttaatttaagagtcaggcctgggtcttttgaggtctgcagagtggggtttaggagagtagggtgggctctagctcttgcagggctcttagagagcagtcatgtcttttctcccatgactctcaggttctttgccaatcacagcaacttttcctgccaaagccagtatcctctggggctgtttagaagggcagttagattcaggagtcaccactgatgtttgagttgctcaaggcaagaggcagagaagagttcactaaaactgcttatttttgaataatttcagcacactgtccttaagaagaaagaaacatcaaaacaaaatagtttttacatga

SEQ ID NO: 8643 - DNA, 344 bp, Homo sapiens
  misc_feature 323: r=a or g
  misc_feature 325: n=a, g, c or t
  misc_feature 326: y=c or t
gagaggcttgattgagaacctacccgactatcagaggacctgtccgggaagagaaatggggctacgtccagacagaatctcgctctgttgcctgggctggagtgcagtggcactgtatccggaattggggggttcttggtctcactgacttcaagaatgaagccacggacccttgcgagatgggggttccaccatgttggcccggctggtctcgaactgctgacctcaagtgacctgcctgtctcagcctcacaaatggctgggattacaggcacgagacaccgtgcctggccctgggaacatgtttacatggactttgttcrcnyttttaaaacaaactgagg

SEQ ID NO: 8644 - DNA, 140 bp, Homo sapiens
  misc_feature 22: s=g or c
  misc_feature 24: m=a or c
cggatccttgctgcagcgtcasgmcgccgcccgtgcctttcctcttcctcctcctcctccttggcatccgcctcttcttcctcctgcgtcctcccccgctgcctccgctgctcccgacgcggagcccggagcccgcgccg

SEQ ID NO: 8645 - DNA, 526 bp, Homo sapiens
  misc_feature 326: k=g or t
  misc_feature 359: k=g or t
  misc_feature 360: k=g or t
  misc_feature 363: w=a or t
  misc_feature 372: k=g or t
ctctttgttaagatgtaatatttagccttttttttgttgtcttgtgttttgtctaacatgagaagaatatccaggacacttaacatttttacttaaactcatttccttcttattcgtatctgtattatgatggctatttaatgactccgatataaggtaaattatgttctaaatgaaataaagttaggaaagatctcatgtcaaaaatcatataattcgttaatgttttacttttttaaaaaataattgcattgttctctttactcttcccttccacccccacccaagtaattctgcattgattctaactttgaatttcattttgkataaagtgttttagttatttgtgtatatgcttkkctwtcttttctkttttttgagacagagtttcactcttgttgcccaggctggagtgcaatggcacagtctcaggctcactgcaacctctacctcccaagttcaagtgattttcctgcctcagcctcctgagtagctgggattacaggcgcacgcactgtgcccagct

SEQ ID NO: 8646 - DNA, 364 bp, Homo sapiens
  misc_feature 364: w=a or t
cctactgttaccaaaatgccaggggtttggtctaggtcctgctgctctccacaaggaaagccaatcactggctgggtgctgtggctcatgcttgtactcccagcactttgggaggctgaggcgggtggatcacttgaggtcagttcgagaccagcctgaccaagatggagaaactccatctctactaaaaatacaaaattagctgggcgtggtggtgcatgcctgtaatcccagctacttgggaggctgaggcaggagaatcgcttgaacccaggaggcagaggtgtggtgagccgagatagtgccattgcactccagcctgggcaacaagagcaaactctgtctcagaaaaaaaaaaaaaaaw

SEQ ID NO: 8647 - DNA, 193 bp, Homo sapiens
tctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcc

SEQ ID NO: 8648 - DNA, 454 bp, Homo sapiens
  misc_feature 219: n=a, g, c or t
  misc_feature 314: s=g or c
tacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggactnaaggcagcttgttctatgtatttatctttgctcttgggtgacttagggaatgattttatttgatttaaccttctttctgtttgccccgagaatastcgccagtggcgcttgcagttgtagcatttaccccaagataactttgcctacgaaatatttcgcttttattattttcacatcattctagtatatggactttggaaacaaaagacattgttctatttatagcattcttttt

SEQ ID NO: 8649 - DNA, 202 bp, Homo sapiens
agtagagatagggtttcaccatgttggccaggctagtctcgatctcctgacctcaggtgatccacccgcctcagcctcccaaagtgctgggattacaggcgtgagccactgcccccagctgaattgtaatctttcatttcctcactgtcatattataaaataatacctttaagaattttattcttcattccatttgacccca

SEQ ID NO: 8650 - DNA, 385 bp, Homo sapiens
  misc_feature 343: n=a, g, c or t
  misc_feature 351: w=a or t
  misc_feature 353: m=a or c
  misc_feature 360: n=a, g, c or t
  misc_feature 385: r=a or g
cccaaactcaccacctggccgtggacacctgtgtcagcatgtgggacctggttctctccatcgccttgtctgtggggtgcactggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagtaagtaggaccctgggatctggggagggaatggctgtgtcccacaggaataacagcgggatgcttcccccagggtcacttctcaggtgaggcttcagnctaaaggwgmgagggangtcctggcccaggtcgcacccggar

SEQ ID NO: 8651 - DNA, 449 bp, Homo sapiens
  misc_feature 165: k=g or t
  misc_feature 173: y=c or t
  misc_feature 382: r=a or g
  misc_feature 410: k=g or t
aagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaaggccaaatcgcgagcggggcggkgcgggcgygaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaraaactccaccccgcccccagggccagakaccagctccggagagcagagggggattccagccatttgg

SEQ ID NO: 8652 - DNA, 541 bp, Homo sapiens
ctctcgcgagagtgggtttgttcttgggctgcagccgctgccgccgcttctcgccagcgccgttgctgcgggggattgtgggagtctccgcgtcccgctcgctgggagagaggtacctctccttttccctctccctttccctaagagttgtctgctggttctcagcttgaagaagattctgcagtccttattgatcctttttcttggcgttaccatttttgaagcaaagttaacctagctttctagtttgagctttctttttggccgtctttaaaaaaatttttttttttaatctataaaatagacaagagctagttctacaatgtccaagtcattccagcagtcatctctcagtagggactcacagggtcatgggcgtgacctgtctgcggcaggaataggccttcttgctgctgctacccagtctttaagtatgccagcatctcttggaaggatgaaccagggtactggacgccttgctagtttaatgaatcttggaatgagttcttcattgaatcaacaaggagctcatagtgcactg

SEQ ID NO: 8653 - DNA, 335 bp, Homo sapiens
ggttctagcgattctctgcctcagcctcccaagtagctgggattataggcatgcagcccatgcctggctagtttttatttttagtaaagacagggtttgtccatcttggtcatgctggtctcaaactcccgacctcagatgatccgcccacagctgcctcctacattgttggaattacagacatgcccgtggctgcagagatagaaaaacctctggcccatttggataaaaacttgtacaaacctccagctcactcagataaaggaacaagaacgacctagcacagaaatgcctttgtttggccagccacggtggatcatgcctgtaattccaac

SEQ ID NO: 8654 - DNA, 455 bp, Homo sapiens
  misc_feature 434: r=a or g
atgacctcatataaatcccctcctgttctaattcactgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcrcagagacctgctgtcaacccc

SEQ ID NO: 8655 - DNA, 427 bp, Homo sapiens
  misc_feature 12: n=a, g, c or t
  misc_feature 39: n=a, g, c or t
  misc_feature 182: y=c or t
gaggccggaacnggcggactgcggcgcacttccgtagangtggacatggcgtgcggctttcgccgcgctattgcttgccaggtatggatcccggagcgcgcagaggagtccctgaggagctagggaccccaaaggcctttcaccgctgcgggccagtcctcagtcagctggagggtgggtcycacggaatcctgttagtttctaccacctcctcccccttctctggagctggtggagcttcagaagtcctgtggagcgtcggctgggatcagtttgtctcggtgaaaagtaaactttgaaagctttccagagtgttgaatcttccaccagaaaacttgatcacatcaatatctgcagttccaatttcccaaaaagaagaagtagctgattttcagctttctgtggattctttattggaaaaagacaa

SEQ ID NO: 8656 - DNA, 679 bp, Homo sapiens
  misc_feature 268: k=g or t
  misc_feature 408: n=a, g, c or t
  misc_feature 409: n=a, g, c or t
gtgaaaagcggcccgacctgcttggggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggaatgcggggkatgcttcggctcacacacatcacagacaatgtctgctggtcgtgcatgtatatttgatcacccctcttgaagctttcttcactttaatggtggcagtttcacaaggggagtacaattcaccatgagttgtcatggatttnnttgcataattcaagaaatgctctgtttatgtggtcggctgctttttttgtccgacatcttgacgaggctgcggtgtctgctgctattctccgagcttcgcaatgccgcctaaggacgacaagaagaagaaggatcgcttgagcctgggaggtggaggctgtgctgcgtgagccgtggtcgtcccactgcactccagcctgggcgacagagtaaaaccctgtctcaaaggaaaaaaaaaaaaattggtaactcgaaaacttgtaatgctcc

SEQ ID NO: 8657 - DNA, 689 bp, Homo sapiens
  misc_feature 127: w=a or t
  misc_feature 619: k=g or t
  misc_feature 627: r=a or g
  misc_feature 651: s=g or c
  misc_feature 652: n=a, g, c or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcacgtttctgagcagcgcttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagctgtggtctctgagagactgaagattcgaggctccctggccagggcagcccttcaggagctccttagtaaaggacttatcaaactggtttcaaagcacagagctcaagtaakttacaccrgaaataccaagggtggagatgctsnagctgctggtgaagatgcatgaataggtccaaccacc

SEQ ID NO: 8658 - DNA, 577 bp, Homo sapiens
  misc_feature 127: w=a or t
ctcctcctcctcctcccgcgccctccgtgcagccacctgctgcacttgcgcactgggagcgacacgctcgggataagtagtgccggaaagttagctgccgagacctggtggattgcttttcgtttawcagtgcaaggaaaacagcgctatagtactgcgtcacaactagcgcagactccggcagtatttaggcggtgcggcttgggaactagaatccgcttcctgtcttccgcctcaggctagagggcgagcgcttcgccgtgggacttcctctgcctggctccgcctcttgccccggaagtactcacagcggacggtggtttttgggcacgtttctgagcagcgcttcctttttgtccgacatcttgacgaggctgcggtgtctgctgctattctccgagcttcgcaatgccgcctaaggacgacaagaagaagaaggatcgcttgagcctgggaggtggaggctgtgctgcgtgagccgtggtcgtcccactgcactccagcctgggcgacagagtaaaaccctgtctcaaaggaaaaaaaaaaaaattggtaactcgaaaacttgtaatgctcc

SEQ ID NO: 8659 - DNA, 445 bp, Homo sapiens
gtgaaaagcggcccgacctgcttggggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggaataagctattcagttggatggattaaatgcatcacaaataagagaacttagagagaagtcggaaaagtttgccttccaagccgaagttaacagaatgatgaaacttatcatcaattcattgtataaaaataaagagattttcctgagagaa

SEQ ID NO: 8660 - DNA, 447 bp, Homo sapiens
  misc_feature 295: r=a or g
  misc_feature 296: m=a or c
  misc_feature 297: n=a, g, c or t
  misc_feature 298: r=a or g
gtgaaaagcggcccgacctgcttggggtgtagtgggcggaccgcgcggctggaggtgtgaggatccgaacccaggggtggggggtggaggcggctcctgcgatcgaaggggacttgagactcaccggccgcacgccatgagggccctgtgggtgctgggcctctgctgcgtcctgctgaccttcgggtcggtcagagctgacgatgaagttgatgtggatggtacagtagaagaggatctgggtaaaagtagagaaggatcaaggacggatgatgaagtagtacagagagaggarmnrggctattcagttggatggattaaatgcatcacaaataagagaacttagagagaagtcggaaaagtttgccttcgaagccgtaagtgtggcaaatatgataggtggtgcttctgtggaaccacaggctttaatccctgcggctataggct

SEQ ID NO: 8661 - DNA, 502 bp, Homo sapiens
  misc_feature 76: y=c or t
  misc_feature 98: r=a or g
  misc_feature 133: n=a, g, c or t
  misc_feature 137: y=c or t
  misc_feature 154: y=c or t
  misc_feature 178: r=a or g
  misc_feature 196: r=a or g
  misc_feature 197: m=a or c
  misc_feature 231: m=a or c
  misc_feature 232: m=a or c
  misc_feature 244: m=a or c
  misc_feature 319: m=a or c
  misc_feature 361: k=g or t
  misc_feature 362: k=g or t
  misc_feature 406: s=g or c
agaactgagagaggaggggacagagaggtgtcctgggcctgaccccgcccatgagcctgagaagtgctcctgcccygggaagaggctcagcacagaargaggaaggacagcacagctgacagccgtgctcagngagyttctggatcctaggctyatctccacagaggagaacacacargcagcagagaccatgggrmccctctcagcccctccctgcacacagcgcatcammtggaaggggctmctgctcacagcatcacttttaaacttctggaacctgcccaccactgcccaagtcacgattgaagcccagccaccmaaagtttccgaggggaaggatgttcttctacttgtccacaakktgccccagaatcttactggctacatctggtacaaagggcaaatsagggacctctaccattacattacatcatatgtagtagacggtcaaaataattatatatgggcctgcatatagtggacgagaaacagcatattccaa

SEQ ID NO: 8662 - DNA, 394 bp, Homo sapiens
  misc_feature 109: s=g or c
atacttccatcatctccatacttgctgggagattgagtaattggtgtctggatgtgcgtgtgctgcttcccaaaatacctctttaaaaagacgtgagagggatgcggascagtagaaatgactgattttgaagattgagaattaggaatattgtacagatgctgtcattcctacatgaaggaggcagaagaatgtagcaagctcagctctctaatgccaggagtggcactttcagtgaccagagctccctgggtcctctgtgtatccctcccctgtcaactgattcaacagaggctgggctggtcctggcattagcacatttttgaatctgcctttggctgtgacttcacccaaagacagaaaggggaagtttctggtctaaatagccaacatg

SEQ ID NO: 8663 - DNA, 1337 bp, Homo sapiens
  misc_feature 248: w=a or t
  misc_feature 252: n=a, g, c or t
  misc_feature 253: n=a, g, c or t
  misc_feature 254: n=a, g, c or t
  misc_feature 261: n=a, g, c or t
  misc_feature 335: n=a, g, c or t
  misc_feature 422: k=g or t
  misc_feature 433: k=g or t
  misc_feature 438: s=g or c
aaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggwggcnnngttcttnggctgtggacatgaagccctcactggcacagaaaagctaattgagacctatttctccaaaaaaaaacccccccntaccaagactatgagtatctcatcaatgtgatccatgccttccagtaatgtcatctatggaactgcctctttcttcttcctttttakggggttgctgkcaatsagaaagcccttttcattgcaggagaagaggacaaagatactcagagagaaaaagtaaaagaccgaagaaggaggctggagagaccaggatccttccagctgaacaaagtcagccacaaagcagactagccagccggctacaattggagtcagagtcccaaagacatgggcttgttagagtgctgtgcaagatgtctggtaggggccccctttgcttccctggtggccactggattgtgtttctttggggtggcactgttctgtggctgtggacatgaagccctcactggcacagaaaagctaattgagacctatttctccaaaaactaccaagactatgagtatctcatcaatgtgatccatgccttccagtatgtcatctatggaactgcctctttcttcttcctttatggggccctcctgctggctgagggcttctacaccaccggcgcagtcaggcagatctttggcgactacaagaccaccatctgcggcaagggcctgagcgcaacgtttgtgggcatcacctatgcctgaccgttgtgtggctcctggtgtttgcctgctctgctgtgcctgtgtacatttacttcaacacctggaccacctgccagtctattgccttccccagcaagacctctgccagtataggcagtctctgtgctgatgccagaatgtatggtgttctcccatggaatgctttccctggcaaggtttgtggctccaaccttctgtccatctgcaaaacagctgagttccaaatgaccttccacctgtttattgctgcatttgtgggggctgcagctacactggtttccctgctcaccttcatgattgctgccacttacaactttgccgtccttaaactcatgggccgaggcaccaagttctgatcccccg

SEQ ID NO: 8664 - DNA, 1003 bp, Homo sapiens
ttggggcagggcagatttatatctgcgggggatcagctgacgctccgcattgcagactgcggagtcagacggcgctatgtacgccctcttcctcctggccagcctcctgggcgcggctctagccggcccggtccttggactgaaagaatgcaccaggggctcggcagtgtggtgccagaatgtgaagacggcgtccgactgcggggcagtgaagcactgcctgcagaccgtttggaacaagccaacagtgaaatcccttccctgcgacatatgcaaagacgttgtcaccgcagctggtgatatgctgaaggacaatgccactgaggaggagatccttgtttacttggagaagacctgtgactggcttccgaaaccgaacatgtctgcttcatgcaaggagatagtggactcctacctccctgtcatcctggacatcattaaaggagaaatgagccgtcctggggaggtgtgctctgctctcaacctctgcgagtctctccagaagcacctagcagagctgaatcaccagaagcagctggagtccaataagatcccagagctggacatgactgaggtggtggcccccttcatggccaacatccctctcctcctctaccctcaggacgcccccgcagcaagccccagccaaaggataatggggacgtttgccaggactgcattcagatggtgactgacatccagactgctgtacggaccaactccacctttgtccaggccttggtggaacatgtcaaggaggagtgtgaccgcctgggccctggcatggccgacatatgcaagaactatatcagccagtattctgaaattgctatccagatgatgatgcacatgcaacccaaggagatctgtgcgctggttgggttctgtgatgaggtgaaagagatgcccatgcagactctggtccccgccaaagtggcctccaagaatgtcatccctgccctggaactggtggagcccattaagaagcacgaggtcccagcaa

SEQ ID NO: 8665 - DNA, 888 bp, Homo sapiens
  misc_feature 12: s=g or c
  misc_feature 251: r=a or g
  misc_feature 413: r=a or g
  misc_feature 821: s=g or c
  misc_feature 848: s=g or c
  misc_feature 852: k=g or t
  misc_feature 869: s=g or c
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccasgagttctgggataacctggaaaaggasacakagggcctgaggcaggasatgagcaaggatctggagg

SEQ ID NO: 8666 - DNA, 808 bp, Homo sapiens
  misc_feature 171: r=a or g
  misc_feature 333: r=a or g
  misc_feature 741: s=g or c
  misc_feature 768: s=g or c
  misc_feature 772: k=g or t
  misc_feature 789: s=g or c
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccasgagttctgggataacctggaaaaggasacakagggcctgaggcaggasatgagcaaggatctggagg

SEQ ID NO: 8667 - DNA, 807 bp, Homo sapiens
  misc_feature 12: s=g or c
  misc_feature 251: r=a or g
  misc_feature 413: r=a or g
  misc_feature 691: w=a or t
  misc_feature 705: w=a or t
  misc_feature 712: k=g or t
  misc_feature 740: s=g or c
  misc_feature 767: s=g or c
  misc_feature 771: k=g or t
  misc_feature 788: s=g or c
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcgwgacctccaccttcwgcaagckgcgcgaacagctcggccctgtgacccasgagttctgggataacctggaaaaggasacakagggcctgaggcaggasatgagcaaggatctggagg

SEQ ID NO: 8668 - DNA, 732 bp, Homo sapiens
  misc_feature 12: s=g or c
  misc_feature 251: r=a or g
  misc_feature 413: r=a or g
  misc_feature 516: s=g or c
  misc_feature 635: k=g or t
  misc_feature 665: s=g or c
  misc_feature 692: s=g or c
  misc_feature 696: k=g or t
  misc_feature 713: s=g or c
aagtgctggcasgattgtgtcacagacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgasaaggaggtcccccacggcccttcaggatgaaagctgcgcgtgctgaccttggccgtgctcttcctgacggcctaaagctccttgacaactgggacagcgtgacctccaccttcagcaakctgcgcgaacagctcggccctgtgacccasgagttctgggataacctggaaaaggasacakagggcctgaggcaggasatgagcaaggatctggagg

SEQ ID NO: 8669 - DNA, 727 bp, Homo sapiens
  misc_feature 171: r=a or g
  misc_feature 333: r=a or g
  misc_feature 611: w=a or t
  misc_feature 625: w=a or t
  misc_feature 632: k=g or t
  misc_feature 660: s=g or c
  misc_feature 687: s=g or c
  misc_feature 691: k=g or t
  misc_feature 708: s=g or c
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctrtaacaccacctacctcccgtgagagtgaacgagtgttgagaacaaagtgtgaggtgtgagtgtaagaacgagtgagaagtgagtgtgaacaagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcgwgacctccaccttcwgcaagckgcgcgaacagctcggccctgtgacccasgagttctgggataacctggaaaaggasacakagggcctgaggcaggasatgagcaaggatctggagg

SEQ ID NO: 8670 - DNA, 675 bp, Homo sapiens
acatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagcctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaac

SEQ ID NO: 8671 - DNA, 663 bp, Homo sapiens
aagacagggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 8672 - DNA, 653 bp, Homo sapiens
  misc_feature 441: w=a or t
  misc_feature 442: k=g or t
  misc_feature 591: n=a, g, c or t
  misc_feature 592: n=a, g, c or t
  misc_feature 593: k=g or t
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtgataggactgaggctttcagtgcatactggcaaccttggaaggcaggaatgtgaaacttttccctactacttagcatcagaattgaatgggagaccgcattctgccatttctggcggcagtgtggctctgccagctggccttctgcacggatcccctaacaacagtgagagagcaatgcgagcagttggagaaatgtgtaaaggcccgggagcggctagagctctgtgatgagcgtgtatcctcwkgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaataannkccttatggttttggatgtaccatttgtttcttatttgtgtaactgtaagttcacatgaac

SEQ ID NO: 8673 - DNA, 618 bp, Homo sapiens
  misc_feature 7: n=a, g, c or t
gactagncgggagaccagagatctagcgactgaagcagcatggccaagccgtgtggggtgcgcctgagcggggaagcccgcaaacaggtggaggtcttcaggcagaatcttttccaggagtcctttcattttcaggtcttcagtttcctcatttgcaagtcttggacccagtgatttccaaaggcccttccagttccatttgtcagacatctcattgagcatattctgtgattcccctcccttgcaatgtaacccacaggctgaggaattcctctacagattcttgccacagaaaatcatatacctgaatcagctcttgcaagaggactccctcaatgtggctgacttgacttccctccgggccccactggacatccccatcccagaccctccacccaaggatgatgagatggaaacagataagcaggagaagaaagaagtccctaagtgtggatttctccctgggaatgagaaagtcctgtccctgcttgccctggttaagccagaagtctggactctcaaagagaaatgcattctggtgattacatggatccaacacctgatccccaagattgaagatggaaatgattttggggtagcaatccaggagaaggtgct

SEQ ID NO: 8674 - DNA, 610 bp, Homo sapiens
  misc_feature 547: k=g or t
aaaagctgacgacttcggtctgcgccgggagtgcatgagctgccgatgtggtgcttagtgattgcggtttcggtcgctctcccgtgtttcccgggctgggtatttgcctcgcaccatggcggtttctgcactacggggacctggctgagttgcggatggagctctatagctcaccaggctggtggggagaatgaggaggaccgtggcctcctgacggcatctcatcattcctctgcagcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtkatcctactgacagccatcgtgcaggtgctcagctgcttctctctctatgtctggtccttctgg

SEQ ID NO: 8675 - DNA, 597 bp, Homo sapiens
  misc_feature 390: n=a, g, c or t
  misc_feature 522: w=a or t
acttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggnttagattcttcgacgaggagtcctacagcctcctcaggaaggctcagaggaataacgaggacatttccatcatcccgcctctgtttacagtcagcgtggaccatcggggcacttggaacgggccctgggtgwccactgaggtgctggctgcggcgatcggccttgtgatctactacttggccttcagtgcgaagagccacatccagg

SEQ ID NO: 8676 - DNA, 159 bp, Homo sapiens
agggctgcgcggcgcaggaaaatggcggcttccaggtgggcgcgcaaggccgtggtcctgctttgtgcctctgacctgctgctgctgctgctactgctaccaccgcctgggtcctgcgcggccgaagtcgcccgggacgcccgacgagtctaccccacc

SEQ ID NO: 8677 - DNA, 154 bp, Homo sapiens
caatttggaaattcctaagtaggatgagagttagtaactggatacgagtgaagtttatatccaagttcagactcaaaggcattattatgatttgcttcttcccatgtcttccatgtcctgcttctcaaagtttttctcatccatcacactccct

SEQ ID NO: 8678 - DNA, 152 bp, Homo sapiens
tccttcttattcatccttgagtttgcaaaaacagaaacatcatttgtttttattgctgaatagtattccggcgtactcgctgacttcaggacgacttgggcctgcagaggtcgccaggaggcccaagctgggcgcggaggagcccaccgacc

SEQ ID NO: 8679 - DNA, 134 bp, Homo sapiens
gtaggactgtttactcgttttcttaagctgctgggtgctttgctgctcctggctctggccctctttttgggctttctacagttgggatggcggtttctggtgggactaggtgaccggttaggctggaggctaat

SEQ ID NO: 8680 - DNA, 207 bp, Homo sapiens
ctcaataccgcaccccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactga

SEQ ID NO: 8681 - DNA, 169 bp, Homo sapiens
acagatgcaccccagctgtcactccccgctccactctggctcgctgctcgcgcacacgcgtgcgctctcctccctcgcccctttcttccctctctcctctctctctctccctccatccctctctttccttctcagtttgtgactgacccagcagccccgtcccccggct

SEQ ID NO: 8682 - DNA, 192 bp, Homo sapiens
caggacctcattcacgtatttatttacacaactgcatttcattcagtgctgatgaatctggaatggcatgagttaagttattgtgattcattaatagctggagtggtgctcattttcctagtgcttgcaaacgttaactgataaatccatgtgaacacttattatcagtattttgcagatgacaaactgagg

SEQ ID NO: 8683 - DNA, 255 bp, Homo sapiens
atcttgcgggagaccgggttgggctgtgacgctgctgcgacaactggtctcaatctcctggcctcaagtaatccacctgcctcagccacccaaagtgctgggatttcaggcgtgagtcaccgcacccagcctagacacattataaaaatattaaatgcaaggctgggcgtggtggctcacacccgcaatcccagcactctggaaggccaaggcaggtggatcgcttgaggtcagttcaagaacagcctttggccc

SEQ ID NO: 8684 - DNA, 322 bp, Homo sapiens
  misc_feature 236: r=a or g
tgtagaaaaaagtcttagaaaactaatagttttatggtttatatttcattttaatctgaaactttattaaacttgataaagaggtgcaaaattcctggtgtcttatgccaaggaatccggtcttcactagaaggatgtatttttgtttgtttgtttgtttgtttgtttgttttgagatgcagtctcgctctgtcacccagtctggagtgcagtggtgcggtctcggctcactgcarcctctgcctcccaggttcgggtgattctcgtgcctcggccttccagatggctgggattgtgggcacgcaccaccacgcctggctga

SEQ ID NO: 8685 - DNA, 260 bp, Homo sapiens
tctgacagctacttcctggcgacaaggaacgacaacattcccaatgccgtctgggtctgggacattcagaagctgaggctgttcgcggtgctcgagcagctgtccccagtgcgcgcgtttcagtgggacccgcagcagccgcggctggccatctgcacgggaggggttcagttcgcattactggttatttttgttttaatagttgtgaaagtacttacagtagtggttcacagtaggtggtaggtaagtgttggctatac

SEQ ID NO: 8686 - DNA, 219 bp, Homo sapiens
cacttactttctagataatgggtaactctttgtttaactgggaattaccagaaggttttccaaagccgtttcccttctcacccacagtgtatgagggttccaatttctttgcatgcttcccagtacttgttcttctgtgcttctcattatggtcatcctactgagtgtgaagtgctaactcattgtgatttttcttttttcgttttttttcagacggag

SEQ ID NO: 8687 - DNA, 199 bp, Homo sapiens
aaaggaatttctaggaaatgcagccaaaggtgcagtcagaaaagatgcaggggtggtgtcgcggcccagtgcggtggctcatccctgtaatcctagcactttgggaggctgaggcgggcggatcacgaggtcagaagatcgagaccatcctgactagcgtggtgaaaccccgtctctactaaaaatgcaaagattggct

SEQ ID NO: 8688 - DNA, 162 bp, Homo sapiens
  misc_feature 84: s=g or c
aactcttcagagtcgcgtcgctcctcatccgcccttctacaccccaaactctggacaccagcggggtgggtgaggaagcctgtsagacacattcttgtgccctgatttctttcaagcaacattgtgattttaagactcataactagttcacatccaagcatt

SEQ ID NO: 8689 - DNA, 296 bp, Homo sapiens
ctggtggagtatggcaccttgcattattttgtcagcaaccggaaaccaagcaaggacaaagataaaaagaagaaaaaccctcttcttcggatgttttccttcaaggccccccgcaccgtcccgtccctcagcaggccctggtgcacctgcccaattgaggcagcggcaaagggcacctcctccaaggaggccaccttggcctgccagtccctgccgagctcctcttcaagaactctcagcatctgccagcggggcatgaagtcggcgctctggcgcggtgaagagacatgagaggt

SEQ ID NO: 8690 - DNA, 200 bp, Homo sapiens
ctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttctcaccccagct

SEQ ID NO: 8691 - DNA, 285 bp, Homo sapiens
atttggaatctaggatgggcctaaggtatctaggtttgaaaatcaccactttagagtactagaatggaatcctaaacaatctcagatttaagaatgtggtttacagatgagcctgaatgcatctgtgttcttgccagggtcctgttgttcctctgtacagtctgccatctagtggtaggaatgcagagtttaccagaatgccaacggaaagctctaggtttacactttcttatattaagaaggcttacgtagtaatttaaaacattttgataatcagaagagggg

SEQ ID NO: 8692 - DNA, 305 bp, Homo sapiens
agtctgggtgttgagttccgggaccggagttcccgggccttttggcttctgtagtctgtacctttttaagcagtggaagtgcctgggtggattctccaatgctttattgttttcttgttacaattatttattttacttcccgtgatgtttcagcctcatcccttcaccatttgttgttgttgttgtttttgagacggagtctcgcactgttgtccaggctggagtgcagtggcgtgatctcggcccaccgcaacctccgtctcccgggttaaagcgattgtcgtgcctcagcctcccgactgctt

SEQ ID NO: 8693 - DNA, 216 bp, Homo sapiens
ttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccacccaa

SEQ ID NO: 8694 - DNA, 244 bp, Homo sapiens
  misc_feature 87: s=g or c
  misc_feature 122: v=a or c or g
atctccccccaccaactctctgtctctctctgatgctctctctttctctccccctcaactctctctatctctctctgactctctgtstctgtctctctctcttcccttaccaactctctgtvtctctctcccccaccgactctctcgtctctctctgactctctctctctcccccgaccaactgcctctgtctgcctctctctatcactttctctctctctctctctccctcaccaccccaccc

SEQ ID NO: 8695 - DNA, 461 bp, Homo sapiens
  misc_feature 404: m=a or c
gtttgttttctggaatggtaggtgctgggaggaggagtttgatggagggcttcctggctgcttctggccctcacctcgtggaggccttcacagagaccctgtgggccctggccctgtgctggcactgtgccagtcatgaggcagctctgatcacttccccactgtggaaacaggactgacccagccttcagcgtgggctgctgaagctatcctcctcaggcctcagggatgacctcctgcctgagcctctcacaggctggctgtgggccagtttcatctgctttcctgttgggggtcccgggcctctgctgtccttgacccactggtgttctgtgcaaggcttcttcccattcaccaagtgcacaccttgcatctgccgctcggcatgcaccagttccacacamcatcccattttacagacaaggacgctgaggcctgcagcagcagtgtgacttgctcaa

SEQ ID NO: 8696 - DNA, 331 bp, Homo sapiens
  misc_feature 21: w=a or t
  misc_feature 56: n=a, g, c or t
  misc_feature 100: s=g or c
  misc_feature 108: k=g or t
  misc_feature 109: k=g or t
  misc_feature 116: y=c or t
  misc_feature 127: k=g or t
  misc_feature 129: k=g or t
  misc_feature 141: k=g or t
  misc_feature 202: k=g or t
  misc_feature 203: r=a or g
agatatacccattttctctcwcaggatagcaggatttgggggttccacattgaaanggagttcaggggaggaggcagggtggctcttgtcgccccccgcsccaagcckktctctcyatgctggttcktkcagcgaattaakggagctctggggcctctttagcccctaaggagtctctggctgttgcctgatcctgaacctkractctttcccctctggcccagtgggcactgctctgggcacatcaggcgctgtcctctgcacagtccagtgcccactgaggaaggcagggcctggcgtcctgggagcagtgaagtccgtggaaagggaa

SEQ ID NO: 8697 - DNA, 393 bp, Homo sapiens
  misc_feature 390: y=c or t
ccctgtagttttgccttttccagaatgtcatatcaatggaatagtacagtctgaagcctttgaatctggcttctttcattcaatataatgggtgaggagtcaaccacgttgttgcatgttatccacatttcctccttttgtgtctctgagtagtattctcttgcatagatgtaccacagtttgtttatccattcaccagctgaaggacagtgctccagggtcctagagcacagaactctggctttgttgtctttatttctaccagttgtctctctctctgtctctctctctctcttttttttttaaaccctagaagattattaagatttataagactgggtatggtggctcatgccagtaatcccaatgctttgggattacacgcatgtycca

SEQ ID NO: 8698 - DNA, 284 bp, Homo sapiens
  misc_feature 242: m=a or c
tccccaggtcctcggtctggtctggtctggtctggttggcaccacctctgcactcccaggcagaactaactttcccttcctgctgcccttgttcctctactctccagtcctggcctctcatgcctacacacaattttttttttcttttattttgggatggagtcttgctgtgtcactcaggctggcgccatctcagctcactgcaacctccgtctcccaggttcaagcgattcttgtgcctmagcctcccaagtagctgggattacaggtgcccgccccctaaa

SEQ ID NO: 8699 - DNA, 389 bp, Homo sapiens
ccctgtagttttgccttttccagaatgtcatatcaatggaatagtacagtctgaagcctttgaatctggcttctttcattcaatataatgggtgaggagtcaaccacgttgttgcatgttatccacatttcctccttttgtgtctctgagtagtattctcttgcatagatgtaccacagtttgtttatccattcaccagctgaaggacagtgctccagggtcctagagcacagaactctggctttgttgtctttatttctaccagttgtctctctctctgtctctctctctctcttttttttttaaaccctagaagattattaagatttataagactgggtatggtggctcatgccagtaatcccaatgctttgggattacacgcatgt

SEQ ID NO: 8700 - DNA, 160 bp, Homo sapiens
aaaggcccggcccaagggaacgttcagggcgtctcggctctccccgctgctgcttctgctaggcccagtgcgagaccagagcacgagcgactcccgtcgtccccggccaggcagatgttggcctagtcctggcgcgaacgaagcgcgctatttccctgct

SEQ ID NO: 8701 - DNA, 221 bp, Homo sapiens
agaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgta

SEQ ID NO: 8702 - DNA, 301 bp, Homo sapiens
catgccagtgtgcctggctaattgtttgtatttttagtggagatgggtttcaccatgttggccagcctggtctccgactcctgacctcaggtgatccgcctgccttggcctcccagagtgctgggattacaggggtgagccaccacttccagctcctttacactcttaaaaattaaggatcccaaagagtttttgtctctgtgggttatatctatatcaatacttacaatgttaggaattaaacctgataatttaaaaatattgattgattgattgatttaaaatagctataaacccgcgc

SEQ ID NO: 8703 - DNA, 439 bp, Homo sapiens
  misc_feature 57: k=g or t
  misc_feature 432: w=a or t
ttattccattcccacccgctttgatgtctatgcttggctctctgggctgcccctggkactgccgaatcctacacatctcttatcagctttcctcaaactttaaggaggctctgtgaggggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaatggaacactttcgtgcacagaagtcagccgcaatccaggcacaggacgaagatgggawcacgtgc

SEQ ID NO: 8704 - DNA, 453 bp, Homo sapiens
  misc_feature 12: k=g or t
agatttcctcgkctgtaaacattaagtatctacattcactaaaagtagttctgaatgaatgttatttaatggtgccaatgatgttggaggatacctgtgcatctcatgctgtggttacagcatcaattgtgatgaatataggatactgagtccctcctagaaatgacttcaggaacttcaccccccaactccacaatctgggaatggcagacagattcagcaccaggagaacatcacataaaggacaagtgtgtatgtttaaaaatggcaagtttcggcctggcatggtggctcacgtctataatcccagcagtttgggaggctgaggtaggtgaatcacgaagtcagaaggtcgagacaatcctgaccaacatggtgaaaccttgtctctactaaaaatacaaaaattagctgggtgtggtggcgcacacctgtaatcccagctactcggga

SEQ ID NO: 8705 - DNA, 358 bp, Homo sapiens
  misc_feature 12: k=g or t
  misc_feature 291: s=g or c
  misc_feature 307: r=a or g
tcatcaacctakgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcactgggaggtggtgagggacaccgtctcacacacacagggaggcaagagctgccccccagsccacctgacagcagartgtgcaggacgcaggcggccccactctgatgggcaggaccctgacccatct

SEQ ID NO: 8706 - DNA, 380 bp, Homo sapiens
  misc_feature 154: r=a or g
  misc_feature 168: k=g or t
  misc_feature 259: d=a or g or t
  misc_feature 323: d=a or g or t
  misc_feature 335: n=a, g, c or t
  misc_feature 355: k=g or t
cctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattrtgccattccaaagkgcatcagaactgtcattcccttctaatatcttctcaggagtaatacaaatcaggtatttcatcatcatttggtaatatgaaaactccagtdaactcccaaggacatttacaacatttatattcacacgctgtatggaagggtgtgggtgtgtgtdaaggggcgagtngagacactgtgtgtatctckagataagaagatatgcaccacgtcg

SEQ ID NO: 8707 - DNA, 354 bp, Homo sapiens
  misc_feature 138: s=g or c
  misc_feature 139: s=g or c
  misc_feature 152: r=a or g
  misc_feature 153: r=a or g
  misc_feature 236: k=g or t
  misc_feature 349: s=g or c
actcatttataccaggaaacagacaagagaacaagaggctgccgaagacaaaacttctctgcaagcacctgtgcacagcaatgtgcgtgggcatctgtgagaagaagagaatctgtgaagtttgagcaagcggccttsscaagatgtaccgrrtatctcaactgatgtcaacaccagtagcaagttcttccaggttggaaagagaatatgctggagagctgtctcccacgtgcatkttcccaagtttcacctgtgattccctggatggttaccattcttttgaatgcggctccatagatcccctgacaggctcccactatacctgtcgccgaagtcccagactccccascaaag

SEQ ID NO: 8708 - DNA, 188 bp, Homo sapiens
  misc_feature 175: k=g or t
aaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgkattctgcctccga

SEQ ID NO: 8709 - DNA, 358 bp, Homo sapiens
tgatgaagaaacagaagggttaaggaacttgcccatggacacacagccaatgacagagctagggtctgaacaggtgtggctataaagcctgggctttggcccgtgggccatatctttacagactcacaaccatcccttcctgctgctcgaattttcattcttgaggcatgagcagcgcctgcagcccctgctgggatgttttgctcaaacctgctgagacttccaagggagcctgggactctgctctcctactcctttcctcccttgtgtttgggcactcggctgagctccttggaaagatttctgcttcctgtgggtgagaagtagggcagtgtgaggaggcagggctgctaggcta

SEQ ID NO: 8710 - DNA, 296 bp, Homo sapiens
accaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagt

SEQ ID NO: 8711 - DNA, 142 bp, Homo sapiens
  misc_feature 70: r=a or g
  misc_feature 110: r=a or g
accttcacagtgtgagatgcctagtgtgaacagtgctggattatgtgtcttgcagttgacaacggcagtraccagtgcctttttactagcaaaagtgaatcctttcgaarcttttctctcaaggggcttttggctatgtgct

SEQ ID NO: 8712 - DNA, 271 bp, Homo sapiens
  misc_feature 21: m=a or c
  misc_feature 22: w=a or t
gagactgccggggctgctgcmwgctgcttctcgcgcctgtcctctccaagatgcagttttttgatgctgaggagctcctggtcgatgaagaggatgatgtttttggtgaaggtaaatgcatctttctggcaggaggctctccggtctgctttgctttgttttgacaccactggacacttttgcccagcttgggcaaggacttgagtattttgaaatgataaaaacaaagcatcctgagtgaggtagtggctgcaaatatcaacttaggcac

SEQ ID NO: 8713 - DNA, 174 bp, Homo sapiens
aaagctttggagatattgaatcatgttaccatttctgtttttttccaccctgttttcttccatatttactgaagctcagaagcagtattgggtctgcaactcatccgatgcaagtattcatacacctactgtgataaaatgcaatacccaatttcaattaatgttaacccctgg

SEQ ID NO: 8714 - DNA, 440 bp, Homo sapiens
  misc_feature 13: y=c or t
  misc_feature 14: w=a or t
  misc_feature 43: k=g or t
  misc_feature 44: s=g or c
  misc_feature 362: r=a or g
  misc_feature 394: s=g or c
  misc_feature 395: s=g or c
  misc_feature 402: s=g or c
  misc_feature 412: s=g or c
  misc_feature 438: y=c or t
cccacatcacctywccctgggaactggacagggtgaaagtccksaaactctgggaacaggcgagatggaacagggatttaactccccgcccacaggtccatgggagcttgaggcagtaagggggatcccaggcacccatctcaaggagtggctgggagtcttttccctaacttgtggggataccaccagttgtcaagctactaggcagtagggtctgagggctcaggcctccacctgagaggttataacctgagagacagctctacccttcctcccagtaagaagggaaggtgggtgggcacctgagagattaagactattctcccagtcccactaccagcacccccgatccctgagactgrggggtttacgggctgtgaatggaccttcagcsstgcccascctccctccscactgctgctgagtctgtctgatgtytt

SEQ ID NO: 8715 - DNA, 175 bp, Homo sapiens
actcctgacctcaaatgatctgcccgcctcggcctcccaaagtgctgggattacaggcataagccaccacgcccagcctaccctgtacattttaatgtgcatagttaattgtatctttactctcctgctgaactatgcagggaccttagcccactttattctaatccaaccctta

SEQ ID NO: 8716 - DNA, 341 bp, Homo sapiens
  misc_feature 12: y=c or t
  misc_feature 13: s=g or c
cacagatgcccysggactttaggaggcagcagaggttaagaacacgtgagcaggaggcctggaactcaggttctcagggaacctcttgagtagacgaccccgcagtgacatgcagaggccgtcaagttgcttcatcgtggttcttgccgaggcccagggagcgtggggagggctgggcctgcctggaccttgcaggaaggcctttcacgtgctgcttcgcctctttatgctttatctgccattccttttgaaaacaatgaacacgttttactttttctaaagtttttaatttttcatttcatttttgcacccagactggggtgccagccttccagcgcccc

SEQ ID NO: 8717 - DNA, 464 bp, Homo sapiens
  misc_feature 415: m=a or c
ctgttgatatggtgatagttggagagtcaaatttttaccagaatttgtgaatatcatctctggttaatgattacacaaaaccttttaaaattttaaaaaattatttctaattctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagmctaaagattagttctttggcaatagccagtctggacttactatgtactt

SEQ ID NO: 8718 - DNA, 423 bp, Homo sapiens
  misc_feature 29: s=g or c
  misc_feature 340: k=g or t
aggaagagcaagaggttgagcagcgcaasagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccctgccgggcgtgcccggagcccaccgttgtgatttgaagagtaaccttcttcagaaaactgtggagacttcacagaaatggcagaagctagttgaagtctacaaattacctaatggaacaggctggagtacagtggcatgatctcagckctctgcaacctccatcttccaggtgcagaaggaaatagttatgaccttttgctctccaggaaagcaactgtctcatctgcaga

SEQ ID NO: 8719 - DNA, 214 bp, Homo sapiens
  misc_feature 150: r=a or g
  misc_feature 152: r=a or g
cgtcgctgccactctcgccctacaggaaggtggtgggttctcgggcagtctcctgggtcctgctactgcccaagatgccctggagctgcccagggccagtggctgggctttgtccttcccctggcgtctgctccccagctctcctgcttrartctgtgcccatgcaccccaggatccaggctgggggcctggcatccctactccctaccccagc

SEQ ID NO: 8720 - DNA, 145 bp, Homo sapiens
ttttgagatggagtcttgctctgtctcccaggctggagtgcagtggcctgatctcggctcactgcaatctctgcctcccaggttcaagtgattcccctgcctcagcctcccaagtatctgggactacaggcacgcaccaccgcac

SEQ ID NO: 8721 - DNA, 186 bp, Homo sapiens
  misc_feature 108: m=a or c
tctgggaggagaagaggcctgaccttggcgctggggtccagtgggcgctgctctggtccgaggctgctgctcttgacctctgctctgcggctgttttccattggagtmgaggctcctcctgtcctgtcctgcctgtggagggaagcaaaccttcccctggaccagagagaggagaaagcggagaca

SEQ ID NO: 8722 - DNA, 256 bp, Homo sapiens
tgttctgtggtcagatggctccctcggccccgctcttcctccatttgtggggcctgtcccatcagccatccctggtgggttctcctagagacccagagagccccccagtgtcctttctcccagcccttgtcccctgtgcccctctgttcctctgtctcgggagcagatgccgtgaggtggtgtggctgtggctactcatgccctgactgtggcccctgaaagggaggatggggttattcccattttacagatgaga

SEQ ID NO: 8723 - DNA, 133 bp, Homo sapiens
  misc_feature 116: m=a or c
tttatatgtttagtaaagcagggtttcgccatgttggccaggctggtctcaaactcttgggctcaagtgattgccttacctctgcctcccaaagtgctgagattacaggcgtgacmaccacacccggtggcag

SEQ ID NO: 8724 - DNA, 337 bp, Homo sapiens
ccgaaagacagaaataccatttgacccggcaatcccattactgggtatatacccaggggaatttaagtcatactattataaagacacatggtgtgtatgttcattgcagcactattcacaatagcaaagacatagaatcagcctaaatgttcaccaataacagattggataaagaaaatgtggtacatatgcaccatggaatactacgcagccataaaggagaacaggatcttgtcctttgcagcaacatgagtggagctggaggtcattatcctaagctaactaatgcaggaacataaaaccaaatactatatgttcttactaacaagtgggacct

SEQ ID NO: 8725 - DNA, 388 bp, Homo sapiens
  misc_feature 280: b=c or g or t
gatcatgaggtcaggagatcaacaccatcctggctcacatggtgaaaccccgtctctactaaaaaacataaaaaattagctaggcatggtggcatatgcctgtagtcccagctaatttttgtatttttagtagagacggggtttcaccatgttggccaggatggtctcgatctcttgacctcgtgatccggctgccttggcctcccaaagtgctgggattacaggcttgagcccctgtgcacggcatgcccggctaatttttgtatttttctgctgagabagcatttcgccatggtgcccaggctggtctcaaactcttggactcaagagatccacctgcctcagcctcccaaagtgctgggattacaggcgtgagcaccatgcccgt

SEQ ID NO: 8726 - DNA, 219 bp, Homo sapiens
  misc_feature 133: b=c or g or t
tctttttatcgagacagggtctcaccctgtcgcccaggctggagtgcagtggcgagatctcgactcactgcaacctctgcctcctgggatcaagcgattctcctgcctcagcctcccgaatagctgggattabagagtctccctctgtcacccaggctggagtgcaatggcacagtcgtggctcgccgcagcctcaacctcctgtgctcaggcgatccg

SEQ ID NO: 8727 - DNA, 267 bp, Homo sapiens
  misc_feature 219: s=g or c
taaatccaggaggcagaggttgcagtgagctgagatcacaccacttcactccatcctgagtgacagagcgaaactccatctcgaaaaaaaaaagagaaaaaaaaacctaggcgacaggatgatgtgtgcagcaaaccactgtggcctaggtttttttttctctctctctttctctctttctttcttttatagtctcattctgtcacccaggctggagtscagtggcagttctcagctcaccgaagcctctgcctcccgggctcaggc

SEQ ID NO: 8728 - DNA, 199 bp, Homo sapiens
  misc_feature 115: v=a or c or g
  misc_feature 116: r=a or g
tggcttcttggctgggtgcagtggctcaggcttgtaatcccagcactctgggaggccaaggcgggaggatcgcttgagatcaggagttcaggaccagcctggccggcgtggagavrcctcatctctactaaaaatacaaaaattaaccggacgtggtggtgtgtgcctgtagtcccagctactcgggaggctaagacac

SEQ ID NO: 8729 - DNA, 134 bp, Homo sapiens
tttatatgtttagtaaagcagggtttcgccatgttggccaggctggtctcaaactcttgggctcaagtgattgccttacctctgcctcccaaagtgctgagattacaggcgtgagccaccacacccggtggcag

SEQ ID NO: 8730 - DNA, 182 bp, Homo sapiens
  misc_feature 99: y=c or t
gaactattaaatgttgatcttgtgtcttattcttctttttgtatctcctcacttttttccccctttgtttttctttctttcttccttcctttttttttyctgagatggagtcttgctgtgttgcccaggctggagtacagtggggcgcgatctcggctcactgcaagctccgcctcccaggt

SEQ ID NO: 8731 - DNA, 202 bp, Homo sapiens
  misc_feature 74: r=a or g
  misc_feature 109: r=a or g
  misc_feature 174: s=g or c
  misc_feature 175: r=a or g
agcttttgggtcaccagctggtgcacccactcggggatctcgtccacgtcgcccggcgggtagaggcgctcctrgccgggcccgcgcttctgcagctgggcgccgtaartgtagccttcgccgaagaagtacttgttgcgcagtggggcccggtccaccgtgtgctcgttgtasrggcccttctcagcgcgggacaccaccg

SEQ ID NO: 8732 - DNA, 225 bp, Homo sapiens
agctggagcctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccagc

SEQ ID NO: 8733 - DNA, 174 bp, Homo sapiens
gtctcagtgattggctttctgtgcagtgagcagctggacctagatcagggtgtttcaacaacagattttggtttcctgacagtaaacatgttgcttgtggcttggctgccatgggccacgagtctcagaagccctcctaagcagctgcccactcagttttgactggagccgcaa

SEQ ID NO: 8734 - DNA, 144 bp, Homo sapiens
atcctcctcctcctcctgctcctcctggttggagcgcagtgtccggagcgggctggggggagagagcccgagagcagggttcggtgccttttcctctgtccccagccggtgcccagagcccccctccccttcctcgccacccca

SEQ ID NO: 8735 - DNA, 162 bp, Homo sapiens
aatccagcatttccaagtcaattgcgggaacgtggtcattagaattattataatttgctcatttgtgattgcctgccctagcaaaggtttgggccagagcgagctgcaggattttgtctcttctgttttatttggtttcagtggtaaactgtgaactcccct

SEQ ID NO: 8736 - DNA, 370 bp, Homo sapiens
  misc_feature 334: s=g or c
aactatgttgctgctggagatcaatgaagccgagtgaatgggggctgaatgtgcgagtccatagctgaagaggagcgccagatggtggaggaatacacttatttatgaagtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggstgaacatcggctacgtcatcaacgtcaccactctga

SEQ ID NO: 8737 - DNA, 258 bp, Homo sapiens
  misc_feature 63: w=a or t
  misc_feature 64: w=a or t
  misc_feature 66: y=c or t
  misc_feature 67: y=c or t
  misc_feature 82: s=g or c
  misc_feature 174: r=a or g
  misc_feature 175: m=a or c
cccaccttggcccttcaagtagctgggaccacagatgtgtgccaccatgcgtggctacttttwwtyygtattttttgtagasatggggttttgccatgctgcccgggctggtctcaaactcctgagctcaagggatcaacctgccttggcctcccaaagtgccaggattatggrmatgaggcaccacacctgacctgcactaagttttttatatacgttatctccattaatttttaactatgagtaagtggcccaata

SEQ ID NO: 8738 - DNA, 231 bp, Homo sapiens
tcaggtaccaaatttgcaggctgaagaattgccacttgggtgtatttttatgactgcattttctcacccattgagtctcctgtaccttagtctttgggcttacggacatgctgacacagcgcctgctgttccacgaaggagacccacgggtggtaatggtcagttaaaacacggggatggaccatgagagagggggtacctttgacagtggtgcttttcaaagggcacgaa

SEQ ID NO: 8739 - DNA, 228 bp, Homo sapiens
  misc_feature 196: n=a, g, c or t
  misc_feature 208: w=a or t
aaatacattaatgatagtaataattaagcttttaacttaattgccacatgacttcagacaagttaccccttgttcctgagctgtatttagttctgtcatctgtagatgaaataaaaattcctctcttactggaaatgctgtcaggattaagtggaatagagggctttcagactctagagtcacacccatttacggngctatttctgtwtgttttttaaaaccactcct

SEQ ID NO: 8740 - DNA, 183 bp, Homo sapiens
atctatcctttacggcaagggtacctacggtacctgaaaacaacgatggcatggaaaacacttcccatttacctgttgttgctgctgtctgttttcgtgattcagcaagtttcatctcaagatttatcaagctgtgcagggagatgtggggaagggtattctagagatgccacccgcaactga

SEQ ID NO: 8741 - DNA, 254 bp, Homo sapiens
  misc_feature 97: d=a or g or t
  misc_feature 101: k=g or t
  misc_feature 103: w=a or t
  misc_feature 104: y=c or t
  misc_feature 109: w=a or t
tttaagttaacttttgattattatgtgtaatttgaattagctcctgtaatgctgggttcagaaagtctcattttatatctttggttttttgttattdtgtktwyttggwtttttttgagacagagtttcactcttgttgcccaggctggagtgcaatggcgcaatcttggctcactgcaacctccacctcctgggttcaagggattatcctgtctcagcttcccaggtagctgagattacaggtgcccaccacc

SEQ ID NO: 8742 - DNA, 150 bp, Homo sapiens
gccctgctgaggttgaatactaagttgcttgtggccagctgggaagttggagtgagccagggagctgtgttggcacagacccaaggaggacctgggcctggtccacagtgtcagtcattctccagagcacttgcattactgttaccgaac

SEQ ID NO: 8743 - DNA, 189 bp, Homo sapiens
  misc_feature 90: m=a or c
cttactttggaagagagcgagagagagagagagagagtgtgtgtgtgtgtgtgtgtgtgtgtatgtcttggggaggatactaaggcaggmactcttccaaattcccattgttttgccaatgattttccctggcaaatcaatatattccctgcctgttgtcttcaacatttgtaaaaattgacatctctc

SEQ ID NO: 8744 - DNA, 359 bp, Homo sapiens
  misc_feature 10: s=g or c
  misc_feature 11: y=c or t
  misc_feature 194: r=a or g
  misc_feature 218: k=g or t
  misc_feature 230: r=a or g
  misc_feature 329: s=g or c
tgatggggtsyaattcagccccggctctagtttcagacgggggacctgctggcccacttgcaggtctcatccctgcactggcaccaccctgggcctcaggcctgtgttctctgcttcccacagtctcataccaccacctgcagttagttagttagttagtgaaacacagaccccatgtcagccaaccacagccrcaaaggtttaatcagtttttatckcacaaggcagtracaatgaggggcacagtggtggtcagggtggtggccccagtggccaactaggggagtatggcctcctccacagagccgctgcctggggaagatgctgtsagggcacgaccacagcccagcacttgcccc

SEQ ID NO: 8745 - DNA, 132 bp, Homo sapiens
tcactcctgggcctgctgggcctgtggctgccacgccccgtgcccctggtggccggagcaggggtgcacctgctgctcaccttcatcctctttttctgggcccctgtgcctcgggtcctgcaacagcagcgg

SEQ ID NO: 8746 - DNA, 344 bp, Homo sapiens
  misc_feature 284: k=g or t
  misc_feature 322: k=g or t
cagattcatatagctttggttaatctttgttctttttacattttattgtattttagacagggtctcgctgtgttctgcaggctgcagtgcaatggcatgatcatagctcactgcagccttgaacccctgggctcaagtgatcctcccactttagtgtcccaagtattaaatagctggcattacagacatgtgccaccatgcctggctgtttctcgttttttttagagatgggatctcactatgttgccaaggctggtctcgaacttctggcctcaaatgatctkcttgccttggcctcccaaagtgctggattacaggagtkagctactgtgtccagcctaatc

SEQ ID NO: 8747 - DNA, 275 bp, Homo sapiens
  misc_feature 28: m=a or c
tcttactatgtcactatgttgcctaggmtggtctcaaactcgtgggctcaagtcatcctccaatttcagcctcccaagtagccggaactacagacacatgcaaccatgcccagctcaagttcaaagattctttgctcagctatgtaggtagcacgtgcctgtagtccatgctacttgggaggctgaggcaggaggattgctcgagcccaggaggttaaggctgcagtgagctatgatcacacccactgtacgtcagtctgcttgacagagtgaga

SEQ ID NO: 8748 - DNA, 268 bp, Homo sapiens
  misc_feature 168: k=g or t
aggtcttaaatgcaagaaatgcaagagtgaatttcttgcatgtgtgtgcgtgtgcatgtgtgtgtgtgtgttttgagacagggtctcattctgttgctcaggctggcatgcagtggtgcaatcagtggtacagccttgacctcccaggctctcaatccatcctcccakcttagcctcctgagcagctggggccacaggcacacaccatcatccccggctaattttttgtagaaacagggtttctccacatagcccaggctgttctcca

SEQ ID NO: 8749 - DNA, 212 bp, Homo sapiens
acaaaaccctttccacttcttgccagtcgtttcaattcctcctgggctgctcgtgctgctgctgctgcactcaagtttatttattttcccgcctgggtaggggttttaggattcggtttgtggttttcacctctgttgctgctgtgcctaaggagggaaagaggagcagctgcgggaggatcgggaaggttttctgatgtagtcaccgggga

SEQ ID NO: 8750 - DNA, 339 bp, Homo sapiens
agcaggtggaaggactaggcctgggactcctgggtccccggcagtgtctggaggcatggctggggctggcgggggcctcggggtctgggggaactggtgctgctgggcctgtgcagctggacaggggccagggcgcctgcccccaacccagggaggaacctgacagtggagactcagaccaccagctccatctccctgagctgggaggtcccgatggcctagactcacagaactccaactactgggttcagtgtactggagacggcggcacaacagagactcgaaacacaacagccaccaacgtcaccgtggatggccttggaccgggtcattgtatac

SEQ ID NO: 8751 - DNA, 162 bp, Homo sapiens
attattttttttattgttgttttcttgttgctgttgttgttgttctcggagacggagtcttgctcttgctctgtcgtcgcccacgatagagtacagtggcgtgatctctgctcactgcaacctccgcctcctgggttcaaacaattctgcctcagcctccga

SEQ ID NO: 8752 - DNA, 456 bp, Homo sapiens
  misc_feature 4: s=g or c
  misc_feature 15: r=a or g
  misc_feature 64: w=a or t
  misc_feature 253: k=g or t
  misc_feature 254: k=g or t
  misc_feature 357: n=a, g, c or t
  misc_feature 380: m=a or c
  misc_feature 450: w=a or t
  misc_feature 455: w=a or t
gagsagacaagcgtrgccgcattagctctttctgcctcccacgcagccttattttttttattgwtgttttcttgttgctgttgttgttgttctcggagacggagtcttgctcttgctctgtcgtcgcccacgatagagtacagtggcgtgatctctgctcactgcaacctccgcctcctgggttcaaacaattctgcctcagcctccggagtagctgggattacaggcgcgcgccactatgcccggctaattkktgtgtttttagtaaagacggggtttcaccatgtcggccaggctgttctcgaactcctgacctcgtgatccctccgtctcggcttcccaaagtgctgggattangggcgtgagcaccgtgcccggcmgcagccttgttttgactgagtcattgggagccattactgttcctaaatgtaaactggcgtgacaggagtwcgggwt

SEQ ID NO: 8753 - DNA, 252 bp, Homo sapiens
  misc_feature 16: s=g or c
  misc_feature 56: s=g or c
  misc_feature 78: r=a or g
gggacgcggctccggsaacatggctcgcttcgctctgactgttgtccggcatggasaaacaagatttaacaaggagaraataatccaaggttggtataatccgattgttattttagctctcacccttgtgttaataagatgtgtgagttaagcagatttggtggggtggggtagactgggggcagcactccattgtgaattgggattacagaatcaaagcatcataaccacagaaatatgatcagggctgga

SEQ ID NO: 8754 - DNA, 267 bp, Homo sapiens
  misc_feature 76: k=g or t
ttgatgtgcctggtcttatacccagtctgtgtctggtttctctaccctcagtgccctttggcttaggctcaggatkggtgggcctcccttccccagcagctgcctcagccctgatcaagggcagttatttggctcaaggtgagtagtggtttttaaaccctactcccacacactgctgagtctgtgttttcctttcttcctgaccaggtaaactgtcttgagccccaccctcacctgcctgtgctggcaaccagtggcctagaccat

SEQ ID NO: 8755 - DNA, 311 bp, Homo sapiens
  misc_feature 218: b=c or g or t
  misc_feature 219: v=a or c or g
taagattatgagctttggaatcagacatagttggtttctaatcctggttttgctacttacataagctttatgtaagctgtctgtgcacagtgccttattcttagtaggcatttaggtgattttcttttagactaagatgaggataaaaatctttagtgagtcttaccgtgacctaccagacactgtatcatctgatcccccattagctctcagtactbvtctttcccttgttcaacccattccagtcacattagtgtcctccttgtttctcaaaaactccagttgctaggaatagatgcttaagggcaaga

SEQ ID NO: 8756 - DNA, 166 bp, Homo sapiens
  misc_feature 38: s=g or c
  misc_feature 45: s=g or c
atcaaaaccctccatttgtctccatacacacatttttsatctcgstgctcttttccccttttttacattgcacttatcaccttttaacaaactataatgtatgcattctatttatctgtatccaccctcccctaaccaactaaatgtaaacttgaagacagggaat

SEQ ID NO: 8757 - DNA, 140 bp, Homo sapiens
attcatttccttctcctcatcctttggatttcctggttcctgttggccggagaccctcattttctcccccttctgggtgtgtgggggtttttctgtctctttttctggacttggggacggtcgcttctggtttttttttt

SEQ ID NO: 8758 - DNA, 400 bp, Homo sapiens
cgatatgataatgcaaacctatttcatcactctaaaagcactgacctcaaaaaaccttataagcacttagatttaattgcattttccataggttcaactactgctgaaagtctggatttcagaataaagcagaatgtaagtttcagttgaggccatggatttgattgttccatggctggaagttccctttagatttcacattttatatggctgatcaattttcatacattgagaaaccaagtcaatcaagcaggaatcatttaaaaaccagataaagccatgtttttcttctgtgacaatttatcagtatctttaccaatgagccttaatttttatataggtccaatattgagcttttacttaaaatttagatagaacttttttttggatacaggcacaa

SEQ ID NO: 8759 - DNA, 331 bp, Homo sapiens
  misc_feature 160: s=g or c
atttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccasgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccaccagca

SEQ ID NO: 8760 - DNA, 265 bp, Homo sapiens
cacatggctaattttttatttttcttttgttgtagagatgggctgtcattctcttgcccaggctggtcttggtatactgtcctgtagcagtatattttggctacctgtactggcattggcttttccaagtgtcaagattacaggtgtgagctagtataccctgcccagtgtttctttcttacttggctttggtgtgaatgagaaaagaatttagtactaaaattttatgtgcatacagaagcattatttgaagtcagcctgtttt

SEQ ID NO: 8761 - DNA, 421 bp, Homo sapiens
  misc_feature 82: n=a, g, c or t
  misc_feature 129: k=g or t
agctgagcctggtggcggaaaggctgcggccccgcgccagagggccggtggctcctccgggcttctgaggacccgcaggagncgggcctcatcatttctgtctcctgtttctccacttccttctctatkggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagagctgggggcagcccagatcctacagagcgaccttctgcccatcctcacccagcaccaccaggacaagcctctctttgatgctgttatcagactgatggtgaacttgacacaaacc

SEQ ID NO: 8762 - DNA, 274 bp, Homo sapiens
  misc_feature 13: r=a or g
cttgcaatgacaratgaacagaaaacagcattaaagtggcaatttctcttggaaagaagcaaaatttatttaaaattcgttctatcacacagagcaaggagtggattgaaaattagtgtactctcgtgcaagcttgcagatcctactgaggcaagcagaaacttgtctggacaaaaacatgtttaaaacggtctatcattttgaactctggaaaagtataagagttttaactccctttaaaatggaatattaatttgaaaattatggggagaga

SEQ ID NO: 8763 - DNA, 158 bp, Homo sapiens
  misc_feature 134: n=a, g, c or t
tttttctttcagcacttgaaagatattgtgccgtctccctccagcctccattgttgctgatgagaattccacaccacccaaattgtttttctcttaccgggtctcactctgtcacccaggctggagtgcagcgncacaatctcacttcactgcagcct

SEQ ID NO: 8764 - DNA, 228 bp, Homo sapiens
  misc_feature 15: w=a or t
  misc_feature 16: w=a or t
tcacaattaacaggwwagtctttcttattttatttatttatatatttatttattttgagacagaatctccctctgtcacccagcatggagtgcagtggcacgatctcagctcactgcaacctccgcctcctgggttcaagtgattcttctgcctcagcctcccgagtagctgggactatgggtgcacgccaccacgcccggctaatttttgtattcttagtagagtaa

SEQ ID NO: 8765 - DNA, 134 bp, Homo sapiens
caacatgcaggtttgttacttatgtatgcatgtgccatgttggtgttattaactcatggactcatccattactcatttactcatcatttacattacgtatttatcctaattcttcccctcccacccccgccaca

SEQ ID NO: 8766 - DNA, 211 bp, Homo sapiens
  misc_feature 45: s=g or c
  misc_feature 108: k=g or t
  misc_feature 135: k=g or t
aactgtctgcatgtcgagtctcagaaaaacaaggattcgtcagtsaacccctttctgcatgcacagtggatttagggtaaagtttatgttaccctgtctttggccgakcgcagtggctcctgcctgtaatcccakccctttgggagactgaagcaggaggattgcttgaccacaggagtctgagaccagcctgggcaacatgacaaaacct

SEQ ID NO: 8767 - DNA, 147 bp, Homo sapiens
acaaagcgatgggaaagcgggacccggtggagaccagagtcttgctatgctttccaggctggttttgaactcctagcctcaagcgattttcctgcctcagcttcccaaagtgctgggattacaggcacaagccactgcaccggccca

SEQ ID NO: 8768 - DNA, 162 bp, Homo sapiens
aatatagaaccacccttttggccttcaaatttacaactgatgattttaaaccctcattgtgggagctaggaaataggatgcaccagacattttttttttcctttctttctgactcctctgaggcaaaaactgacttatagtaggtgtttcactgagggaagc

SEQ ID NO: 8769 - DNA, 161 bp, Homo sapiens
cctcccgggttcaagcaattctcctgtctcagcctccctagtagctgggattacaggcatgtgccactacgcctggctaattttgtgtttttagtagagacggcgtttctccatgttggtcaggctggtctcgaactcccaacctgaggtgatccgcccgt

SEQ ID NO: 8770 - DNA, 351 bp, Homo sapiens
  misc_feature 190: d=a or g or t
  misc_feature 345: n=a, g, c or t
aggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagadtcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtngggact

SEQ ID NO: 8771 - DNA, 209 bp, Homo sapiens
  misc_feature 10: w=a or t
catacatgtwaattagagcaagatttttggcatgttcaaatattctgtgtctttctatgaaatgctcatgcagggctgttaaaatgattatggattttctaactttcctgttaattctgtcaatctgtgcttcagatatcttgagctcttttagtagatgcctttacatttgttgtctctttgtgattaattgaccctgtgaccctgct

SEQ ID NO: 8772 - DNA, 328 bp, Homo sapiens
  misc_feature 7: w=a or t
  misc_feature 26: k=g or t
  misc_feature 97: k=g or t
  misc_feature 179: y=c or t
  misc_feature 180: y=c or t
agatgtwgaattattggttgattttktttctttcagcaatttaagtatgtcatcacactgtcttctggccttcatactttttttctttttctttttktttgagacaggatctcactctgtcactcaggctggagtgcagtagcgcaatctcagctcactgcagcctccgcctcttgtgyycaagtgattctcctctctcagcctcctgagtagctgggattacaggtgcctgccacaatgaccagctaatttttatattttcagtagagatgaggtttccccacgttggccaggctggtctcgaactcctgacctcaagtgacccacc

SEQ ID NO: 8773 - DNA, 229 bp, Homo sapiens
  misc_feature 197: v=a or c or g
  misc_feature 210: r=a or g
caactgtaaattagatggttaccctacactcctggttaatttttttaaacatatttttctgttttgctttttatttattttttttattttttgtttcgagacagagtttcgctcttgttgcccaggctggagtgcagtggcgcggtcttggctcactgcaacctccacctcccggtttcaagcgattctcgtgcctvagcctcccgagtrtctgggattaccggcactc

SEQ ID NO: 8774 - DNA, 148 bp, Homo sapiens
gctatcagcctgtctgtccgtttctatttcatcccttgcctgcctatctcaggctcttcccatctctgcattatttctgtctctttctgtttctttctagttacctgtctcttttcctctctctctttctccctgtgtctcaccgcct

SEQ ID NO: 8775 - DNA, 142 bp, Homo sapiens
  misc_feature 58: n=a, g, c or t
  misc_feature 68: n=a, g, c or t
  misc_feature 132: n=a, g, c or t
  misc_feature 142: h=a or c or t
cctgtgtatgtgtctgtatgcatgtgtgtctgtgcatatgcatgtgtgtctgtgtgtntgtgtgtgtntgtgtgtctgtgtgtatgtgtgtgtgtctgtgcatatgcatgtgtgtgtgtgtgtctgtgcgtntgtgtgtgth

SEQ ID NO: 8776 - DNA, 253 bp, Homo sapiens
  misc_feature 135: d=a or g or t
  misc_feature 136: k=g or t
  misc_feature 172: m=a or c
  misc_feature 173: h=a or c or t
  misc_feature 217: k=g or t
  misc_feature 231: s=g or c
  misc_feature 232: r=a or g
  misc_feature 238: w=a or t
tatactatactgtggcctattaagtgcagtagcattgtgtctaaaaaatgtacataccttaatttcaaaaatactttattgctaaaaactgctgatgatcatgtcagccttctgcaagtcgtcatctttttgctdkgtggagggccttccctcaatgttgacagccactgamhgatcagggtagtggttgctgaaggttgggatggccgtgacagtkgcttaaaataagasrgcagtwaagtttgccacactc

SEQ ID NO: 8777 - DNA, 169 bp, Homo sapiens
cattttgactggtgtaagatgatatctcatggtggttttgatttgcctttctctcatgatcagtaatactgagctttttttcatacgcttcttgactgcatgtatgccttcttttgaaaagtgtctgttcttatcttttgcccacttcttgatgggaagaacccaccgt

SEQ ID NO: 8778 - DNA, 212 bp, Homo sapiens
  misc_feature 9: s=g or c
gcgcggtastcatgcctgtaatcgcagcactttggtagccaaggtgggtgttttatttgaggtcaggagttcgaggcctgcctcagccccccaagtagctgggattacaaccatgcgccaccacacctggctaatttttgtatttttagtagagacaggttggccaggctggcctcgaactcctgacctcaaataaaacacccaccttggct

SEQ ID NO: 8779 - DNA, 382 bp, Homo sapiens
  misc_feature 295: w=a or t
cctgacagttgccccttaatttcatgccagtttcagcagtgatcaggagagctttgtcctgctctatcttggttccaggttgctcaggctccccccagagcagctgtagtcagtgcagtcttgtctgggggtctgagcagaagcatgggtaccactcttgagcaggaccctcctttcttcacctctggggtaaagaccatgcttacctgcatgcacgaagagtgtggtaggtggttgcacctgcccagaaagagataataataattaaggatacagtagggggaacaagtgcgtwaatttacattttaacttgtcttttcttcaaataggtattaatatccttgtgaagtccaaggccttccagtatttcatgtgtaagtgt

SEQ ID NO: 8780 - DNA, 191 bp, Homo sapiens
cacccgtatctcctttcttttctcagaggaggaactgtcctcttcctgttcgaaggtctgtccctccatgttcttactctcatctcttctcttttgagatcttgggatctcactttattgattgatctgttcatttacagtctctctttgtttctttcatcttcaacctctcacttaacacttgaccctgg

SEQ ID NO: 8781 - DNA, 441 bp, Homo sapiens
  misc_feature 39: s=g or c
  misc_feature 286: m=a or c
  misc_feature 307: m=a or c
  misc_feature 309: s=g or c
  misc_feature 375: k=g or t
  misc_feature 378: v=a or c or g
aaaatacaaaaaaaaattagccggacgtggtggcgcatsctgtaacctccgcctcccgggttcaagtggttctccttcctcagcctcccaagtagctggaactacaggtgcatgccaccatgcccagctaatttttatatttttagcagagacggagtttcaccatgttggccaggagggtctcaatctcttgacctcatgatctgcccaccttggcctcccaaaatgtgggattagaggcgtgagccaccacggagggtcctggagcatccagatggagaggggmaatgccctggtggtgctgcgmasctgctctggccgggcctcaccttctaccatgctccccgcaccaagaactatggctacgtctacgtkggvactggcgagaagaacatggacttgcccttcattattgcagcctagcagcactccacctcctat

SEQ ID NO: 8782 - DNA, 141 bp, Homo sapiens
cttgtctttgtgtcacttccgacttgtttcttcaaaatacggtaaatgtgtatatatcagtatcacataaatttggaaccttaggctctctagaacttactttggcaaatgtgcccttatgtatttgttttctcgggggca

SEQ ID NO: 8783 - DNA, 239 bp, Homo sapiens
cgatctcagctcactgcaggctcgcctcccaggttcatgccattctcctgcctcagcctccctagtagctggagctacaggcgcccaccaccatgcccggccattttttttgtatttttagtgagatggggtttcacggtgttagccaggatggtctcgatctcctgatctcatgatctgcccgcctcagcctcccaaagtgctgggattacaggcgtgaaccaccatgcccggccgcc

SEQ ID NO: 8784 - DNA, 151 bp, Homo sapiens
tttagtaaagatggcgtttcaccatgttggccaggctggtctcagactcctggcttcaagtgatccacccaccttggcatcccaaaatgctgtgattacaggcgtgaatcacagcactggcctgaatctagggtttaaaaaaaaaaaaaaa

SEQ ID NO: 8785 - DNA, 207 bp, Homo sapiens
tgtgtatttgttgagtgaatattggttatatatattttttattttattttattattattatacttcaagttttagggtacacgtgcacaatgtgcaggtttgttacatatgtatacatgtgccatgctgctatgctgcacccattaactcgtcatttagcattaggtatatctcctaaagctatccctccccactcctcccaccccg

SEQ ID NO: 8786 - DNA, 152 bp, Homo sapiens
  misc_feature 139: s=g or c
aatgtattcatcatcctcatcgtcgcgccgccgccgccgccgccgccgcctcggcgcgggattggggggctctcctcggccttctcggtcttcgtctcacttatctctcccccctctccccccccccttttcagcgcastcggaactggccc

SEQ ID NO: 8787 - DNA, 222 bp, Homo sapiens
  misc_feature 156: n=a, g, c or t
  misc_feature 197: m=a or c
  misc_feature 213: m=a or c
taaaatactttgatttctttccggacctgttatctgtcatgttgatatcttattgctacaaagagtctgttttgtcagtcttaaggtctctgttttttttggtttttttttttgagacagagtctcactctgtcgcccaggctggagcgtagtggncgcgatctcggctcactgcaagctccacctcccgggttcamaccgttctcctgcctmagcccccca

SEQ ID NO: 8788 - DNA, 298 bp, Homo sapiens
  misc_feature 123: n=a, g, c or t
  misc_feature 127: k=g or t
  misc_feature 258: m=a or c
  misc_feature 278: k=g or t
ttttctttctagttcaatccttgttgctctatttgttcattttcttgctgagttcatattatgttttattgtggtaaaatatatgtaacaaaatctaccattttaactattttttttttcccnagakggagtctcgctctgtcacccaggctggagtgcaatggcgcgcaatctctgctcactgcaacctctgccttccgggttcaggcgattctcctgcttcagcctcccgagtagctgggattacgggcgtgtgcmaccgtgcccagctaattttkgtatttttagtagagatggg

SEQ ID NO: 8789 - DNA, 362 bp, Homo sapiens
acttttttatttgcttggtttttatgtacttattactaatttatccccagattctttacaagctctgtaatctcctctcaatatgttctaacatattagtttgtcaattagatattttatcagtctttctgggagcctcttggcctggtttggtctgagcatctttactttgtattgactgcagagtaattgtatttatgtactagtgtttatatcccattgtttttgatacaacaattttcttaactagtccttttttcatgcgctgtttttcaagatttcataagaaaaatgctactattagcatttttgtgtacatattttactctggattaaataacacatggtatcactgggacctg

SEQ ID NO: 8790 - DNA, 133 bp, Homo sapiens
  misc_feature 29: b=c or g or t
gatgtgatacatgagaaattgtgccagtbacttttaagctgcacattcctccacagtaagtggaattggtggggcttgaatagtagagataaagaggttttctttttctttctttctttctcttttttttttt

SEQ ID NO: 8791 - DNA, 252 bp, Homo sapiens
  misc_feature 115: y=c or t
  misc_feature 135: w=a or t
tgttttttgggcatttgtttatcttcttttgggaattatctattcatgtcctttgcccactttttgatagattttttttttgtgtgttttgtttttttgctgatttgtttgggtyccttgtagattctgaatatwagtcctttgtcagatcatagtttgcaaatattttctcccactctgagaggtgtctgtttactctgctgattatttcttttgctgtgcagaagctttttagtttcattaggtcccata

SEQ ID NO: 8792 - DNA, 149 bp, Homo sapiens
  misc_feature 7: h=a or c or t
tgtttghattttggtttttggtttttagtttttttgagatggagtctcgctctgtcactcaggctggagtgcagtgacgcaatctcagctcactgcgctccagcctggcaacagagcgagactctgtctcaaaaaaagaaaaaaaaaaa

SEQ ID NO: 8793 - DNA, 411 bp, Homo sapiens
ttgtttgtttctgaatagttttgcaaaaagattcatcccactacgttccgaatctgaagcaggttcacatttcctaggcgctcagatgtgcaaagggtaattctgttctctgattcctgaactgagtctgtgtgctcagccctgttctggtgggtggggcggcttgttcctgtcacatggcagtgggtttggccacctcggggtttccacagtccacagcctatggaagatccagccagcattcattcttcatgctatcctctccttctccttccatcctcctgcagagccctgccccgtctcctccctggccaccctgcccttagggggtttgcccttgttaacagccctgccctttgcctcaactcgacccatccctaagcgtctgtttgccagatcactcccatgagc

SEQ ID NO: 8794 - DNA, 353 bp, Homo sapiens
  misc_feature 19: y=c or t
  misc_feature 292: h=a or c or t
  misc_feature 343: s=g or c
  misc_feature 344: w=a or t
taagtgttgtacagttgtyctggagttgtgcagttttttctcttctttcttttgagactgggtcttgttctgttgcccaggctggagcgcggtggcatgatcaaggctcacagcagcctctacctcctgggctcaggtgatcctctcacctcagcctcctgagtagctgagactacaggtgtgcaccaccactcctgggtcatttttgaattaaatttttttttttaatttttaatttttgtagagacgaggttttgctctattgcccaggttgatctcaaatgactgagthaagtgatcctcctgcctcagcctcccaaagtgctgagattactagcgtgaswaccacacct

SEQ ID NO: 8795 - DNA, 205 bp, Homo sapiens
cctaatattttatttataccgtcttatttatttttatttttattttttgtgacagggtcttgctctgttgcccaggctaggcaacatgacaaaaccccatctctactaaaaatacaaaagttagctgggcgtggtggcctgcccctgtagtcccagctactcaggcggctgaggtgggaggatcacctgagcctagaaggtcaag

SEQ ID NO: 8796 - DNA, 274 bp, Homo sapiens
aatggaggcaaggaggcttgggaaggaaatggaggcatggggaggttggtcttacatggctcaacatcaactgctgcttctctgtgaagctatttctgatccttttcctctgcccagtcacagttaatcgcttctcctctgcattgtgtattgtagccattactcttgtaatactataatgtaatgatttctttatcttcctgtttccataataggccataaatctaatagacaaatttaagatttcctatttctccaacccccttccccacct

SEQ ID NO: 8797 - DNA, 131 bp, Homo sapiens
  misc_feature 116: s=g or c
atcttagaggaaagtctttcagtttttccccattcagtatgttattagctgtgagcctgtcccttgtctctaattgtaactttgtactcactgaccaacttttccctgcccctgcstccctcatccccgaa

SEQ ID NO: 8798 - DNA, 156 bp, Homo sapiens
  misc_feature 68: w=a or t
  misc_feature 88: y=c or t
  misc_feature 90: y=c or t
  misc_feature 102: w=a or t
  misc_feature 143: y=c or t
acctcagcctcccaggtatctgggactaaagtcatgcaccgccatgcccagataattttttttttttwactttttgtagagacaaggycycattatgttgcwaggctgatcttgaacccctgtgttcaagtgatccccctgayttggcctccctaa

SEQ ID NO: 8799 - DNA, 211 bp, Homo sapiens
  misc_feature 36: h=a or c or t
  misc_feature 37: w=a or t
  misc_feature 202: y=c or t
  misc_feature 210: d=a or g or t
acgccctgttaatttttgtggggttgtttgtttgthwgtttgtttgtttgtttgttttttggtagagatgacatttcgccatgttgcccaggctggtcttaaactcctgggctcaagcgatccacccacatggccaggcgcagtggttcatgcctataatcccagcactttggaaggctaacgtgggtggatcgcttgagcycaggagtdt

SEQ ID NO: 8800 - DNA, 140 bp, Homo sapiens
aggtgcgaggctggctgtcctcctctatctgccgcagcagcaatcagcagattctaatcagcctcaccctcagagaggctcacacagaagagaccagcaggtctagaaccctccaggctgcccactgtcctaccccgtga

SEQ ID NO: 8801 - DNA, 134 bp, Homo sapiens
  misc_feature 71: n=a, g, c or t
ctcctctctcctcctctctgcttctctctgctcctctctcctcctctctcctcctcctcctcctccaccancctcctccttctccccctctttctccccctctttctctcttctttctcccccgtcccccccga

SEQ ID NO: 8802 - DNA, 141 bp, Homo sapiens
actgggttgttttttgtttatttgattttttgagacagggtcttgctctgccgctcagggtggagtgcagtggcgtgatcttggctcactgcaacctccgcctcccgggctcaagcaatccatcttcctcagccccccgag

SEQ ID NO: 8803 - DNA, 417 bp, Homo sapiens
  misc_feature 7: n=a, g, c or t
  misc_feature 8: n=a, g, c or t
  misc_feature 9: n=a, g, c or t
  misc_feature 385: d=a or g or t
tccagcnnngtggtcaattttggaataggtgtggtgtggtgctgaaaaaaatgtatattctgttgatttggggtggagagttctgtagatgtctgttaggtctgcttggtgcagagctgagttcaattcctggatatccttgttaactttctgtctcgttgatctgtctaatgttgacagtggggtgttaaagtctcccattattattgagtgggagtctaagtctctttgtaggtcactcaggacttgctttatgaatctgggtgctcctgtattgggtgcatatatatttaggatagttagctcttcttgttgaagtgatccctttaccattatgtaatggccttctttgtctcttttgatctttgttggtttaaagtctgtdttgtcagagactaggattgcaacccctgcctt

SEQ ID NO: 8804 - DNA, 156 bp, Homo sapiens
  misc_feature 117: y=c or t
  misc_feature 126: w=a or t
atgtgtgcgcgcgtgtgccctgagacccaggacagaagccacggtcctaagagccggttttatcctcgtcattctgcgtgtcctcccccacgccacctgtgtcggggctcagggtcytcctgcttwatatgagcccccttcctttcctccactcca

SEQ ID NO: 8805 - DNA, 314 bp, Homo sapiens
  misc_feature 3: n=a, g, c or t
acntgagtggctgggactgcagacgcgtgccaccatgtccggctggtttttgtatttttagtagagatggggtttcactatttggccaggctggtctcgaactcctgacctcgggcgatccatccgcctcagcctcccaaagtgctgggattacaggcgtgagccaccacgcccagccaaaatgaacttttaatggctagcatactcttaggagtttctgttgtgatgcctgttacctcagatcattaacatcttgatgataaggacttgataatatcttttgtttcagttatatcctccagcaatgcctacat

SEQ ID NO: 8806 - DNA, 178 bp, Homo sapiens
ctaaaaatacagaaattagctgggtgtgggggcatgtgtctgtagtcctgctacttgagaagctgaagcagggtctcgctctgtcacccaagctggagtgcagtgttgcgatcttagctcactgccacctcctcctcctgggttcaagcgatcctcctgcctcagcttctcaagtagc

SEQ ID NO: 8807 - DNA, 168 bp, Homo sapiens
tgtttgttttggtttggttttgagatggagttttgctgttgtcgcccaggctggagtgcagtggcacaatttgggctcactgcaaccttcgcctcccgggttcaggcgattctcctgcctcggcctcccaggtagctgggattacaggcccccaccactacgcccgaa

SEQ ID NO: 8808 - DNA, 348 bp, Homo sapiens
agacagttgggcttcagagtccatgattttttgtttgtttgtttgttttgttttgttttgttttttagacagagtttcactcttgttgcccaggctggagtgcaatggtacgatctcagctcactgcaacctccacctcccaggttcaagtgattctcctgcctcagcctccctagtagctgggattacaggcatgtgccaccatgcccggctaatttcgtatttttagtagagatggggtttctccatactggtcaggctagtctcgaactcccgaactcaggtaatctgcccgcctcggcctcccaaactgcttggattacaggcatgagccaccacgcccagccc

SEQ ID NO: 8809 - DNA, 249 bp, Homo sapiens
agctttggctttctttatgtgctttatacttttggtcaacaggataatctcaagttgcaggttttatttttagctatatattattttctatttcttggtgcttgcctctccctatctgatagttttcacagttgcttttactgaccctcatgttcccagtcaaaaatcaagtcttctgtcccatggcaatacttcagtgcttctattgcatgggatgagtgtggtcagcccagttccttcctccctcca

SEQ ID NO: 8810 - DNA, 157 bp, Homo sapiens
aattttttttgggatggagttttgctcttgttgcccaggctggagtgcaatggggcgatctcagctcaccgcaacctccacctcctgggttcaggcgattctcttgcctcagcctcctgagtatctgggattataggcgtccaccaccacgcccggt

SEQ ID NO: 8811 - DNA, 153 bp, Homo sapiens
tgggggtttctttgttgctgctgggtgatgctaatagtcctgactctccactcgccctcctgtgacactgcccaggaggagatggggagggtgcccactactcccaagtgcaggtggaagttagggctctccatgtgttctttgctgacacct

SEQ ID NO: 8812 - DNA, 214 bp, Homo sapiens
gtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgcccccgct

SEQ ID NO: 8813 - DNA, 183 bp, Homo sapiens
  misc_feature 11: d=a or g or t
  misc_feature 20: r=a or g
  misc_feature 53: k=g or t
  misc_feature 54: r=a or g
  misc_feature 102: w=a or t
  misc_feature 113: k=g or t
ttattcattgdcttgctcaratcgttccctctttgcccatcgggagctctgtkrgttgtcccttgtgtccatttgatttcccagttgggaatttttgttgtwttgatttattkttgagcacttccttacttttcagcactataagaccttctagattcttcttgtatgtttcctgccccagcg

SEQ ID NO: 8814 - DNA, 156 bp, Homo sapiens
gaggccagattatgcaggcctgtgggctgacacaatgactttggctgttactctgagtgcattgggggccaccggattgtttaaggaggcttgtgatctaacctttttaaacataggtcagatcacaagcctccttaaacaatccggtggccccca

SEQ ID NO: 8815 - DNA, 319 bp, Homo sapiens
  misc_feature 5: s=g or c
  misc_feature 13: s=g or c
  misc_feature 90: y=c or t
  misc_feature 268: w=a or t
  misc_feature 269: k=g or t
  misc_feature 287: k=g or t
acaasggaggaastctgaagggaagttggcaggaggcagcagctgaatgcaacttgggcctccgggctccagaaggcttgaagcccctgyaggcaggtttcctgtgggctctcggcctccaggctcctcatagcctgggagggaatttgacccagcagtgagccaccttcgattaataaaccagctgtgccttcccacatgggttccacatgggagaactgtttctggcacgatcattgttgggagaatgatttgaactcgtaggggwkaggtttgttgagggagakggacaaactgggaccagcagtgaggacgggca

SEQ ID NO: 8816 - DNA, 180 bp, Homo sapiens
  misc_feature 30: d=a or g or t
  misc_feature 54: k=g or t
cacttttaatctttaggaacaacatttcadaatttgttttcagatgttcctttktttatttttattttttttgagatggagtttcactcttgttgcccaggctggagtgcaatggcgtgatcttggctcaccacatcctccgtctcctgggttcaagcgattctcctgcctcggcccccc

SEQ ID NO: 8817 - DNA, 309 bp, Homo sapiens
  misc_feature 307: h=a or c or t
  misc_feature 309: n=a, g, c or t
tgttgttgtttggttttggggggttttttagttttgtttgagacggagtctcactctgttgccaggctggagtgcagtggtgagatctcggctcactgcaacctccacctcccgggttcaagtgattgtcctgcctcagcctcccaagtagctgggactgctggcaggtgccaccacgcccggctaatgtttgtgtttttagtagagatggggtttcaccatgttggccaggctggtctcgaactcctgacctcgcccgccttggcctcccaaagtgctgggattacaggcctgaggcactgcgtchtn

SEQ ID NO: 8818 - DNA, 191 bp, Homo sapiens
cttttatttcttttcttatttcttaaaatttttttagagatggggtctcactgtattgcccaggttcgccttaaactcctgggctcaagcgatcctccctccttggcctcccaaagtgttgggattacaggcatgagccactatgctgagcctcttttattttttttaaaagaatgaaaaatatgaagtac

SEQ ID NO: 8819 - DNA, 140 bp, Homo sapiens
catgtgcacaatgtgcaggttagttacatatgtatacatgtgacatgctggtgcgctgcaccccctaactcatcatctagcattaggtatatctcccaatgctatccctcccccctccccccaccccacaacagtcccca

SEQ ID NO: 8820 - DNA, 323 bp, Homo sapiens
  misc_feature 139: y=c or t
  misc_feature 167: w=a or t
  misc_feature 178: w=a or t
  misc_feature 195: w=a or t
  misc_feature 227: k=g or t
  misc_feature 235: w=a or t
  misc_feature 237: k=g or t
  misc_feature 284: w=a or t
  misc_feature 290: y=c or t
  misc_feature 299: d=a or g or t
  misc_feature 300: r=a or g
  misc_feature 302: b=c or g or t
tgagaaaaccaaaggctgagagaggtggggtaagttcccagaatcatatggcgcacttaataatggaaccgagatttgaactcaaagaccacacaattatgtgtgatactatggcaaactgatgatttctttttttttycttttcttttttcattttattttttttwattattattawactttaagttttagggwacatgtacacaatgtgcaggttagttacatakgtatacawgkgccatgctggtgtgctgcacctattaactcgtcatttagcattaggwatatcycctaatgcdrtbccctcccccctccccccaccc

SEQ ID NO: 8821 - DNA, 224 bp, Homo sapiens
acagattattggccagggcatttacatttatggcaaggttaattaagaaagttttatttatttactttttatttattttatttactttttttgagaccgggtcttgcccaggctggagtgcagtggtgcaatcacagctcactgcagccttgacctcccgggttcaagcaatgcttctacctcagcctcccgagtagctgggactataggtgcccaccaccgat

SEQ ID NO: 8822 - DNA, 201 bp, Homo sapiens
  misc_feature 5: v=a or c or g
actcvtcccctgcgcccttcccaacccttagcccctctgcctcctgctcgctcctctccccagcccactcctctaccctgcaccctctcctttccagcctcccagcccctctgctcctgtcccctattccttcccacaccctcacctctgcatcctccagtctcctttcccgcccacaatcccccaatttcccccttccct

SEQ ID NO: 8823 - DNA, 181 bp, Homo sapiens
  misc_feature 21: m=a or c
  misc_feature 28: m=a or c
tttctaatgctattatcctgmtagtgamtaagtctcatgagatctgatgggtttatcaggggtttctgcttctgcttcttcctaatttttctcctgccaccgcttcctgccatgatactgaggcctctgcagccatgtggaattataagtccaattaaacctctttttccttttttttttt

SEQ ID NO: 8824 - DNA, 179 bp, Homo sapiens
  misc_feature 121: m=a or c
  misc_feature 146: k=g or t
gccactgcactgtagtctggatgacagagcaagaccctgtctcaacaacaacaaccaaaatctgtttgggcctgaaactccttagctcaagtgatcctcctgcctcagcctcccaagtagmtgagactacaggaaaatattttatkttattttattttttaattttttttctctaacct

SEQ ID NO: 8825 - DNA, 335 bp, Homo sapiens
tgtgagaaatggagtcaaaggaaatcacgttggaactttaaggtttaatgactgccttaatggattttgaagttgcatgggccctgtagcccctttgttttggccaatttctcccatacggaatagctgtatttacccaatgtctgtactcccactgtatctgggaagtaagttactggtttttttgttttgttttgttttgttttggtttttacaggctcatatgtagaagaaaccaaaaaaaacaaaacaaaacaaaacccaggtaagttgattcagcaaaattaaaaacttttgtgataaaaacactatcaacaaagaaaaggcaacaaaca

SEQ ID NO: 8826 - DNA, 350 bp, Homo sapiens
tatatgtatacttaattttcagcaattatgacacaataaaaagaatatgcaaatttattgttgttttagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaacgt

SEQ ID NO: 8827 - DNA, 366 bp, Homo sapiens
  misc_feature 236: n=a, g, c or t
  misc_feature 237: d=a or g or t
ccctgtgccaaggtatctgtctgatttttaaaaattatttcaatctattaaatttatctggtacatttctgaaaagcttttctgtgtttccctcttggagatcactgaatttccctaaaactactattttgaattattggtcagagttcacatactgctgtctcattagagtttcatcactggttccttgcctttttctgtttgcagaggtcacagttccctgtttgctgttgacndcttgtggacttatgtctattatttattccagtcttctctgtgtggcttgttttggtttttactggatatgtttgcttagaaattctttgtaatttacctgttgattttctttccctctctccctcccca

SEQ ID NO: 8828 - DNA, 159 bp, Homo sapiens
ccacattttcttaatccagtctatcattgttggacatttgggttggttccaagtctttgctattgtgaataatgccgcaactttatgttctattaaccagatcaaaaacttgtttcacttgatttttagtagattttatctcattttattgttattttt

SEQ ID NO: 8829 - DNA, 134 bp, Homo sapiens
caaaaagtatggagagttccggccaggcgcggtggctcacacctgtggtcccagcactttggggggccgaggtgggcagatcacaaggtcaggagtttaagaccagcctggccgatgtgatgaaaccccatgcc

SEQ ID NO: 8830 - DNA, 355 bp, Homo sapiens
  misc_feature 299: k=g or t
  misc_feature 309: k=g or t
  misc_feature 319: r=a or g
ttgactatcgaaattgccttctgactgttgggcagtatttgcacaatgatgagataattcctgttattattttaaatggagacggggtctcacggtgttgcccaggctggtcttgaactcctgagctcaggtgatcctctcacctcggcctctcaaagtgctaggattacaattcctgtttttctaaaaccggtttttctttggttttgtcattagcatgtgcgacacaagaggtcgacactgaacttagcgttttcaatagctaagatgaaatgtttctattcatgatgtgcttctgkttcctcatgkttcaggaggraaataagattttattttatcatccaaatgaggtagt

SEQ ID NO: 8831 - DNA, 152 bp, Homo sapiens
attttctaaagtcagcacagcctggaaggattcctggtctctcccaccttctaccattctgctgccagtgacggcaaggattggtgtagcttctgcgcagtgctttgtgcctggaataccgagaaggaagaaaaagaagacaagcacccctt

SEQ ID NO: 8832 - DNA, 280 bp, Homo sapiens
  misc_feature 230: w=a or t
  misc_feature 231: n=a, g, c or t
  misc_feature 232: n=a, g, c or t
  misc_feature 248: y=c or t
  misc_feature 249: y=c or t
cctgcttttttggtaagattttaatgtcattcatagaactttattcattatttgatgttggtagtagatccaacttctctactcttcattttcttttttatatggatttttttatttccaacttttaagtttaagtgtacatgtgcagatgtgcaggtttattacataggtacatgtgtgtcatgggggtttgctgcacagatcatcccatcacctaagtattaagctgwnncatgcattagctattyytcctgattctctccctccttctgccccccac

SEQ ID NO: 8833 - DNA, 245 bp, Homo sapiens
  misc_feature 52: y=c or t
  misc_feature 53: y=c or t
  misc_feature 222: n=a, g, c or t
  misc_feature 237: s=g or c
acctgggaaagcttcatagaggatgcagtttttttgtttgtttttgtttttyycttttttgtggagatgggagtcttgctctgttgcccaggctagagtgcagtggcaagatctcagctcactgcaacctccgcctccgatgttcaagtgattctcttgcctcaggctcccgagtagctgggattacaggcacaagctaccacacccggctactcgggagcntgaggcaagagaatsacttgaac

SEQ ID NO: 8834 - DNA, 208 bp, Homo sapiens
tggcgcgatcttggctcaccgcaccttccgcctcccgggttcgagcgcttctcctgcctcagcctcccgattagcggggatgacagggagtcacccccacgcctggcttggctgatgtttgtgtttttagtaggcacgccgtgtctctccatgttgctcaggctggtctccaactcccgacctcctgtgatgcgcccacctcggcctg

SEQ ID NO: 8835 - DNA, 203 bp, Homo sapiens
  misc_feature 20: k=g or t
  misc_feature 68: k=g or t
  misc_feature 125: k=g or t
  misc_feature 136: s=g or c
  misc_feature 143: v=a or c or g
  misc_feature 151: b=c or g or t
ctctattacttttttttatkttttattttttttttagacggagtctcgctctgtcgcccaggctggaktgtagtggtgccatctctgctcactgcaagctccacctcctgggttcacgccattckcctgggttcasgccattvtcctgctbtggcctcccgagtagctgggactacaggcacctgctaccatgcccggccaat

SEQ ID NO: 8836 - DNA, 202 bp, Homo sapiens
  misc_feature 46: y=c or t
  misc_feature 47: y=c or t
  misc_feature 51: b=c or g or t
  misc_feature 52: w=a or t
atcccttctctcttccttggtgcttctttttcctgctcggtgagtyygctbwtgtttgtttgtttttgagacagagtctcactttgcttcccaggctggagtgcagtggtgcgatctcagcttactgcagcctccgcttccggggttcaagcgattctcctgcctcagcctgccaagtagctgggactaccggcgcccacct

SEQ ID NO: 8837 - DNA, 150 bp, Homo sapiens
  misc_feature 129: k=g or t
  misc_feature 130: k=g or t
  misc_feature 136: r=a or g
aagacagagtctgctgtattgaccaggctgcatggagtacaatggtacaatctcggctcactgcaacctccgcctcctgggttcaagcaattcttatgtctcagcctccaggacagctggggattacakkcatgcrccatcacacctgaa

SEQ ID NO: 8838 - DNA, 254 bp, Homo sapiens
acagtcatttgggcttaacattttaaagtctgttctgggtcttccacattcattattctctacagtcaatcacattccaaggattgttgcctccaatgcatgcctttttctcagttttattttctcccatcagagtcatgcacagattagctctcaagtgagctattataatggcctcctagcatctaaactctctttttccaattgatagttctgccagagttgtcttcttaaagcagaggttagaccgcata

SEQ ID NO: 8839 - DNA, 281 bp, Homo sapiens
  misc_feature 161: s=g or c
  misc_feature 223: s=g or c
  misc_feature 264: s=g or c
  misc_feature 271: m=a or c
cccatcgttttacaaataactcagatttacactttttaatgacaggtgtccattcacatccactttctctaattcgagttggtcttcccattacacattgcttcccttctgcattctttagttgttgtacttttttttttgaaacggagtctcactctgtsgcccagtctggagtgcagtggcgtgatctcggctcactacaagctccgtctcccgggttcasgccattctgcctcagcctcctgagtagctgagactacaggsgcccacmaccacaccca

SEQ ID NO: 8840 - DNA, 217 bp, Homo sapiens
  misc_feature 100: y=c or t
  misc_feature 109: y=c or t
  misc_feature 145: s=g or c
  misc_feature 208: m=a or c
aaatgtttcttatagaaacattatagaaaagctagtgaaagcttttatccctgtgattaggcatgaaacaaaggtgttcactctcactgctttttttttyctttttttygagacagagtctctttctgtcgctcaggctggagtscagtggtgcgatctcggctcactacaacctctgcctcccaggttcaagcgattctcctgcctmagcctccaa

SEQ ID NO: 8841 - DNA, 317 bp, Homo sapiens
  misc_feature 165: k=g or t
aagtgtttccttttctccacaacctcaccagcatctgctatattttcactttttaagaataaccattcttactgatgtgagatggtatctcattgtggttttgatttgcatttctataacgatcagtgacactgagctttttttcttttttttatttttattttkttatttttttattattattatactttaagttttagggtacatgtgcacaatgtgcaggttagttacatatgtatacatgtgccatgctggtgtgctgcacccattaactcgtcatttagcattaggtatatctcctaatgctatccctcccc

SEQ ID NO: 8842 - DNA, 243 bp, Homo sapiens
  misc_feature 159: s=g or c
  misc_feature 225: s=g or c
ctgtttctttcttaaatataattagatgcgcctcattacctcacactgaaggacttttgtactttttcgagctgtgttttctgagatcttccgtgggcgacggcttgtcgtttccacttgcagttaattgcattagcagctattttccccccgcccctsccgccccggcatatttgtcctctcttctcgctctccccaagatatctggagtcgattttgcgagtscgaaggccacacccagct

SEQ ID NO: 8843 - DNA, 275 bp, Homo sapiens
  misc_feature 146: s=g or c
  misc_feature 149: y=c or t
  misc_feature 151: y=c or t
ccaagttgtttcatatccttataaacactttatattttcttttcgagatggagttttgctcttgttgcccaggctggagtgcagtgctgcggtctcggctcactgcagcctccacctcctgggttcaagtgattctgctgcgtcasctytyaagtagctgggattacaggcgcctgccaccacgcctggctaattttttgtatttttagtagagacggggtttcaccgtgtcagccaggctggtcttgaactgctaacctcaggtgatcccgccc

SEQ ID NO: 8844 - DNA, 149 bp, Homo sapiens
  misc_feature 20: k=g or t
  misc_feature 29: b=c or g or t
  misc_feature 85: s=g or c
  misc_feature 103: k=g or t
  misc_feature 127: s=g or c
gggaagggagggcaggcggkgctggagtbatgtggtggaaacctgctcctgaggaaggggtccgggtggggttggtgcttgtgtsaagggctctgtgcctctktgtactctctcggttcatgttcasaaatcctggccttggtggcatg

SEQ ID NO: 8845 - DNA, 206 bp, Homo sapiens
  misc_feature 81: d=a or g or t
  misc_feature 99: w=a or t
ttcaagcagttctcctgcctcagcctctggggtagctgggattacaggcgtgcgccaccacgcccagctaatttttgtgtdtttagtagagatggagtwttgccatgttggccaggctggtgttgaattcctgacctcgagtgatctgcctgccttggcctcccaaagtgttgggattacaggtgtgagccactacaaccagccat

SEQ ID NO: 8846 - DNA, 310 bp, Homo sapiens
ctttttggactttttcgttattgttgttgttgagacggagtctagctctgtcgcccaggctggagtgcagtgatgggatctcaactcactgcaagctccgcctcccgggttcaagccattcttctgcctcagcctcctgagtagctgggactacaggcacccgccaccacgcccggctaattttttgtatttttagtagagacggggtttcaccgtgttagccaggacggtctagatctcctgacctcgtgatccgcccgccttggcctgcctaagtgctgggattacaggcgtgagcaccgcgcccggc

SEQ ID NO: 8847 - DNA, 183 bp, Homo sapiens
  misc_feature 8: y=c or t
  misc_feature 12: y=c or t
  misc_feature 31: w=a or t
  misc_feature 46: r=a or g
  misc_feature 47: r=a or g
  misc_feature 75: k=g or t
  misc_feature 172: k=g or t
  misc_feature 181: n=a, g, c or t
  misc_feature 183: k=g or t
tgtttgtytgtyttcgttttgtttttgtttwtgttttttaagacgrrgtctagctctgtcacccagactggagtkcagtgacgcaatctcatctcactgcaacctccgcctccccggtcccagctacttggcaggctgaggcaggagaatcgcttgaaccggggaggcggakgttgcagtnak

SEQ ID NO: 8848 - DNA, 280 bp, Homo sapiens
ccctacttttatgttttttttggttgtcgttttctcgtgtttgtttttttgtttttgtttttgttttttgagacagagtcttgctttgtcgcccaggctggagtgcagtggtgtgatcttggccactgcaacctccgcctcccgagttcaagaaattctcctgcctcagcctcccaagtagctgggattacaggtgcgcaccaccatgcctggctaatttttgtattcctagtagggacagggttttaccttgttggccaggctggtcttgaactcctga

SEQ ID NO: 8849 - DNA, 152 bp, Homo sapiens
  misc_feature 8: s=g or c
  misc_feature 123: m=a or c
actggttsacacttaaattcttttttatttttatttatttatttattttttttgagaaggagtcttgctctgtcacacaggctggagtgtagtggtgcaatcttgggtcactgcaacatccgmctcccaggttcaatcaattctcccgctgt

SEQ ID NO: 8850 - DNA, 141 bp, Homo sapiens
  misc_feature 51: y=c or t
tttggtttaaaattaactttttttcttttttttttgagactgagttttgcycttgttgcccaggctggagtgcaatggcacgatctcggctcactacaacctctgcctcccgggttcaagagattctccttcctcacccat

SEQ ID NO: 8851 - DNA, 225 bp, Homo sapiens
  misc_feature 30: w=a or t
  misc_feature 44: w=a or t
  misc_feature 123: m=a or c
  misc_feature 140: r=a or g
cctgaaactttgctggagttgtttatcagwccctaggagcctgwatttttttattttttcatatagtttattacatctcaatttcttagttcaactttggttttgcttattttttttctctamtgctagctttaggcttratttgctattgtatttctagtccatctatatttaatataaaattgttaatttgagatttttctgccttttttgatgtgggcatct

SEQ ID NO: 8852 - DNA, 235 bp, Homo sapiens
tctgcctctgtgttcctcttgatgtctagccacttgtgtctgtgcccgctaggtctcagagcttttataggcacaggatggggggcgtcacggccagggtggtctttgaaaatgcaacatttgggcgccaaaacaggagtgcctgaccacacctaggtccgtgggcacagacccaagggtggagccctcaccagtgaccttgcctttctctacccagcactttcctgccccctac

SEQ ID NO: 8853 - DNA, 233 bp, Homo sapiens
cactctgttgcccagactggagtgcagcgacacaatctcagctcactgcaacatccgcctcctgggttcaagcaattctcctgccttggcctcccaagtagctggaattacaggcacctgccaccacacccagctaatttttgtattttcagtagagagagagtttcaccatgtcggccaggctggtctcaaactcctgacctcaagtaatccacccacctcggcctcccacc

SEQ ID NO: 8854 - DNA, 297 bp, Homo sapiens
attattttgttttgttttgagacagaatctcactctgtcatccaggctggagtgcagtggcatgaacacagcttactacagcctcgacctcctgggcccaagtgatcctcctgctttagcctcccaagtggctgggactataggcatgcaccactaatgcctaatttttaaattttctgtagagacggggcctcactatgttgcccaggcaggtttcgaaatccttggctcaagcaatcctcccaccttggcctcccaaagtgctgggattacagacgtgagccaccacgccctcca

SEQ ID NO: 8855 - DNA, 196 bp, Homo sapiens
  misc_feature 20: v=a or c or g
gccatttgtatatatttgavaaatatctattcaaatacattgcctgctttaaaatactgttattggtctttttatcattggattgtatgagttctttatatattttggatattagtctcttatcagatatattatttgcaaatattttctcccattcttgggacgtctttccactttcttttcttttcttttcttt

SEQ ID NO: 8856 - DNA, 159 bp, Homo sapiens
ttcatgccattctcctgcttcagcctcccgagtagctgggactacaggtgcccaccaccacgcctggctaatttttttgtatttttttttagtagagacggggtttcaccgtgttagccaggatggtctcaatctcctgacctcgtgatccgcccacaa

SEQ ID NO: 8857 - DNA, 280 bp, Homo sapiens
  misc_feature 7: y=c or t
  misc_feature 8: y=c or t
ccctacyyttatgttttttttggttgtcgttttctcgtgtttgtttttttgtttttgtttttgttttttgagacagagtcttgctttgtcgcccaggctggagtgcagtggtgtgatcttggccactgcaacctccgcctcccgagttcaagaaattctcctgcctcagcctcccaagtagctgggattacaggtgcgcaccaccatgcctggctaatttttgtattcctagtagggacagggttttaccttgttggccaggctggtcttgaactcctga

SEQ ID NO: 8858 - DNA, 479 bp, Homo sapiens
  misc_feature 304: n=a, g, c or t
  misc_feature 305: n=a, g, c or t
agtctactcttgtcaccagctgtgctttagctgagtgaacatgagaaactagttctgcttaggagctaatagtggtgccagtcattctaagtgtatccttttttattatttttggaaaggtacctcccttaatcccctctaagcacatatttgtacatgacagaaatttacttgggtggctggtggttttgagctttcaaacatcctgaattataagctttatgaactgctctgctgtgtggcctcctttgttgtcttatgcatttgcctctagtgtttagtagacaaatgtttgcatttaaannacacaccatgaacatacgtggactacatctgcaatttttcttttttccggagacaacgtcttgctctgttgcccatgctggagtgcagtggtatgatcactgctcactgcagcctcaacctctctgactgaagggaatcctcccacctcagcctcccaagtggctgggacaggt

SEQ ID NO: 8859 - DNA, 372 bp, Homo sapiens
  misc_feature 48: k=g or t
  misc_feature 136: w=a or t
  misc_feature 152: w=a or t
  misc_feature 301: n=a, g, c or t
  misc_feature 302: y=c or t
  misc_feature 319: s=g or c
  misc_feature 320: d=a or g or t
  misc_feature 326: m=a or c
tagacattgggtctcactatgttgcccaggctggtctcaaactccttkgctcaaggaatcctcctgcttcgggctcccaatactgctgggattacaggagtgagccacagtgcctgactgctgttgtttttttttwatagtttatattgttwttgagatttatccacattggcgcataactctagttcactcatcttcactcttgtatagtattttattcatgagcattccacagcttatctattcttttctttcttttttaaagagacaaggtctcactttgtttttggggctggagtgnyagtggtgtgatcatagsdcactgmaaccttgaactccgtagaggcacaagccaccatgcctggctaattt

SEQ ID NO: 8860 - DNA, 301 bp, Homo sapiens
tggctcacgcctgtaatcccagcacttttggaggctgaggcgggcggatcacctgaggtcaggagttcgagaccagcctcaacatggggaaaccccgtctctactaaaaatacaaaattagccgggcatagtggtgcatgcttgtaatctcagctactcgggaggctgaggcaggagaattgcttgaacctgggaggcagaggttgcggtgagccgagatcgagccattggactccagcctgggcaacttacatatattaactatagttttaactcgtgtttttttttttttttttttttt

SEQ ID NO: 8861 - DNA, 343 bp, Homo sapiens
  misc_feature 68: v=a or c or g
  misc_feature 99: s=g or c
  misc_feature 125: y=c or t
  misc_feature 285: w=a or t
  misc_feature 293: w=a or t
  misc_feature 297: w=a or t
  misc_feature 298: w=a or t
aatactggctattttctcttctcgccgtagtgccgttggtttcacatgattgcacttttgtgggtcgvaaggtgatacatacgtgtattacttggtcastggatgcagaagtacccattcatcayacctgccccataggtgaaaccctgtctctactaaaaatacaaaaattagctgggtggagggaacaccagtaatcaatactgtattgtccaccagctgagaggccaggctgtggtcgttggttttgtttttttgtttgtttggtttttgttttgttttgtwttgttttwtgtwwttgttttgttttgtttttgagacggaatttcactcttgttgccca

SEQ ID NO: 8862 - DNA, 216 bp, Homo sapiens
  misc_feature 7: m=a or c
tgctacmaggaatctgttttgtcagttttaagatctctggtttttgtttgtttgtttgtttgtttttgagacggagtttcactcttgtcgcccaggctagagtgcagtggtgcgatcctggctcaccgcaacctcctcctcccgcattcaagcgattctcctgcctcggcctcccgagtagctgggattacaggcatgtgccgttacgcccatcct

SEQ ID NO: 8863 - DNA, 271 bp, Homo sapiens
  misc_feature 45: w=a or t
tatcttcactatttaccacttcctctagaatcctttttatttgtwttattttttgagatggagtttcactcttgttgcccaggctggagtgcaaaggtgcaatctcggctcaccgcaacctccgcctcccgggttcaggcaattatcctgcctcagcctcccaagtagcagggattacaggcctatgctaccacacctggctaattttgtatttttagtagagagagggtttctccatgttggtcaggctggtctcaaactcccgacctga

SEQ ID NO: 8864 - DNA, 197 bp, Homo sapiens
agtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgtgccaacc

SEQ ID NO: 8865 - DNA, 209 bp, Homo sapiens
  misc_feature 10: r=a or g
  misc_feature 43: k=g or t
  misc_feature 50: m=a or c
  misc_feature 51: w=a or t
tccaggctgrctcaccgcaacctggaccaccctgcttgttttktgtttgmwtgtttgtttgtttgttttgagacggagcctcgttgttgcccaggctggagtgcggtggcgcgatctcggctcactgcaaactccgcctcccgggttcacgccattctcctgcctcagcctcccgagtagctgggactacaggcacctgtcaccgcggc

SEQ ID NO: 8866 - DNA, 211 bp, Homo sapiens
  misc_feature 116: s=g or c
  misc_feature 132: k=g or t
  misc_feature 141: k=g or t
aacccaggctgaacagcaatgaagcaaccttggttcactgcatcctccccctcctgggttcaagtgattcttccacctcagcctcctgtgtagctgggattacagatgctcaccascacgcctggctaattkttgtatttktagtagagacggttttgccatgttggccaggctggtctcaaactcctgacctcaggtgatccgcctgcca

SEQ ID NO: 8867 - DNA, 149 bp, Homo sapiens
  misc_feature 12: s=g or c
gacagaggacasactttgtttttttgtttgttcttgtttttgtttgagatgcattcttgctctgtcgcccaggctggagtgcagtggggcggtcttggctcactgcgacctccgcctcccgggttcaagcgattctccttactcagcca

SEQ ID NO: 8868 - DNA, 263 bp, Homo sapiens
gtattccatgttgtatatgtgccacattttctttatccagtctaccattgataagcatttaggttgattccatgtctttgctattgtgaatagtgctatagtgaacataaacatgcatttgtctttatggtaaaatggtttatattcctttgggtatatacccagtagtgagattgctgggtcaaataatagttctgttttcagctccttcaggaatcaccacattgttttccacaatggttgaactaatttacactcccacc

SEQ ID NO: 8869 - DNA, 400 bp, Homo sapiens
  misc_feature 378: m=a or c
gcagcagctagtgaattgtttccatgtatttttctattatccaataagtgaactatgctattcctttccagtctcccaagcacttcttgtccccatcaccacttcggtgctcgaagaaaaagtaacaaatcaaggaacacaactaaagaaacacacacacaaaccaaagacaactacagcgtctgcaaaagtttgctagaagactgaaactgttgagtataaggatctggtattctacgatcatgagttcacttcaagagtttgttcaagacatacgtttcgtaaggaaacatcttagttagaagttattcagcagtaggtaccatccctaagtatttttcaccaaatccgtgacaataaagagctatctaaccagamaaattagcgagtaccggcacca

SEQ ID NO: 8870 - DNA, 264 bp, Homo sapiens
ctttctgtcttgatgacctgtctagtgctgtcagtggagtattgaagtcccccactattattgcgttgctgtctatctcatttcttaggtctattagtaattgttttataaatttgggagctccagtgttaggtgcatatatatttaggattgtgatattttcctgttggacaaggccttttaccattatataatgtctctctttgtcccttttaactgctgttgctttaaagtttgttttgatacaagaatagctacccctgc

SEQ ID NO: 8871 - DNA, 230 bp, Homo sapiens
  misc_feature 12: s=g or c
  misc_feature 96: s=g or c
  misc_feature 122: m=a or c
  misc_feature 133: m=a or c
  misc_feature 191: y=c or t
atgtagatattsctggctggatgaccagccacagccagctagcttgagtccaaggcctcctcaggcactgtgtttctgctctgtgggctgcagccscagtggggtggcatgtcacagaggamggccagagggmcaccagccatgccaggggtggggcatagccagactcaggccaaagcacggttgctgcyaggcgctgacaggaagaggagccgcctcagcaggaggaa

SEQ ID NO: 8872 - DNA, 183 bp, Homo sapiens
  misc_feature 12: y=c or t
  misc_feature 15: w=a or t
  misc_feature 18: w=a or t
  misc_feature 19: w=a or t
  misc_feature 76: k=g or t
  misc_feature 182: r=a or g
tgtttgtttgtyatwcgwwttgtttttgtttttgttttttaagacgaagtctagctctgtcacccagactggagtkcagtgacgcaatctcatctcactgcaacctccgcctccccggtcccagctacttggcaggctgaggcaggagaatcgcttgaaccggggaggcggaggttgcagtra

SEQ ID NO: 8873 - DNA, 134 bp, Homo sapiens
taagatggttctggtgttttcttcttttcttgaaacactgtcttgtgtgtgtgaggggggtgatcttttgttcagtcatttttgatagagacattagaagagcgatttctttaaaatataaacaagggtgctct

SEQ ID NO: 8874 - DNA, 186 bp, Homo sapiens
  misc_feature 80: y=c or t
  misc_feature 87: k=g or t
  misc_feature 130: y=c or t
  misc_feature 143: m=a or c
  misc_feature 150: s=g or c
aacaatcctcccacctcaacctcctgagtggctgggactacagatgcatgccaccacacctggttaattttttttttttyctgagakggagtctcactctgttgcccaggctggagtgcagtggcatgayctcggctcactgmaacctcsgtctcccgggttcaagcaattcttctgcctccgcct

SEQ ID NO: 8875 - DNA, 239 bp, Homo sapiens
  misc_feature 144: r=a or g
tgtatttttagaagagatggggtttcactatgttggccaggctggtctcaaactcctgacctcaggtgatcctcccgcctcagcctcccaaagtgctgggattacaggcatgagccaccgagcccagccaggattcatactttraaatgggaatgtggaaatagacattatcctgtaaaatatagttagtgtggcagatcagcaccaaaaatgatttgtgaagcttgtatgtatgggaa

SEQ ID NO: 8876 - DNA, 264 bp, Homo sapiens
  misc_feature 243: s=g or c
ataccctcctttgagctcaatcttagaaatatgtgggactgtactggttttaggtttaggagggtattttgtttgttggtttggtttttgttttgttttgtttttgttttttgagatagagtctcgctctgttgcccaggttggagtgcggtagatgatctggtctcactacaagctccacctcctgggttcaagcaatcctcctgccttggcctcctaaagcgctgggattatgggcgtgasaccacacccagctattcaaag

SEQ ID NO: 8877 - DNA, 166 bp, Homo sapiens
  misc_feature 9: r=a or g
  misc_feature 10: m=a or c
aactttcarmagttaactccccacgtccccatcctgcttgggtttctggacttttctgaggcaccggcagaggggtctcgttgctcccttgagtgtaggggcagccctttaacctggctccttgagtccctgctttttctgcttctgttgccttcttcctcgtctt

SEQ ID NO: 8878 - DNA, 176 bp, Homo sapiens
tatattggtattttcttcctactgtttgctttccataattaaatgtttgtttagcaaccctgtcaggagtgcatgtctatcaaaatttgttttgttttgttttttatttttagattggaacttttggcagaaagtcaaaactgtcttcatatctgtatccttagaaagaggtgaaa

SEQ ID NO: 8879 - DNA, 233 bp, Homo sapiens
  misc_feature 40: k=g or t
  misc_feature 43: k=g or t
  misc_feature 44: k=g or t
  misc_feature 98: m=a or c
acacaatgttattttgatgaatgactcactaatgtctctktakkttctccactctcttaagtccattagcattttccttttaaacttatttgtgagtmtgaggtttgaaactcttttgtttcaagtttcatttggacaaaatcaacctccaagtccccattccaacctcttaaaaagatacatttctataaaatattatttaaatggttttggacattttaaataaaggctgt

SEQ ID NO: 8880 - DNA, 187 bp, Homo sapiens
  misc_feature 39: m=a or c
  misc_feature 53: w=a or t
  misc_feature 122: m=a or c
  misc_feature 159: m=a or c
  misc_feature 165: m=a or c
  misc_feature 166: h=a or c or t
  misc_feature 178: d=a or g or t
  misc_feature 180: s=g or c
  misc_feature 181: s=g or c
ccctgaggagctgggagtacaggcatgcgccaccacacmcggctaatttttgwatttttagtgaaaacagggtttcaccatgttgacccagctgatcttgaactcctgacctcaggtgatcmgcccacctcagcctcccaaagtgctgggattacaggmatgagmhaccacctctgtdcsscatgac

SEQ ID NO: 8881 - DNA, 174 bp, Homo sapiens
  misc_feature 12: s=g or c
  misc_feature 13: m=a or c
cactggggattsmgagggtggtacaggtgctctgtactcttgctcatgaggttttgagtgttctggaaaaggggtttcttttggatgccaaaacaaactggactaggaattatagatttctagaaagcctaaaagtttaagcagttttgtacacacagaagtatagaaggctgt

SEQ ID NO: 8882 - DNA, 361 bp, Homo sapiens
  misc_feature 299: r=a or g
ctccaaaaacagttatattctgaggtactagggggttaaggcttcaacatatgaattttgagcaaacacaattttcttccaaagcattttctctgcttataagccttcagtgtagccgggcacagcggctcatgcctgtaatcacagcatatgggaggctgaggtgggtggatcactttgaggccaggagttcaagaccatcctggccaacatggtgaaaccccatctctactaaagatacaaaaattaactgggtgtggtggcacatgcctgtaatcccagctactcaggaggctgargcaggagaatcccttgaacccaggaagcggaggttgcagtgacacaatatcataccactgca

SEQ ID NO: 8883 - DNA, 185 bp, Homo sapiens
tgcctcagcctcccaagtagctgggactacaggcgtgtgccaccatgcctggataatttttgtattttttgtaaaggcggggtttcaccatgttggccaggctggcctcgaactcctgaccacaggtgatccacccgccttggcctcccaaattgttgggattacaggcaagccaccacgcccca

SEQ ID NO: 8884 - DNA, 272 bp, Homo sapiens
  misc_feature 45: k=g or t
  misc_feature 218: s=g or c
  misc_feature 219: y=c or t
tatcttcactatttaccacttcctctagaatcctttttatttgtkttattttttgagatggagtttcactcttgttgcccaggctggagtgcaaaggtgcaatctcggctcaccgcaacctccgcctcccgggttcaggcaattatcctgcctcagcctcccaagtagcagggattacaggcctatgctaccacacctggctaattttgtatttttasyagagagcagggtttctccatgttggtcaggctggtctcaaactcccgacctga

SEQ ID NO: 8885 - DNA, 176 bp, Homo sapiens
  misc_feature 47: s=g or c
  misc_feature 131: s=g or c
tctctcttggcttcccaaagtgctgggattataggtgagccactgtscctggcccatttttgccaattatattttattttatttctatttctatttattattttgagacagagtcttgctctgttgcctasgctggagtgccatggtgtgatctccgcttactgcaccccccgcta

SEQ ID NO: 8886 - DNA, 181 bp, Homo sapiens
  misc_feature 73: w=a or t
  misc_feature 83: m=a or c
atcatcaaatagaacttctctagttctccattgtctaatttttttttatttgtttgtttgctttttgtttttwttgagatggmgtcttgctctgtcgcccaggctggcgtgcagtggcacaatctcagctcactgcaacctctgcctcccaggttcaagtgattctcctacctcagcctcc

SEQ ID NO: 8887 - DNA, 209 bp, Homo sapiens
atttatagataggggttttgctttagtgcccaggctggtctcaaactcttggctcagtctcccaaaatgttgggattacaggtgtgagccactgcacctggcccattcttgggccttttgttctttctgcctataccattgtacaatttccactgtgaaacttggaggacagggatcaggcaaagtacctaatgtataaaaggagtcct

SEQ ID NO: 8888 - DNA, 165 bp, Homo sapiens
  misc_feature 114: m=a or c
tgtgatctgtgaacatgaactttttttgttttgttttggttttgtttttgttttttgagatggagtcttgctctgttgctgaggctagagtgcaatggcgcaatctcggctcamtgcaaacttcaacctcctgggttcatgcaattctcctgcctcagcctccac

SEQ ID NO: 8889 - DNA, 147 bp, Homo sapiens
  misc_feature 7: w=a or t
  misc_feature 120: w=a or t
  misc_feature 125: w=a or t
tatcacwtctaagagatttctggtgaaacttgtggattttctatacatgacaccatgttttctgcaaatggacaatttgactcctcttttcctatctggatgctttttatttctctctcwttgcwtgatttatttggctaggatttt

SEQ ID NO: 8890 - DNA, 191 bp, Homo sapiens
  misc_feature 43: k=g or t
  misc_feature 178: m=a or c
aataggagataaatttagggttggtttaccttttttgtttttkttacttttatttactttttttaatttttgtagagacaggatcttgctaggttgcccaggctggtctcaaattcctggcctcaagccatcctcctgcctcagcctcccaagtgctgggattacaggtgtgagccamcacacctgggatt

SEQ ID NO: 8891 - DNA, 275 bp, Homo sapiens
  misc_feature 7: y=c or t
  misc_feature 87: s=g or c
  misc_feature 146: s=g or c
ccaagtygtttcatatccttataaacactttatattttcttttcgagatggagttttgctcttgttgcccaggctggagtgcagtgstgcggtctcggctcactgcagcctccacctcctgggttcaagtgattctgctgcgtcasctcccaagtagctgggattacaggcgcctgccaccacgcctggctaattttttgtatttttagtagagacggggtttcaccgtgtcagccaggctggtcttgaactgctaacctcaggtgatcccgccc

SEQ ID NO: 8892 - DNA, 164 bp, Homo sapiens
  misc_feature 120: m=a or c
tgtgatctgtgaacatgaactttttttgttttgttttggttttgtttttgttttttgagatggagtcttgctctgttgctgaggctagagtgcaatggcgcaatctcggctcactgcaamctccacctcctgggttcatgcaattctcctgcctcagcctccac

SEQ ID NO: 8893 - DNA, 196 bp, Homo sapiens
  misc_feature 57: m=a or c
  misc_feature 77: v=a or c or g
  misc_feature 78: v=a or c or g
  misc_feature 89: s=g or c
  misc_feature 90: m=a or c
  misc_feature 95: r=a or g
  misc_feature 97: w=a or t
gctggggttggcgagttcacccgcggcggagggtaactttgctgtgctgttttttgmgcagttgtctggtccctggvvgtgtagcatcsmgagartwttctaattacgtttacaaaatatcttccctttggccatacaagtggtgactgccatgtcgaactcgcggcccaggtcccgccgagacgccgggggtggc

SEQ ID NO: 8894 - DNA, 207 bp, Homo sapiens
  misc_feature 30: k=g or t
  misc_feature 37: k=g or t
  misc_feature 42: b=c or g or t
  misc_feature 64: d=a or g or t
  misc_feature 69: m=a or c
aaattatcacacttaaggaaattctccatkttatttkatttbatttttgagacagggtcttgcdctgtmaccctggctggagtgcaatggtgcagtctggctcactgcaacctccacttcttgggttcaaacagttctcctgccttagcctcctgagcagctgtggctagaactgtaggcacaccccactgtgcctggctaaccttt

SEQ ID NO: 8895 - DNA, 218 bp, Homo sapiens
  misc_feature 8: y=c or t
  misc_feature 100: m=a or c
  misc_feature 132: m=a or c
acactgtytgttgacttctgctgttagaccatctgttttttcttttcttttttttttgacagggtctgactcggtcacacaggctggggtgcagtggcgmaatcgtggcttactgcatcctccacatcccamagcttgggtgattctcccttcttagcctcccgagtagctgagactacaggtgcatgccatcacgcttttttttttttttttttttt

SEQ ID NO: 8896 - DNA, 285 bp, Homo sapiens
  misc_feature 180: v=a or c or g
tctttagtcctgtttatatgatgaatcacatttattgatttgcatatgttgaaccatccttgtatcccagggataaagcctacttgattgtaatggataagcttcatgatgtgctgctgaatttggtttgccagtattttgttaaggatttttacatcaatgttcattgagaatattggvctgaagttttcttttttgttgttgcatctctgccaggttttgctatcaagacgagctggtaccattcctactgaaacaattccaaaaaaattgaggaggagagac

SEQ ID NO: 8897 - DNA, 254 bp, Homo sapiens
ttcggacatgcgcgctcggagcaaggcgccctcgcactcagcttaccgcgcatgtacgttgccaggggtaacgcaggtagccaaagtggcttgtggagtggcgaccgttagtgaggcggttgctgagacagacgctgaggcgggtaggaggagcccgagccgtaagggaagccgtgatgagggccgtgttgacgtggagagataaagccgagcactgtataaatgacatcgcatttaagcctgatggaactcgg

SEQ ID NO: 8898 - DNA, 152 bp, Homo sapiens
ttttgtttttgtttttaagaaacagggtctcattctgttgtccaggctggagtgcagtggcacaacggtagctcactgcagcctcgaactcctgggtttgaatgatcctcccacctcagcctcccaagtagctaatacaggtgcatgccaca

SEQ ID NO: 8899 - DNA, 140 bp, Homo sapiens
gtaacctcaaactcctgggctcaagccatccccccatctcagcttcccaaacagctgggactacaggtgcatgccaccatgcctggccaatttttaaaaatttttcttgctatattgccaaggtcttgaaccccttgccc

SEQ ID NO: 8900 - DNA, 449 bp, Homo sapiens
cttgtaaatatgttcaagttccttgtagactctggatattagatgcctgtcagatggatagattgcaaaatttttctccctttctgtaggttgtctgttcactctgatgatagtttcttttgctgtgcagaagctctttagtttaattagatcccatttgtcaatttattttgctgcaattgtttttgttgcacttgcttttggcattttcatcatggaatctttgcccatgcctatgtcctgaatggtattgcctagattttcttctagggtttttatagttttgagttttacatttaagtcttgaatccatcttgagttaatttttgtataaggtgtaaggaagaggttcagcttcaattttctgagcatggctagccagttctcccagcagcatttactaaatagggaatcttggttttttttgttttttgttttttttttgagac

SEQ ID NO: 8901 - DNA, 283 bp, Homo sapiens
  misc_feature 141: k=g or t
  misc_feature 170: n=a, g, c or t
  misc_feature 171: n=a, g, c or t
  misc_feature 203: y=c or t
  misc_feature 224: m=a or c
  misc_feature 225: v=a or c or g
  misc_feature 229: r=a or g
aagtgactgaaggtatgcccttccaaagtagtactgagctaatggctaaagtttgtcaagcccatccaagcacattttttcgtaatttttatttatttatttttttaagacagagtcttgctctgttgcccaggctgggakacagaggttgcagtaaaccgagatcacannactgcactccagcctgggcaacagagcaagaytctgtcttaaaaaaataaatmvataraaattacgaaaaaatgtgcttggatgggcttgacaaactttagccattagctca

SEQ ID NO: 8902 - DNA, 170 bp, Homo sapiens
caaaaattggccgggcatggtggtgtgtgcctgtggtcccagttgctccggaggctgaggcaggagaatggcttgggcccgggaggcggagattgcagtgagctgaggtcgtgccactgtactccagcctgggtgccagagtgagactccatctcaaaaaaaacccccta

SEQ ID NO: 8903 - DNA, 333 bp, Homo sapiens
  misc_feature 76: s=g or c
  misc_feature 122: s=g or c
  misc_feature 181: s=g or c
  misc_feature 277: y=c or t
agaggatcccggccagccagcgtgaggaaagctctgctccctgccagaccggccagctgtggaaacccagcggggsttgcagcagagcggaggggcccaccccgttcttcctcatttcccasccctggtgtgggatttggggggctcctgggcagagtgcgaactccggagccgaggccastggatccccagtgactgctcgggggggtcccgctgcgtggagatgccggcagcacgtcggttccctggcctggagctctccttccctctcctggcyagactgcggcgacgcctgtacacaaggctgggaggcggcagaatgcagccagagga

SEQ ID NO: 8904 - DNA, 435 bp, Homo sapiens
  misc_feature 342: v=a or c or g
  misc_feature 403: d=a or g or t
gtgttcatgttgtgtgtgcgtttgtgtgcacacacgtgtgtctgggcaggtgtacatacctgcatgtgtacacaagtgtatttgtgtgtgcatgcccatgtctgtcccatgtctgtgcacatgtgtgcatacgtgtttggcggggtgcatacttgtgccaggcactttgctggggattttttcaaacgtcattcatgtgacttatgatctgctgggaacaggcattgctatcttgaccacagataaggacacagcctgcagatgagtggacagtagaaaaggcccaagttgtgaggtcttgcagacccaccttggggtctgaggagtttgaggaggtaagtvaaagtcatgtgcctttcaggggtctgtgtcctcatctgtggtcaagatagcaatgcctgtdcccagcagatcataagtcacatgaatgacgtt

SEQ ID NO: 8905 - DNA, 147 bp, Homo sapiens
gttttcatacttgcctattccagcttcactttgcagtttactttggtggttttgactttgtcgtcattagtaaatcagctgttaagaaaacatgaaagtcttgatgtttcattgggatatcctctaattttcgtttttgaagttttt

SEQ ID NO: 8906 - DNA, 217 bp, Homo sapiens
tctgttcactctgatggtagtttcttttgctgtgcagaagctctttagtttaattagatcccatttgtcaattttggcttttgctgccattgctttttgtgttttagtcatgaagtctttgcctgtgcctatgtcctgaatggtatcgactaggttttcttctagagtttttatggttttggattttacatttaagtcttaatccatcttgagttaa

SEQ ID NO: 8907 - DNA, 140 bp, Homo sapiens
  misc_feature 20: n=a, g, c or t
agtctcgctctgtcgctcangctggagtgcagtggtgcgatctctgctccctgcaatctccgcctcccgggttcacgccattctcctgcctcagcctcccgagtagctgggactacaggcacctgccaccacagccggca

SEQ ID NO: 8908 - DNA, 171 bp, Homo sapiens
ctaatatttgtatttttagtagagatggggttttgccatgttggccaggctagtttcaaattcctggcctcaagtgatctgcctgcctcagcctcccaaagtgctgtgattacaggcatgcgccacggtgccccgctgagacttttctccaatgtgaccttctcagccagt

SEQ ID NO: 8909 - DNA, 191 bp, Homo sapiens
gaacacagactctggcctgtgctgcagtttttctttctttcttttcttttttgagacggagtcttgtcgcccaggttggagggcagtggtgcgatctcggctcactgcgagcttcacctcccgggttcacaccattctcctgcctcagcctcccaagtggctgggactgcaggcacccgccaccacgtcca

SEQ ID NO: 8910 - DNA, 152 bp, Homo sapiens
ccctacctaatgctgtgcatttacagagaagtcttaggggattgttagccaaactgaatagaggactactctatttttccccttttcttgtcttccttctctttttttttcctaatttatttattcaagaagtagttactgaacgccaacta

SEQ ID NO: 8911 - DNA, 202 bp, Homo sapiens
gatccagttttcattcttctacatgtggcttgccaattatcccagcaccatttgatgaataggatgtcctttccccactttatgttattatttactttgttgaagatcagttggctatataactatttggctttagtactaggttttctattccgttccattgctttacatgccaccatgccccgctagttttttgtttttt

SEQ ID NO: 8912 - DNA, 162 bp, Homo sapiens
ctccattcaggaatacatacggcaactgcctcctaattttccctacagagatgatgtcatgtcagtgaatcctacctgtttggtccttattattcttctgtttattagcattatcttgacttttaagggttacttgattagctgtgtttggaactgctacct

SEQ ID NO: 8913 - DNA, 392 bp, Homo sapiens
  misc_feature 25: k=g or t
atatctttccattcatttgtgtatkcttcaatttctttcatcagtgtttcacagttttcattgtagagatatttcacctctttggttaaatttattcctaagcattttattttgtgcagctattataataggattgttttctagatttctatttcagatagttttccatcaccatacagaaatgctactaatttttatatgttgattttgtatcccacaactttactgagtttgtttattagttctagtagtttttttggtggagcctctaggattttgtatatacaagatcacgtcatctgtaaacacgtaaaatctaacttctttattcccactttggatgacttttatttctttctcttgccaaacccacagctagcatcatactgaat

SEQ ID NO: 8914 - DNA, 264 bp, Homo sapiens; identical to SEQ ID NO: 8870

SEQ ID NO: 8915 - DNA, 197 bp, Homo sapiens
tgtgcattctaccatttatttatttttatgtttttttttcccccaacttttatgtttggggatacatgtggaggatgtgcaggtttgttacataggtaaatgtgtgacatggtggttcgctgcatggttcatcccataacccaggtattaatcccagcatccactagctattcaccctgattctccccccccttcca

SEQ ID NO: 8916 - DNA, 174 bp, Homo sapiens
ccctgggaagcctctccttctgtgcatattattactgaaattcttcaaaagattttgaggcactcacggcatttcattgctactttaattttcattattatgggattgattgctgtcacagctactgctgcagtagctgggagttgctttgcattccacagtacaaacagcaga

SEQ ID NO: 8917 - DNA, 182 bp, Homo sapiens
  misc_feature 122: w=a or t
  misc_feature 123: k=g or t
tgtttgtttgttttcgttttgtttttgtttttgttttttaagacgaagtctagctctgtcacccagactggagttcagtgacgcaatctcatctcactgcaacctccgcctccccggtcccwkctacttggcaggctgaggcaggagaatcgcttgaaccggggaggcggaggttgcagtga

SEQ ID NO: 8918 - DNA, 197 bp, Homo sapiens
  misc_feature 151: w=a or t
tgtgcattctaccatttatttatttttatgtttttttttcccccaacttttatgtttggggatacatgtggaggatgtgcaggtttgttacataggtaaatgtgtgacatggtggttcgctgcatggttcatcccataacccaggtattawtcccagcatccactagctattcaccctgattctccccccccttcca

SEQ ID NO: 8919 - DNA, 412 bp, Homo sapiens
  misc_feature 250: d=a or g or t
  misc_feature 251: n=a, g, c or t
  misc_feature 252: n=a, g, c or t
  misc_feature 253: b=c or g or t
  misc_feature 335: h=a or c or t
  misc_feature 394: v=a or c or g
gaacatgcagtgtttggttttctgttcctgtgctggtttgctgaagataatggcttccagttccatccatgtctctctcagggacataatctcatttctttatatggctgcatagtattccatggtgtatatgtgccacattttctttatccagtctaccattgatgggcatttgggttgattccgtgtctttgctattgtgaatagtgctgcaataaacatacgtgtgcatgcattttataatagaatdnnbtatattcctttgagtatatatccagtaatgggattgctgggtcaaatggtatttctggttctagattcttgaggaatcgcthactgtcttccacaatggttcaacaaatttgcattcccaccaacagtgtaaaagcattcvtatttctccacatcctct

SEQ ID NO: 8920 - DNA, 187 bp, Homo sapiens
  misc_feature 149: w=a or t
  misc_feature 152: y=c or t
ctcggctcactgcaacctccgcctccctgggttcatgcgattctcctgcctcagcctcccaagtagctgggattacaggcatgcgccacgatgcctggccaattttgtatttttagtagagacagggtttctccatgttgttcagggtwgtyttgaacttctcggcctcaggtgatccacccaactc

SEQ ID NO: 8921 - DNA, 151 bp, Homo sapiens
  misc_feature 126: k=g or t
  misc_feature 130: k=g or t
  misc_feature 132: k=g or t
  misc_feature 134: k=g or t
  misc_feature 137: w=a or t
atacataatgtcttccattttgggtgtctcatcctcatggtggtatttatattatggctattgtatatttgttaaaaagtgctctttttgcagtttcctgttccttgcctgtatttttcaaggctkttckcktkatwcaaacacacaaagc

SEQ ID NO: 8922 - DNA, 161 bp, Homo sapiens
  misc_feature 121: y=c or t
acatttgcacttcagtcagtttatctttttattttattttattattattattattattttttgagacggagtctcgctctgttgcccaggctggagtgcagtggtgcgatctcggctcacyggcaagctccgcctcccaggttcacgccattctgctgcca

SEQ ID NO: 8923 - DNA, 190 bp, Homo sapiens
  misc_feature 122: w=a or t
ctgtaattaaatatttttcttttcttttttttccttttcctgatagatatgtaagcagctatctacatgcaatctttggcttcttttttcttttctttttttttggagatggaatctcggcwgtgtcacccaggctggagtgcagtggcacaaactcggctcactgccactcccgtctcccaggtccagc

SEQ ID NO: 8924 - DNA, 304 bp, Homo sapiens
  misc_feature 110: h=a or c or t
  misc_feature 116: d=a or g or t
  misc_feature 117: r=a or g
  misc_feature 119: w=a or t
  misc_feature 124: m=a or c
  misc_feature 130: n=a, g, c or t
  misc_feature 143: w=a or t
  misc_feature 170: r=a or g
  misc_feature 249: y=c or t
  misc_feature 293: m=a or c
  misc_feature 295: n=a, g, c or t
  misc_feature 302: m=a or c
tgttttttgtttttttgtttttgagatggagtcttgctctcttgtccaggctggagtgcagtggcgctatctcggctcactgcaacctccgcctcccaggtccaagcaghccttcdrcwtcggmctccgnaggagctgggacwataggcgcgtgccaccacgcctgtctrattttttgtatttttagcggagacggggtttcaccttgttagccaggatggtcttgatctcctgacctcgtgatctgcytgccttgacctcccaaagtgctgggattacaggcatgagccacmangcccgamtt

SEQ ID NO: 8925 - DNA, 394 bp, Homo sapiens
acttgctttatgaatctgggtgttcctgtatttggtgcatatatatttaggatagtttgctcttcttgttgcattgatcccttcgccattatgtaatgcccttctttgtcttttttgacctttgttgttttaaagtctgttttatcagagactaggattgcaacccttgtaaagcaggggaaggtgctcaaaagagcaacattattagcattattattttttagagacagggtctcactctgtcgcccaggctggagtgcagtggcatgatctcggctcactgcagcctcaacctcctaggctcaacggatcctcccacctcagcctcccaagtagctgggaccacaggcaggtgccaccgtgttcagccagtttttgtatttttagtagagat

SEQ ID NO: 8926 - DNA, 373 bp, Homo sapiens
  misc_feature 117: r=a or g
  misc_feature 118: s=g or c
  misc_feature 121: n=a, g, c or t
  misc_feature 292: n=a, g, c or t
  misc_feature 293: n=a, g, c or t
  misc_feature 294: b=c or g or t
  misc_feature 296: m=a or c
  misc_feature 302: m=a or c
  misc_feature 338: s=g or c
  misc_feature 360: r=a or g
  misc_feature 368: v=a or c or g
gtaaaggggaaaaaaaaaggtctaggcccggtacggtggctcattcctgtaatcccagcactttgggaggctgaggcggggagatcacctgaggtcgggagttcgagaccagcctgrscancatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaaggaagnnbamgaaagmagaccaagtccctgcctcgcagagctcacgatttastggaaatggcatccaataatartgaataavtataa

SEQ ID NO: 8927 - DNA, 170 bp, Homo sapiens
  misc_feature 154: k=g or t
  misc_feature 155: s=g or c
caaaaattggccgggcatggtggtgtgtgcctgtggtcccagttgctccggaggctgaggcaggagaatggcttgggcccgggaggcggagattgcagtgagctgaggtcgtgccactgtactccagcctgggtgccagagtgagactccatcksaaaaaaaacccccta

SEQ ID NO: 8928 - DNA, 203 bp, Homo sapiens
gtctcactgtttcgccgaggctggagcacagtggtgcgatcttggctcactgcaacctccattctcctgcctcagcctcccaagtagctgggactacaggcgcccgccaccacgcccagctaattttttgtatttttagtagagatggggtttcaccgtgttagacatggtctcaaactcctgacctcatgatccgcccacaa

SEQ ID NO: 8929 - DNA, 398 bp, Homo sapiens
  misc_feature 61: h=a or c or t
  misc_feature 90: y=c or t
  misc_feature 267: y=c or t
  misc_feature 292: s=g or c
  misc_feature 317: m=a or c
  misc_feature 355: m=a or c
  misc_feature 396: s=g or c
cagtatacggcgttgtcaggtgattttgcccaactgtaagctaaggtaagtggagcatgthtaaaggaggctaggctgagcgatgatgtycagtaggtttgggtaatattttcaacttaggatgaatttatcagaacataatcccattgtaagtcaaggaggatctatagtgtatcagcgttgttaatgttttgacatgaggttattttcacatttggtttgtgttttattattattattattattatttttttttttgagacagaytcactctgtcacccagactggagtscagtggcgtgatctcggctcactamaacctctgcctccccgcttcaagtgattctcatgcctmagccttctgagtagctgagattacaattatgtaccacccasgc

SEQ ID NO: 8930 - DNA, 179 bp, Homo sapiens
  misc_feature 130: d=a or g or t
aattcctttttcttttttttctttttttgtgagacagagtctcttgctctgtcacccaggctggagtgcagtggtgcgatcttggctcaccacaacctccacctcccaggttaaagcgattctcctgtcdcagcctccctgagtagctgggattacaggcatgcgccaccacacccggc

SEQ ID NO: 8931 - DNA, 158 bp, Homo sapiens
  misc_feature 119: m=a or c
catatacattttaaaatttttttcagacactgcaccaggctggagtgcagtggagtgatcacagctcactgcatccttggactcctgggatcaagcaatcctcctgcctcagcctcccmaagtaactgggactgcaggcatacaccaccacacccagc

SEQ ID NO: 8932 - DNA, 241 bp, Homo sapiens
  misc_feature 117: w=a or t
  misc_feature 118: y=c or t
  misc_feature 119: y=c or t
  misc_feature 144: v=a or c or g
  misc_feature 208: m=a or c
  misc_feature 227: y=c or t
caggctggagtgcagtagtgcactccggctcactgcaggcttgacctcctggggctcaagccgtcctcccaccccagcctccgtagtagctgggactacaggtgtgtgccaccacawyygggctaatttttgtatttttagtgvagatgaggtttcagtatgttggtcaggctggtcttgaacccctgacctcaggtgatctgcctgmctcggcctcccaaagtacygggattacaaggat

SEQ ID NO: 8933 - DNA, 167 bp, Homo sapiens
agctgcgctgcgactgctctggaaggagaggacggggcacaaaccctgaccatgaccccccacaggctgctgccaccgctgctgctgctgctagctctgctgctcgctgccagcccaggagggcgccttggcgggtgcccaggctgcgggcaaggggtgcaggcgaa

SEQ ID NO: 8934 - DNA, 167 bp, Homo sapiens
  misc_feature 107: k=g or t
  misc_feature 117: k=g or t
  misc_feature 118: v=a or c or g
  misc_feature 119: m=a or c
  misc_feature 125: k=g or t
  misc_feature 134: k=g or t
tgtgatctgtgaacatgaactttttttgttttgttttggttttgttatttgttttttgagatggagtcttgctctgttgctgaggctagagtgcaatggcgcaatckcggctcactkvmaacctkccacctcckgggttcatgcaattctcctgcctcagcctccac

SEQ ID NO: 8935 - DNA, 157 bp, Homo sapiens
  misc_feature 124: w=a or t
  misc_feature 150: m=a or c
aattttttttgggatggagttttgctcttgttgcccaggctggagtgcaatggggcgatctcagctcaccgcaacctccacctcctgggttcaggcgattctcttgcctcagcctcctgagtawctgggattataggcgtccaccaccamgcccggt

SEQ ID NO: 8936 - DNA, 259 bp, Homo sapiens
ccttctttttctcacagtttttgtcttgaaatctattttttctgatattaagtatagcagttattgctctattttggctcccattgaaatagaatatgtattcacatccttttattttcagacaatgtatgtccttgtaggtgaaaagtgtttcttctgggatcaatggttcttgctttcttatccattcagtctgtgtctttcaatgacaagagtgagtccttctatatcaataataacattgaatgtaaattgacta

SEQ ID NO: 8937 - DNA, 204 bp, Homo sapiens
cctaatattttatttataccgtcttatttatttttatttttattttttgtgacagggtcttgctctgttgcccaggctaggcaacatgacaaaaccccatctctactaaaaatacaaaagttagctgggcgtggtggcctgcccctgtagtcccagctactcaggcggctgaggtgggaggatcacctgagcctagaaggtcaa

SEQ ID NO: 8938 - DNA, 135 bp, Homo sapiens
gaattttcttcttctgctcaggctggagtacaatggcacaatcatggttcactgtaatcttgaactcctgggctcaagttataatcccatctcagcctctccagtagctaggactatatcatgccccgctattgt

SEQ ID NO: 8939 - DNA, 257 bp, Homo sapiens
ttatttgattatggccataattgaaggagtgaggtggtattgcattgtggttttgatttgcatttccctgataattagtgatgctgagcattttttcatgtttgttagctatttgtgtatcttcttttgagaattgtctattcatgtccttagcacactttttgatggggttgtttggttttttcgagttccttgtagattatggatattagtcctttgtcagatgtatagattgcaaagattttctccccctccca

SEQ ID NO: 8940 - DNA, 134 bp, Homo sapiens
tttttattgtttattttttttttgggttggcagttttgctcttgttgcccaggctggaggcacaatgtcatgatcttggctcactgaaacctccacctccggggttccggctattctcctgcctcagccccccc

SEQ ID NO: 8941 - DNA, 204 bp, Homo sapiens
  misc_feature 130: r=a or g
tattttaagctttttaaaaattatatttatttttttattttgagatggagttttgctcttgtctcccaggctggagtacagtggagtgatctcagctcactgcaacctccccctcccgggttcaagcaartctcctgcctcagcctcctgaatagttgtgattacaggcgtctgtcaccacaaccagctatttttttttttttt

SEQ ID NO: 8942 - DNA, 394 bp, Homo sapiens
  misc_feature 103: y=c or t
  misc_feature 104: y=c or t
  misc_feature 105: w=a or t
  misc_feature 106: w=a or t
  misc_feature 126: w=a or t
  misc_feature 128: w=a or t
  misc_feature 131: w=a or t
  misc_feature 132: w=a or t
  misc_feature 139: w=a or t
  misc_feature 328: n=a, g, c or t
  misc_feature 329: n=a, g, c or t
  misc_feature 330: n=a, g, c or t
  misc_feature 331: k=g or t
tcttctttgaatacatactcaaatcctttggacactttttttctcaattatttgtttttttataatgttgcaagagttctttatatattctggatattagtcyywwatgggatatatgatttgcawtwttwwctctccwttctctgagttgttttcacttccttgatgaagtgtcgtttaaaacaaaaacttaatttttttttatttttgagacagggtcttattccattgggcaagctggagtgcagtggcatggtcatggctcactgcagcctcggcgtcctgagctcaagtgatccttcccacctcagcctcccaagtaactggnnnktacagctgtgcaccaccatgcctggttaatttgtaaaaatttttttagagacagagcctcacc

SEQ ID NO: 8943 - DNA, 208 bp, Homo sapiens
  misc_feature 122: k=g or t
  misc_feature 147: d=a or g or t
  misc_feature 148: r=a or g
cttagaaatgcttttgctgtattccataggttttgttttgttttttttatttttttatttttttattattatactttaagttttagggtaatgtgcacattgtgcatgttagttacgtatgkatacatgtgccaatgctggtgcgcdrcacccactaactcgtcatctagcattaggtatatctcccaatgctatccctaccccctca

SEQ ID NO: 8944 - DNA, 214 bp, Homo sapiens
  misc_feature 172: w=a or t
ccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttwttgttgcccacatcctgttttcacccctgagctgtttctctt

SEQ ID NO: 8945 - DNA, 240 bp, Homo sapiens
  misc_feature 202: r=a or g
  misc_feature 203: n=a, g, c or t
gaagaagtctcattctgttgcccagactggagtgcagtggcgcaacctcggctcactgcaacctccacctcccagattcaagcgattttcctgcctcagcctcctgagtagctgggcctacaggcaccctccaccatgcctggctaatttttgtacttttagtagagacggggtttcaccatgttggccaagctggtctcarnctcctgatctcaggtgatccacctacctcggccttcc

SEQ ID NO: 8946 - DNA, 176 bp, Homo sapiens
  misc_feature 140: r=a or g
tttttgtttttgttttgttttgttttgttttgttttgttgagatggagtctcgctctttcgcccaggctggagtgcagtggcgcgatctcggcccactgcaagctcgtcctcccgggttcatgccattcccctgccttarcctacccagtagctgggactactggcgcccaccacc

SEQ ID NO: 8947 - DNA, 233 bp, Homo sapiens
  misc_feature 131: m=a or c
  misc_feature 141: k=g or t
  misc_feature 151: w=a or t
  misc_feature 170: m=a or c
  misc_feature 171: k=g or t
aaatgtcatcttgtttaagtgtacatgtttaatgcctaaaagtattctgaaagtatgtgcattaaaaagcactctaggaggcgcagtggctcacgcctgtaatcccagcactttaggagcccaagatgggmggatcacttkaggttcaagwagttcgagaccagcctggmkaacatggtaaaaccccgactctactaaaaatagaaaaattagccaggcatggtggcaggcac

SEQ ID NO: 8948 - DNA, 380 bp, Homo sapiens
  misc_feature 148: r=a or g
  misc_feature 228: r=a or g
tccacgagttgaagcaattctccctcctcagccttccgagtagctgggactacaggcgtgcgccaccacgcctggctaatttttgtacttatttatttttgagaaggagtttcactcttgttgcccaggctggagtacagtggtgtgraacttgctcactgcaacctccgcctcctggattcaagcgaatctcctgctcagcctcccgagtagctggcattacaggtrcccacgaccacacccagctaatttttggatttttggtagagacagggtttcaccaaaaatccaaaaattagctgggtgtggtcgtggtgcatccctctgatcccagctagtcaggaggctgaggcaggagaatcgcttgaacctggaaggca

SEQ ID NO: 8949 - DNA, 230 bp, Homo sapiens
  misc_feature 137: r=a or g
  misc_feature 139: w=a or t
  misc_feature 141: s=g or c
  misc_feature 146: s=g or c
  misc_feature 147: m=a or c
  misc_feature 170: r=a or g
  misc_feature 180: w=a or t
  misc_feature 227: m=a or c
catttatttttgccaatattaattttccctgcttttccacagacatcagttactattcttagcctaaaactcagttctctccaaactgctgaacccattctgattaagcaggcaatacatatattagcagtcttgargwasgaagsmaggacttgaactctggaaccaarattgaagacwagctgaaacagggaagaagtgaaagcacctctgttagacacacccamcaa

SEQ ID NO: 8950 - DNA, 189 bp, Homo sapiens
  misc_feature 112: w=a or t
cttgttgggaaagctattttagcacctctgataaacagaaaaaaaaaaggtgattattcctgtttcaagctatctaactttctcactttgtctgccttttctaatcaatgtwatcatgtgctggcaaaatcttgtaaaattcagaaaggtaaaatccagggaaatgaaacccagggacagcaactcccc

SEQ ID NO: 8951 - DNA, 161 bp, Homo sapiens
ctgcatgagagagattcctttttgttgttgttttgttttgtttttgtgacagagtctcggctctatcacccagcctggagtgcagtggctccatctcagctcactgcaacctccgcctcccaggttcaaccaatacctcagcctctggaatggctgggatc

SEQ ID NO: 8952 - DNA, 284 bp, Homo sapiens
atcaggagggcattaggcaacgttttacatgtatgagctcaaatgtggccccagctctgacctttcttgctgttgtggctctgggcaggtcgcggctgcactcggggcctcagtttcccccactgggcatgaggatttcaagaaaaattccctctagctggaggacactctgtgtgcaaatgcctggaggtgtgtttagaagtggtttggaccccttgactggaatggagtagggggaatcctgttttgccctatgcctcatacagatcagagggtgggaacct

SEQ ID NO: 8953 - DNA, 239 bp, Homo sapiens
  misc_feature 163: d=a or g or t
ggggcctagcatccactccacatcctttaaaaatagcactcttacttccttttccgggaattacctgtaccccatgcattataacgtggtggcatatcaaagaactctgcacctccccctcaactcccaagcaaggagcacatgccctaagagaagttgattdgaatttcaatgataagcaaagtgataaaaacactaaaaacggatggagcctatcaattccagtggtggcccccgct

SEQ ID NO: 8954 - DNA, 445 bp, Homo sapiens
  misc_feature 123: n=a, g, c or t
  misc_feature 248: w=a or t
  misc_feature 249: n=a, g, c or t
  misc_feature 250: k=g or t
  misc_feature 251: y=c or t
  misc_feature 342: n=a, g, c or t
  misc_feature 343: n=a, g, c or t
  misc_feature 370: k=g or t
  misc_feature 371: n=a, g, c or t
atctcagagatttttggtttgtatctttgttttcatttatttcaaattttttttgtgatttctgccttaatttcattgtttaaccaaaagtcattcaggaacaagttgtttaatttccatagnattatgtggtttttagacatcttcttggtattgatttctatttttattttcatttcactgtggtctgagagtgtggttggtatgatttctatttttcaaaatttatcgatacttccttgtggccwnkyatgtagtcaatcttagagtatgtttcatgtgtgaatgagaagaatataaactctggttactgggtgaaatattttgtagatatctattagnncaaattagtcaattgtgagatttccakntagaatttttgtgttagttttcagcctcaatgatctgtctgtcactgtcagttggatgtcatagtcccccactt

SEQ ID NO: 8955 - DNA, 362 bp, Homo sapiens
  misc_feature 10: k=g or t
  misc_feature 194: w=a or t
  misc_feature 323: n=a, g, c or t
  misc_feature 324: n=a, g, c or t
  misc_feature 325: n=a, g, c or t
attaattatkctttttcacagagccataccttagaatgcacttaggcatctccagaatcctaagcaaaggaggcaaagggagggccatattgttagttaatgtggtcatggggagtctagcagagccaaaatatatccgtgccaacacccaaggtgaaggactccagagagaaactacaagccttattgagaawgtaagaagctactagacctttcctgctgtagttatgaatatcttcatcctgcagcccagccttgcccagaccctgagcccagacagacctgctcccaagagcagctgggctctgcaattaccctgcagnnngaagctccaggtacatccctagggagccagcccctta

SEQ ID NO: 8956 - DNA, 255 bp, Homo sapiens
ctgattatttcttttgctgggcagaagtctatttatttttgtttttgttgcatttgttttggggttcctggtcagaaactctttgcctaagcagatgtctagaagagttttcccaacattatcttgtagaatttttatggttttgggccttagatttaagtctttgatccaccttgagatgagtttcatataaggtgagagatgaggatcccatttcattcttctacatgtggcttgccagttatcccagcacct

SEQ ID NO: 8957 - DNA, 234 bp, Homo sapiens
  misc_feature 132: w=a or t
  misc_feature 137: y=c or t
  misc_feature 142: m=a or c
cgcttcagtattaaggctagatcagagagtttcgttctgttgctgttgctcaatcaatttatgtcgttacatcgtttgtggatcatggctatgtgcctggtctttggccaggagaaggggcaggaaaagtgwtaagyacgamgaatgactaacacaggaccctgtcctttaggagttgatgtacgtgatgaattagtcaagtcatgcatggtggtgagggccatacaaggggta

SEQ ID NO: 8958 - DNA, 186 bp, Homo sapiens
  misc_feature 136: r=a or g
  misc_feature 137: r=a or g
  misc_feature 146: r=a or g
  misc_feature 186: r=a or g
aaggtcagccctccctgcctgtttgtttttgcctccgctcttgccctcaggtgggaccgagccaggtgaggggagggggctgaagggccatttcttatcagggtccccggccccggccgtggcgtcggggcggtcrrtggcggcartgggggtggcagaaactccttccgaagcccccggcgccar

SEQ ID NO: 8959 - DNA, 214 bp, Homo sapiens
  misc_feature 17: w=a or t
  misc_feature 123: w=a or t
  misc_feature 125: k=g or t
  misc_feature 150: w=a or t
  misc_feature 154: w=a or t
taatcagagaacttggwtttagggtttctgggctctgctttccaaggtttgaggctctaaaaagagatgcaacatgtttctgttcccagcatatttttaactttgaagcttttttttcttttwtkcttttttttgagacaggattttgcwgtgwcactcaggctggagtgtagtggtgcactgcagcctcaacctgcctgtggttccagctact

SEQ ID NO: 8960 - DNA, 177 bp, Homo sapiens
tttaaaatttttttattttttatttttgagatggagtttcctcttgttgcccaagctggagtacagtggcgcgatctctgctcactgcaacctccgcctcctaggttcaagcaattctcctgcctccgcttcccaagtagctcgtattacaggtggatgccaccatgcccggctcct

SEQ ID NO: 8961 - DNA, 180 bp, Homo sapiens
  misc_feature 102: w=a or t
  misc_feature 118: d=a or g or t
  misc_feature 143: k=g or t
  misc_feature 149: w=a or t
  misc_feature 154: k=g or t
ttacagtgtcaatcttagatctttcctgctttctcttgtgggcatttagtgctataaatttctctctacacactgctttgaatgtgtcccagggattctggwatgttgtgtctttgtdctcgttggtttcaaagaacaccttkatttcwgcctkcatttcgttatgtacccagtagtcat

SEQ ID NO: 8962 - DNA, 203 bp, Homo sapiens; identical to SEQ ID NO: 8928

SEQ ID NO: 8963 - DNA, 141 bp, Homo sapiens
  misc_feature 127: m=a or c
agtgacagtagcaaccgccggaatgagatggggtcttgctgtgttgtccgggctggtctcgaactcctggcctcaagtgatcctccagccttggcttcccatagtgctgggattgcaggcgtgagcmaccatgtccagctt

SEQ ID NO: 8964 - DNA, 361 bp, Homo sapiens
  misc_feature 144: d=a or g or t
  misc_feature 304: s=g or c
  misc_feature 305: r=a or g
catttgtcattattgttcatttcatttatttgtgttttctttttccttcctcctttgggttatccgattgataacaatttagcacctccgcgcaaaaagagtccctttttgaaaagcaaaaacaaggacaaagacaagtctccdacgacccacccagctctctctaaacgcctgcggttctggtcttcctccgacatcccatcctctcctaacgagcctctctctttctccgacattggagatttctaatccctttcctttatcatgtgtctgtattgtgtaccctccttcatttccgaaattsraacaaacaaaaaaagccagcgtctaaaaggccagatggccgatagcggacccctcc

SEQ ID NO: 8965 - DNA, 152 bp, Homo sapiens; identical to SEQ ID NO: 8898

SEQ ID NO: 8966 - DNA, 407 bp, Homo sapiens
  misc_feature 315: s=g or c
  misc_feature 358: s=g or c
cctccctggttacctctatttctatgtattttatccttttgtggccactgtgaatgggactgcctttcttatttggctcttggattggctgttgggttataagaatgctagagatttttgtagattgattttgtatcctgaaaccttgctgaagttgtttctcagctgaagaagctttaggaacaagactatggggttttctagatacagaatcatgtcatctgcaaacagggacaatttgacttccactttccctaattgaataccctttatttccttctcctgcctgattgccctggccagaacttccaacastatgttgaataagagtggtgagagagggcattcctgtcttgtscagatttcaaggggaatgcttccagtttttgcccattcagtatgatatt

SEQ ID NO: 8967 - DNA, 267 bp, Homo sapiens
  misc_feature 120: w=a or t
  misc_feature 125: k=g or t
  misc_feature 260: b=c or g or t
tttttgagactatcataaaagattatctttaaatttcatttccagtttgtttttatacatagaaataaatgtaatttttatatttctatgtttatatattctatagtctttattttattwttatkttttgtttcttggagacagagtctcgttctatcccccaggctggagtgcagtggcacgatctcagctcactgcaactctgcctgccatgttcaagcaattctcccgcctcagcctccggagtagctgagattacbggaaccc

SEQ ID NO: 8968 - DNA, 416 bp, Homo sapiens
  misc_feature 189: s=g or c
  misc_feature 254: s=g or c
  misc_feature 255: k=g or t
caagcatttaatttgttcttcactgtcaccctacaaggaggtatagcctcttgttctagtgtggattttttttcacaagcaaacacattcctccctacttgtacttctgcctcaactgaaatccattttaagaatttaggccggacacggtggttcacatctgtaatcacagcactttgagaggctgasgcgggcagatcacccgaggtcgggagttcgggaccagcctggccggcatggtgaagccccgtctskgctaaaaatgcaaattagctggggtgtggtggcacgcaactgtaatcccaagttactccggaggctgaggtaggagaaatcgcttgaacctgggagatggaggttgcagtgagctgatattgcgccattgcacttcagcctgggtgacagagtgatactct

SEQ ID NO: 8969 - DNA, 134 bp, Homo sapiens
  misc_feature 117: s=g or c
  misc_feature 119: y=c or t
  misc_feature 120: m=a or c
  misc_feature 126: s=g or c
ttgctctgtcgcccaggctggcgtgtagtggcgccatctcggctcactgcaagctccgcctcctgggttcatgccattctcctgcctcagcctcccgagtagctgggactaacaggsgymcgacascacgcccc

SEQ ID NO: 8970 - DNA, 138 bp, Homo sapiens
tctttgtattaatttttttttctctttttttcaacggagtctcactctgtcaccctgggtggagtgcagtggtacgatctcggctcactgcaacctccacttcctgggttcaagtgattctcctgcctcagcctccca

SEQ ID NO: 8971 - DNA, 289 bp, Homo sapiens
  misc_feature 127: v=a or c or g
  misc_feature 134: r=a or g
  misc_feature 140: m=a or c
  misc_feature 145: w=a or t
  misc_feature 151: k=g or t
  misc_feature 153: m=a or c
  misc_feature 162: m=a or c
  misc_feature 163: s=g or c
  misc_feature 196: m=a or c
  misc_feature 197: r=a or g
  misc_feature 209: d=a or g or t
  misc_feature 210: b=c or g or t
  misc_feature 220: b=c or g or t
  misc_feature 237: s=g or c
  misc_feature 238: r=a or g
  misc_feature 239: y=c or t
  misc_feature 240: m=a or c
  misc_feature 259: w=a or t
  misc_feature 285: m=a or c
tgtgtctaagcagtgaatttcagatattggtttttttgttttgttttgttttgtttgagacggagtctcactctgtcgcacaggctggagtgcagtggcgcgatctcggctcactgcaagctccgcvtcccaargttcamgccawtctcckamttcagcctmscgagtagctgggactacaggcgcccgccaccamrcctggctaattdbttgtattttbagtagagacggggtttsrymgtgttagccaggatggttwcgatctcctgacctcgtgatccgccmacca

SEQ ID NO: 8972 - DNA, 154 bp, Homo sapiens
cttttttcacgctactcccccggagtgcttggatgttgaagagtctctggttgagccttgtggcctggcactggggtgaggctgtcctcctctcccctcatctccctgcagcggcagaatggccccgggcagcgtgtgattcgggaggtgaacc

SEQ ID NO: 8973 - DNA, 153 bp, Homo sapiens
gtatcataaggagaaggcatcattatgtccatgtgggacaaccagcttccttctgtcctgtggcctcagtcttttcttttcttttcttttttcagaattttgtgcaaaatttaagatcagttttctttttgttttttcttctatccctcccct

SEQ ID NO: 8974 - DNA, 204 bp, Homo sapiens
  misc_feature 122: w=a or t
  misc_feature 124: r=a or g
  misc_feature 126: y=c or t
  misc_feature 128: r=a or g
  misc_feature 132: k=g or t
  misc_feature 141: w=a or t
  misc_feature 142: y=c or t
  misc_feature 153: w=a or t
tttgtcaattttggcttttgttaccattgcttttggtgttttagacatgaagtctttgcccatgcctatgtcctgaattattttaaaatgtacaataaattattattgactgtaatcacccwgrtytrtgckatcaaaatwytaaatcgtatwcattctacctatatttttgtactcattaaccatccccactttacccgcgat

SEQ ID NO: 8975 - DNA, 230 bp, Homo sapiens
  misc_feature 183: n=a, g, c or t
tgctcttgtcgcccaggctggagtgcagtgacgcgatctcggctcactgcaacctccgcctcctgggttcaaacgattctcttgccttagcctccctgaggctaggaattacaggcacccgccgccacccctggctaatttttgtatttttagtagagacagggtttcgccatgttagccagnctggtctcgaactcctgacctcaggtgatccacccacctcggcctcc

SEQ ID NO: 8976 - DNA, 342 bp, Homo sapiens
  misc_feature 136: n=a, g, c or t
  misc_feature 272: s=g or c
  misc_feature 273: h=a or c or t
  misc_feature 317: d=a or g or t
  misc_feature 318: b=c or g or t
  misc_feature 324: s=g or c
agattttacattatggaagcttctttttgtttttttgttttttgttgttgttgttgttgagacggagtcttgctctgtcccccaggctagagtgcagtggcttgatctcggctcactgcaacctctgcctcccggnttcacgccattctcctgtctcagtctcctgagtagctgggactacaggcgcccaccaccacgcccggctaattttttgtatttttagtagcgatggggcttcaccgtgttagccactatggtcttgatctcctgashtcgtgatccacccaccttggcctcccagagtgctgggattacadbcgtgascaccgtgcccggcccgca

SEQ ID NO: 8977 - DNA, 263 bp, Homo sapiens; identical to SEQ ID NO: 8868

SEQ ID NO: 8978 - DNA, 343 bp, Homo sapiens
  misc_feature 122: m=a or c
  misc_feature 132: n=a, g, c or t
  misc_feature 325: s=g or c
  misc_feature 326: m=a or c
agattttacattatggaagcttctttttgtttttttgttttttgttgttgttgttgttgagacggagtcttgctctgtcccccaggctagagtgcagtggcttgatctcggctcactgcaamcttctgcctnccgggttcacgccattctcctgtctcagtctcctgagtagctgggactacaggcgcccaccaccacgcccggctaattttttgtatttttagtagcgatggggcttcaccgtgttagccactatggtcttgatctcctgacctcgtgatccacccaccttggcctcccagagtgctgggattacaggcgtgasmaccgtgcccggcccgca

SEQ ID NO: 8979 - DNA, 374 bp, Homo sapiens
  misc_feature 218: b=c or g or t
  misc_feature 294: w=a or t
  misc_feature 298: m=a or c
  misc_feature 329: k=g or t
  misc_feature 331: d=a or g or t
cagcatctgttattccctgtcttttttatgaaggccattttaactgaaatgagatgatatctcatgttatttgaatttgcatttttcatgtgattactgatgttgagcattttattatatgccttttggccatttgtatgtcctttttttttattttattttattttttttttggagacagagttttgctcttgtcacccaggctgaagtgcagtggbgtgatcttggctcactgcaacctccacctcccaggttcaagcgattctcctgcctcagcctcctgagtagctaggwttamaggcacgcaccaccaggcccagttaattttkgdattattagcagagatggggtttcaccatgttggccaggctggt

SEQ ID NO: 8980 - DNA, 151 bp, Homo sapiens
aaattttctcccattctataggttgcctgttcactctgatggtagtttcttttgctgtgcagaagctctttagtttaattagatcccatttgtcaattttggcttttgttgccattgcttttggtgttttagacatgaagtccttgcccat

SEQ ID NO: 8981 - DNA, 426 bp, Homo sapiens
  misc_feature 178: k=g or t
  misc_feature 356: k=g or t
  misc_feature 357: v=a or c or g
  misc_feature 407: b=c or g or t
  misc_feature 408: b=c or g or t
  misc_feature 409: y=c or t
catcaccccagaaaaccacatacctattagccatcactccccatacccagcccctggaaaccagtcatccactttgtgtctgtgaattttgccttttctggactttgcatataaatgaaatcagacactttgttatattgtgtgactggctttcttcatttaacataatgtttttgtkttttgtttttgttttgagatggagtcgtgctctgttgccgaggctggagtgcagtggtgcgatctcggctcactgcaacctccgcctccctggttcacgctattttcctgcctcagcctcctgagtagctgggactacaggtgcctaccactacacccagctaattttttgtattttkvgtagagacggggtttcacagtgttagccaaaattgtctcgatatcctggbbytgtgatctgcccaccca

SEQ ID NO: 8982 - DNA, 210 bp, Homo sapiens
tagaaggattgcaagttacttaagtgttttctaaatcattaaagaaaaggtaaattaagttcagtatggttttatgtcaagctttttttatgttgtatttctttttttatttttattattaattaatttttttgagacagagtttcattcttgttgcccaggctggagtgcagtggcacgatctcagctcattgcaacctccgcctccct

SEQ ID NO: 8983 - DNA, 235 bp, Homo sapiens
  misc_feature 130: n=a, g, c or t
  misc_feature 180: k=g or t
  misc_feature 181: k=g or t
  misc_feature 186: s=g or c
  misc_feature 187: r=a or g
aacaccactcctggctggtttttaaaaattttggtagaaacaggattttgctatgttgcccagcctggtctttttgttttgttttattttgttttttttttgagacggcgtctcactcagttgcccaggntggagtgcagtggtgtgatctcgactcactgcagcttccacctcctgggkkcaagsrgttctcctgcctcaacctcccaagtagctgggattacaagtgtgtgcc

SEQ ID NO: 8984 - DNA, 164 bp, Homo sapiens
tgtgatctgtgaacatgaactttttttgttttgttttggttttgtttttgttttttgagatggagtcttgctctgttgctgaggctagagtgcaatggcgcaatctcggctcactgcaacctccacctcctgggttcatgcaattctcctgcctcagcctccac

SEQ ID NO: 8985 - DNA, 215 bp, Homo sapiens
  misc_feature 143: s=g or c
  misc_feature 149: r=a or g
aaattatcacacttaaggaaattctccattttattttattttatttttgagacagggtcttgctctgtcacccaggctggagtgcaatggtgcagtctggctcactgcaacctccacttcttgggttcaaacagttctcctgsctttarcctcctgagcagctgtggctagaactgtaggcacaccccactgtgcctggctaacctttttttttt

SEQ ID NO: 8986 - DNA, 212 bp, Homo sapiens
  misc_feature 122: s=g or c
  misc_feature 129: m=a or c
  misc_feature 131: m=a or c
  misc_feature 136: m=a or c
  misc_feature 137: m=a or c
  misc_feature 147: w=a or t
  misc_feature 148: r=a or g
  misc_feature 160: m=a or c
  misc_feature 161: w=a or t
  misc_feature 172: s=g or c
  misc_feature 177: w=a or t
  misc_feature 179: m=a or c
  misc_feature 185: m=a or c
  misc_feature 198: m=a or c
  misc_feature 201: w=a or t
  misc_feature 202: m=a or c
  misc_feature 206: s=g or c
ggtccgggtgcaaacacgcgggtcagctgatccggcccaactgcggcgtcatcccggctataagcgcacggcctcggcgaccctctccgacccggccgccgccgccatgcagccctccagcsttctgcmgmtcgcmmtctgcctgcwrgctgcacccgcmwccgcgctcgtsaggawcmcgctgmacaagttcacgtmcawmcgcsagacct

SEQ ID NO: 8987 - DNA, 225 bp, Homo sapiens
ctctggctgcaatgcaggggtcaactcatagctaactgcagccttgacctcctgggctccggggatcctcctacctcagcctcaccatagctatgaccacagatgaccaccaaaacacccagctaatttttatttatttatttattttttgtagaaagaggagccttgctatgttgcccaagctggcctcaaactcccgccctcaagagatctgcccacctcaac

SEQ ID NO: 8988 - DNA, 250 bp, Homo sapiens
tttacaatgttttttatttctagcatttttttattcattcttggaatgtccatctctctgcttacattacccatctgtttttgcatgttgcctacctttttcattagcacccttagcatattagtcatagttgttaaattcctggtctgatcattccagcatccctgccatatctgagtctggttcagatgcctgagttgtaggaaaggggaagcattctaaagtcctacgagtaggtctcagtcctttt

SEQ ID NO: 8989 - DNA, 133 bp, Homo sapiens
tgtgtgtgtgtgtgtctgcgtgtgtatgtgtttgtgtccctgctgggatgtgtttactgtgtttgtgtgtgtctctgtgtgtgtgtctgtgtctgtccctgtcgggatgtatttagtgtgtgtgtgtgtgtgt

SEQ ID NO: 8990 - DNA, 277 bp, Homo sapiens
  misc_feature 128: s=g or c
  misc_feature 129: r=a or g
  misc_feature 130: m=a or c
  misc_feature 136: r=a or g
  misc_feature 142: m=a or c
  misc_feature 180: k=g or t
  misc_feature 181: v=a or c or g
tttgggtggccgggagagacccagggaggttctggaggttcctttctgtctcctggccccaccagggatttccccatttctgtttgctgcctgaaagcaggatgaggaaggccaaggagagtccttgsrmccgtgragcgtmagggatgaaggaaatgacaggaggaagacgtgggtttkvgttagtggctgctggcgttttggcccttggtgtttctggagcctccagggatctaggggagcctgggctgcgtgcatgtcgataagcagagcttaa

SEQ ID NO: 8991 - DNA, 276 bp, Homo sapiens
  misc_feature 140: k=g or t
ttttttgtagagacgaggtctttctattgttgcccagatgggccttgaactcctgagctcaagtgatccttccacctcggcctcccaaagtattaggattattggcctgagccactgcgcctggccatcattactctttkctaatcatttaatgctatacatttttcttttagcagtgatttagctgtattccacaaattccagtgttgtgttctcattttcattcagttcaatgtatatttttatttcctttgaggctttccctttgacccagac

SEQ ID NO: 8992 - DNA, 149 bp, Homo sapiens
  misc_feature 16: w=a or t
  misc_feature 122: m=a or c
cattctaaaggtaaawggtaaaactacacaacttgacttatttatttatttatttatttatttatttatttgcgacagggtctcattgtgtcacccaggctggagtgcagtagtgtcattamagctccactgcagcttctccctcccca

SEQ ID NO: 8993 - DNA, 202 bp, Homo sapiens
tgcagtagggtgatcttggctcactgtaacctctgccttttgggttcaagggattctcctgcctcagcctcccgagtagctgggactacaggcgcatgccaccatgccaggctaattttttgtattgttagtaagagaacagggtttcaccatgatagccaggatgatctccatctcctgacctcatgatccacccacctat

SEQ ID NO: 8994 - DNA, 154 bp, Homo sapiens
  misc_feature 145: m=a or c
  misc_feature 149: y=c or t
ctggaaagggaggagccaaaaggggaacgctttcttgattgtcccagcctcattaggagctaccacagggctctcctgcatgctccttgttttctttgtgctctggacttgctcacttgcactgcttgcttcttccccaatcgcmgccyaccca

SEQ ID NO: 8995 - DNA, 202 bp, Homo sapiens
tctctccttgtccacctgggtccttattgcctgcttctttggaatcctctcctacttagccccactcacagttcttctcaaggtcaatggtagcagggcaagtcaattaaaaaaacttgtcttccctattcaagattgcaaaacattttaagggaaagggctacttattcccatttttcccatttttaattgtcaccagcac

SEQ ID NO: 8996 - DNA, 260 bp, Homo sapiens
  misc_feature 131: r=a or g
  misc_feature 135: m=a or c
  misc_feature 136: r=a or g
  misc_feature 138: r=a or g
agctggatctgttgatggcattcttactagtttggttttcagactttttgataagaatgggtgcggctgggcgtggtggctcacacctttaatcccagcactttgggaggccgaggcaggtgaatcacgargtcmrgragatcgagaccatcctgaccaacatggtgaaaccccgtctctactaaaaatacaaaaattagccaggcatggtggcacgcgcctgtaatcccaggtactcaggaggctgaggcaggagaatc

SEQ ID NO: 8997 - DNA, 280 bp, Homo sapiens
  misc_feature 9: w=a or t
  misc_feature 15: w=a or t
  misc_feature 26: y=c or t
  misc_feature 144: m=a or c
  misc_feature 230: s=g or c
ggatactawacgcawgcagtagtaayattcttttatttatttatttttttttgacagagtctcgatctgtcgccaagtttggagtgcagtggtgcaatctcgtctcactgcaacctccaccttcccgggttcactccgttctcmtgcctcagcctcctgagtagctgggactacaggcacctgccacaacgcctggctaattttttgtatttttggtagagacagggttsaccatgttagccaggatggtctcaacctcctgatctcgtgatccgccctc

SEQ ID NO: 8998 - DNA, 438 bp, Homo sapiens
  misc_feature 81: w=a or t
  misc_feature 131: n=a, g, c or t
  misc_feature 132: k=g or t
  misc_feature 135: w=a or t
  misc_feature 161: w=a or t
  misc_feature 366: r=a or g
  misc_feature 389: n=a, g, c or t
gagccaccacgcccggcctcttttctgtctttctttcctgttttcttacaccctgtctcttccctttttccttctgtctgwctctccctctctgtttctctgtgtctttctccttcctgcccctggcctcnkgtwtctctccagcacctgcctggattggwggtgtcattcccattttacagacgagagacctagggctctgagaagccgatggcttgcctgagaccacccagctgagaggcagagctgggatccgagtctaggtctctgtgactccattctctgtgcttttcccaattccgctcagaagtgtcccaggtagtgccagggaagagagatgggggagggggagctcaggcagctgtrgtgacattttcagagggaaatgntctgccctagaggggcccagagggcttttgtgctttctttatacttcct

SEQ ID NO: 8999 - DNA, 216 bp, Homo sapiens
  misc_feature 14: r=a or g
tccttttgctttarttttggcccttgtgttctacccccctgccatctcttatttgaaaatttgtcggtgggcatggtggcgcacgcctgtaatcccagctactcgagtggctgagacacgagaatcacttgaacccaggaagcaaagattgcagtgagccgagatggcgccactgccctccagcataagtgacaaagtgagactctgtctccaaaa

SEQ ID NO: 9000 - DNA, 190 bp, Homo sapiens
  misc_feature 104: b=c or g or t
  misc_feature 128: k=g or t
tcgcggatgtgtgccaccacacctggctaatttttaaattttttgtagagacaaagtctcactgtgttgcccaggctggtctcagactcctgggttcaagtgabccttccacctcggcttcccaaaaktgctgggattacaggtggcagccaccgtgcctggctgggaagcatttcaaagtcggctacat

SEQ ID NO: 9001 - DNA, 233 bp, Homo sapiens
  misc_feature 128: y=c or t
  misc_feature 129: r=a or g
  misc_feature 140: w=a or t
  misc_feature 186: k=g or t
acatttggaagccagcactcccagacctgccccttgctctctcctctgcctcctggctggctctctccagaaggaatcaattccgaattagggcgcctccaccccgcctctccccttcttggttggcyraatcaaaggcwaccagaaagaacagagtgagatgtccccaggtattgagtatatttkggaagttaacacctgggctggcaacctccaagcaacaaccagcctta

SEQ ID NO: 9002 - DNA, 310 bp, Homo sapiens
  misc_feature 192: b=c or g or t
  misc_feature 269: b=c or g or t
  misc_feature 270: m=a or c
  misc_feature 271: b=c or g or t
tgttgttgtttggttttggggggttttttagttttgtttgagacggagtctcactctgttgccaggctggagtgcagtggtgagatctcggctcactgcaacctccacctcccgggttcaagtgattgtcctgcctcagcctcccaagtagctgggactgctggcaggtgccaccacgcccggctaatgttbgtgtttttagtagagatggggtttcaccatgttggccaggctggtctcgaactcctgacctcgcccgccttggcctbmbaaagtgctgggattacaggcctgaggcactgcgtccttt

SEQ ID NO: 9003 - DNA, 251 bp, Homo sapiens
  misc_feature 118: y=c or t
gtgcagtggtgcaatctcggctcactgcaacctctgcctactgggttcaggtgattcttctgcctcagcctcccgagtagctgggacacagagtgcaccaccatgcccagctaatttytgtatttttaatagtgacggggttttgccatgttggccaggctggtctcgaactcccaacctcaggtgatctgcctggctcagtctcccaaagtgctggaattacaggagtgagccaccacgtccggcctcaa

SEQ ID NO: 9004 - DNA, 297 bp, Homo sapiens
  misc_feature 262: m=a or c
tatgaatgatagacaaaagaaaaaaagactgttctggctgggcacagtggctcatgcctgtaaccccagcactttgagaggcagaggtcaggagttcgagaccggcctggccaacatggtgaaaccccatctgtactgaaatacaaaactggcatgcctgtagtccaggctacttgggaggctgaggcaggagaatcgtttgaacccgggaggcggaggttgcagtaagccaagatcgtgccactgcactccagcctgggcmacagagcaagactccgtttaaaaacacacacacac

SEQ ID NO: 9005 - DNA, 314 bp, Homo sapiens
acaggtgtgagccaccgtgctgattttcagttttgtttgtttgtttgttttgttttgttttgtctgagacggagtctcgtctcaatctgtcacccaggccagagtgcaatggtgcaatcttggcttactgcaacctccacctcctgggttcaagcaattctcctgcctcagcctcccaagtagctgggattacaggcgtgtgccactgtgcccagctagtttttttattttcagtagagatgcagtttcgccatgttggccaggctggtctcgaactccggacctcaggtgatctgctttcctcggcctcccaa

SEQ ID NO: 9006 - DNA, 202 bp, Homo sapiens
  misc_feature 164: y=c or t
aagtagctgggattataggtgcccgccaccacgcccagctagtttttttgtatttttagtagagatgaggtttcaccatgttggccaggctggtctggaactcctgacctcaggtgatccacccgcctcggcctcccaaagtgctgggattataggcgtgagcyactgtgcccgaccacagctgttttcttctaccctacca

SEQ ID NO: 9007 - DNA, 271 bp, Homo sapiens
  misc_feature 225: s=g or c
tatcttcactatttaccacttcctctagaatcctttttatttgttttattttttgagatggagtttcactcttgttgcccaggctggagtgcaaaggtgcaatctcggctcaccgcaacctccgcctcccgggttcaggcaattatcctgcctcagcctcccaagtagcagggattacaggcctatgctaccacacctggctaattttgtatttttagtagagasagggtttctccatgttggtcaggctggtctcaaactcccgacctga

SEQ ID NO: 9008 - DNA, 286 bp, Homo sapiens
  misc_feature 39: k=g or t
  misc_feature 197: r=a or g
  misc_feature 211: k=g or t
  misc_feature 241: w=a or t
  misc_feature 242: k=g or t
taataatatttgccttacatgtctgggtcgtccaatgtkaggtgcatatatacttgctaaatataataattgctaaattgattcttgtattattatataattttcttctgtgtctccttttacagcttttattttcaaatctactttgatagaactatggctgctcctgctcactttccattttcatggagtatgtrtttccatcccttckctttcagtatatatgagtcttctgaggtgwkataatttgttataggcagcatagttctatcaaagtagatttgaa

SEQ ID NO: 9009 - DNA, 152 bp, Homo sapiens
tagcataacagcccactttccctcccattttaactacagcaaatccttggaatgggggcttttgctgagtagtttgtttttgttttgtttttgtttttgtttttgtttttttgagacagagtttcactcttgttgcccaggcaggggttgca

SEQ ID NO: 9010 - DNA, 443 bp, Homo sapiens
  misc_feature 130: s=g or c
  misc_feature 244: n=a, g, c or t
  misc_feature 308: n=a, g, c or t
  misc_feature 310: w=a or t
  misc_feature 411: r=a or g
  misc_feature 412: n=a, g, c or t
acatttcaagttggtcgcggcttgggctccgctttggggaggggcagcaggtttattcactggatctctgatacccaggccccctccaccatggccagccggggtgggggccggggtcgtgggccggggscagtttgaccttcaacgtggaggccgtgggcattgggaaaggggatgctttgcccccacccaccctgcagccttctccactcttccctcccttggagttccgcccagtaccttngccctcaggcgaggaaggggaatatgtcctggcactgaagcaagagctacgaggagccatgagncwgctcccctacttcatccggccagctgtccccaagagagatgtggagcgttattcagacaaatatcagatgtcaggtccgattgacaatgccatcgattggrnccctgattggcggcgtctaccccgggagcta

SEQ ID NO: 9011 - DNA, 414 bp, Homo sapiens
  misc_feature 138: k=g or t
  misc_feature 346: n=a, g, c or t
  misc_feature 376: y=c or t
  misc_feature 377: n=a, g, c or t
  misc_feature 381: d=a or g or t
  misc_feature 382: n=a, g, c or t
  misc_feature 411: n=a, g, c or t
cactgtaatattaacagccaaggtgtgatctgtctggacatcttaaaggacaactggagtccggctttaactatttctaaagttctcctctccatctgctcacttcttacagattgcaaccctgctgaccctctggtkgggcagcatcgccacacagtacatgaccaacagagcagagcatgaccggatggccagacagtggaccaagcggtacgccacataggggcctgctgcctgccgccccgcgggacctgtgcaagcacattcaccaagtgcatcggtagccctgcccacccctccagacctcggttcttattttcctatttttattaaatttggaaccatnttgtgatggtatgttgtccatcttcccatyncagdncttcctgccccccttcctctctcccacgntca

SEQ ID NO: 9012 - DNA, 194 bp, Homo sapiens
  misc_feature 140: n=a, g, c or t
  misc_feature 193: r=a or g
  misc_feature 194: r=a or g
atacacatccattattgttctgtgtgatattataatgttctggggcctctttcctaaataccctgacaatcatgctgctcttttctcttgctgtgagctgaccagctgtgcccctgcctgttgccagcacgctccccttncctagatccctgtcttcctctagtgcagtttttaattcatcgtggccggggarr

SEQ ID NO: 9013 - DNA, 234 bp, Homo sapiens
tacacttgctattccactcacacttgttctcacttgtttcacacacctctcactgttctcacactcgttcactcacttgttctcgttcttacactcacacctcactttgttctcacactcgttcactcacttgttctcgttcttacactcacacctcactttgttctcacactcgttcactcacttgttctcgttcttacactcacctcactttgttctcacactcgttcactc

SEQ ID NO: 9014 - DNA, 294 bp, Homo sapiens
  misc_feature 100: s=g or c
  misc_feature 115: w=a or t
  misc_feature 166: m=a or c
  misc_feature 185: w=a or t
  misc_feature 228: y=c or t
  misc_feature 266: y=c or t
  misc_feature 267: n=a, g, c or t
ttttttgttttctgttttgtttttgttttgttttttggagacagggtctcacccaagctgaagtgcagtggtgcagtctcggctcactgcacctcagccstcctgtgctcaagcwatcctcccaccccagcttcccaagtagctgggactacaggtgcgtgctgcmacacctggctaatttttgwatttttagtagagatggggtttcacactgttgcctaggctggycttgaactcctgggctcaggtgatccacccgcctcagyntcccgtagtgctgggattacaggcaca

SEQ ID NO: 9015 - DNA, 229 bp, Homo sapiens
agaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacaggg

SEQ ID NO: 9016 - DNA, 147 bp, Homo sapiens
gcccttaataacattagggaactggactgggttcggtttgcatctcccgagtctgactcgtgggagtaaccaccataatagcagcgctgtgctgttgagggtgactttgactatctgcttgtgttgtgagcccactgtgtgccggat

SEQ ID NO: 9017 - DNA, 246 bp, Homo sapiens
  misc_feature 43: w=a or t
  misc_feature 92: m=a or c
  misc_feature 93: y=c or t
aaatctaaggaccactctattcaccctacagtgactgctcttwttccctcctgccacagtccagggtaggagatacttctccgggctctcamyttatgggggctttcctgctggctacatcactgaaatggaatctcctagtggcccttctccctctacagctctggtgttacactgaaaaactagaagtttcaaaacagacaagggaaaaagagaaacatcagaaagtctgattaaagcagaagc

SEQ ID NO: 9018 - DNA, 163 bp, Homo sapiens
  misc_feature 132: k=g or t
ttctttcctctcccacccttaattgcttctccagttttctatttctctgtgagggcatcttccctgatctatgtgattatgtgactaggtacctggaagttgaccttgacactgctttctccttcccaaccktcatattcccacccccatatccacccgcctc

SEQ ID NO: 9019 - DNA, 252 bp, Homo sapiens
  misc_feature 139: r=a or g
  misc_feature 140: w=a or t
  misc_feature 145: r=a or g
  misc_feature 146: w=a or t
  misc_feature 149: r=a or g
  misc_feature 150: s=g or c
  misc_feature 155: s=g or c
  misc_feature 157: y=c or t
  misc_feature 162: k=g or t
  misc_feature 170: w=a or t
cttaggaaaccttttaaaattggggctgagagcaaaccaagaatgatgcaagttcactgcagtttgccctttgctcactccatgtatctgcattgtctggggatgctcaggatgtctttagaacacacacgaagctggrwcctgrwtarsctggscyttggkggccagtwagtgctgagagtttacagccaggattctaagtgaaaacctaaaagctgatagcttccttatcactatcattaggagacacta

SEQ ID NO: 9020 - DNA, 285 bp, Homo sapiens
ccagggatacagagaccaccaggccctgtcatcaggcttctccctgtgcaggtggagcttttctctaacagcacaaacagcagagacattgacagattccttgcattcaaatcctggctccaccactcaccagccgtgtgacccttcacttctctgagcagtgtgcttatttgcaaactggggatcatcatggtgctcatcgcttacaggattttaatgataatgaaatgaatccgtagttgtaaagtgtttagaataatatctggcacatagtgagggctcctg

SEQ ID NO: 9021 - DNA, 195 bp, Homo sapiens
caaatgcagttttctatttttatcttgggtatctttatacttactctaatgatggtatcattactcaaaacattttttgagccacttaacaaaccagtaagaaaattgatcttattaccttatagttattctatgaggacagtgctgaaaacagtgtatttgatacattactaaggattggaaatttgggagtaa

SEQ ID NO: 9022 - DNA, 308 bp, Homo sapiens
  misc_feature 30: s=g or c
  misc_feature 127: k=g or t
  misc_feature 130: s=g or c
  misc_feature 231: d=a or g or t
  misc_feature 239: n=a, g, c or t
gtttcttcttacccgttgttaggggcgcasgtcaggtgttcagctcccctgggaccactggtcccttcattagtgacgtatttcatcatcagtttagagagttcggcatgcttacaggcagttattkgtsctaggtgttagctttctgggtgtacggagcagctctaagccggcaacatggcccggttgcccttgcgatcaaagagaagagggctgggcgctccatgattdagcctgangctcttcaaacatccattctgcttccacgcatggcttctgccattggttctcttcccccagcaccctgc

SEQ ID NO: 9023 - DNA, 259 bp, Homo sapiens
  misc_feature 125: k=g or t
  misc_feature 128: w=a or t
  misc_feature 133: r=a or g
  misc_feature 143: n=a, g, c or t
ttttggaacagggtaggcattttgtttattgtttgcttgcttctaggtgttttcgccatcagggtgtattggaggctgacacttaatgggtgtgtgttgcgcccagaactgctcggtgtcggggktcwaaagraatgcgctgntgttcttggcttcaagtttctgctttggagaagcagattcaggaagtaggtgttgcttaaaaataattcttggtttttatctaatcagatattcattgattacctaccaggtgcgt

SEQ ID NO: 9024 - DNA, 166 bp, Homo sapiens
tactttttatttttttggtagagatggggtttcaccatgtttgccagttggtctcaaagtcctgacctcaagtgattcacccaccttagcctcccaaagtgctgggattacaggtgtgtgctattgcacctggcctaaccaagctgattttaatttcagttataat

SEQ ID NO: 9025 - DNA, 246 bp, Homo sapiens
  misc_feature 116: k=g or t
  misc_feature 119: s=g or c
  misc_feature 124: s=g or c
tacaaaaaaatttgcctggcattgtggtgtgtgcctgtaatcccagctacttgggaggctgaggcaggagaattgcttgaacctgggaggtggaggttgcagcgagtcaagatcgktgscaacsaaactccagcctgggtgacagagtgagactccatctcaaaaacaaaataaaaacagtttggaggggtcagtgcccaagccctcctgcgcacgcaccctctgcctggcccctgcctacagcgc

SEQ ID NO: 9026 - DNA, 347 bp, Homo sapiens
  misc_feature 119: y=c or t
  misc_feature 124: k=g or t
tatcttagatacaagttctttgtcagatatgtggtttcaaatgtattctcccagtctgtagtttgctctttcatctttttcatgaaattctgcagcacaaagtttacattttaaagtcyaagtkgggctctccttttaatgtcttgtttctttgtttctttttttttgggacggagtcttgctctcgctctgtcgcccaggctggagtgtgttggcgcgatctctgctctctgcaacctctgcctcctggttcaagggattctcctgcctcagcctcccaagtagctgggattactggtgtgctactatgcctggatgatttttgtatttttagtagagatggggac

SEQ ID NO: 9027 - DNA, 133 bp, Homo sapiens
agacggcgcccagcggcggcgcgaacggcagctaggagggttgctccgggcttggtgctcactgcgacttcccgcgcagggcccggtcggactaggacccgcggcctgagagacgctggaggatgcggacgct

SEQ ID NO: 9028 - DNA, 345 bp, Homo sapiens
  misc_feature 266: n=a, g, c or t
  misc_feature 286: n=a, g, c or t
  misc_feature 287: n=a, g, c or t
tatcttagatacaagttctttgtcagatatgtggtttcaaatgtattctcccagtctgtagtttgctctttcatctttttcatgaaattctgcagcacaaagtttacattttaaagtctagtgggctctccttttaatgtcttgtttctttgtttctttttttttgggacggagtcttgctctcgctctgtcgcccaggctggagtgtgttggcgcgatctctgctctctgcaacctctgcctcctggttcaagggattctcctgnctcagcctcccaagtagctnngattactggtgtgctactatgcctggatgatttttgtatttttagtagagatggggac

SEQ ID NO: 9029 - DNA, 195 bp, Homo sapiens
aaaacttcattttgcttgtttgtatttttctgttgttattatttttgagacggagtttcactcttgttgcccaggctagagtgcaatggcgcgatctcggctcacagcaacctccacctcccgggttcaagccattctcctgcctcagcctccggagtagatgggattacaggcatgcaccaccacacccggacc

SEQ ID NO: 9030 - DNA, 283 bp, Homo sapiens
  misc_feature 195: s=g or c
  misc_feature 241: h=a or c or t
  misc_feature 270: s=g or c
ccatccgttagcagatcttgtaggtgactcttggcctgctttggccttccaggagaagatttggggtccacttgcaagatcacaggtcctcagtgagcatcctgctagtttctgtctctatcaccctcccaccccgtcagctcctgcccctgtatcttggttcactctcacattgtcatcatctctcctttttastccaatttttcttctttgaggccaagttcagagactggagaaatghaattcagctgactcttgaagtcattagasattcggggagtct

SEQ ID NO: 9031 - DNA, 365 bp, Homo sapiens
cggactcctcccttgctgttctcatgatggagttttcacaagatctggttggtcttttgcttttttgttgttgttgttgttttgtgacagagtctcactctgtcgccaggctggagtgcagtggtgcgatcttggctctctgcaagctccacctcccaagttcaagtgactctcctgcctcagcctcctgcccagccgagtagctgggactacaggtgcgcaccaccactcccagctaatttttgtatttttagtagagatggagtttcaccatgttggccaggatggtattgatctcttgacctcgtgatccacgaggcctcccaaagtgccaggattactggcgtgagcaccacacccggcct

SEQ ID NO: 9032 - DNA, 313 bp, Homo sapiens
  misc_feature 234: m=a or c
tcctgttcttcctggctggcctgggctagcactagtctctctagtggacgcacatggccttgccccaaaagcatctctctctgccttggggctgctcccgctgcaattcccagaggactcctgtccttttttttcagaagcttgcctggagctgcagaaagagaaaagggctaactataaaaattccagattaatcaacgcatggttgtagaagtacacgaagtaaaaaccagmcacagtcctgaatgaaattggagagttgtaagggaagccaagtggcaccctggggacgtgaacattgaaagggcctgca

SEQ ID NO: 9033 - DNA, 171 bp, Homo sapiens
ctttctctcttgtctctcctttctttctctcctttctctcttttttccttttccttttcctttttctttttgacagagttttgctcttgttgcccagtttggagtgcaatggcacaatctcagctcactgcaacctccacctcccaggttcaagcaattctcctgcctcag

SEQ ID NO: 9034 - DNA, 189 bp, Homo sapiens
gacagtctcattccatcccccaggctggagtgcagtggtgtgaactcagctcactgcaacctccacctccctgcttcaagcaattctcttgcctctgcctcctgagtagttgggcttggaagcgcctgccaccatgcctggctaatttttttatttttagtagagacggagtttcaccatgttggccat

SEQ ID NO: 9035 - DNA, 303 bp, Homo sapiens
actgcttcagtctcccgagtagctgggattacagatgcatgtcaccacgcctggctaatttttgtatttttaatagagacagggtttcaccatgttggccatgctggtctcaaactcctgacctcaggtgatccgcccgcctcggcctcccaaagtgctgggattacaagcgtgagccactgtgcccggctacataagcatttttaagctcagtaagccccaaactaagctcaccttcccttcccaaacctgattgtgtattttctacctttttgaacacctttttgaacctggcggggctca

SEQ ID NO: 9036 - DNA, 267 bp, Homo sapiens
  misc_feature 184: s=g or c
tgtacttatttatgattttagtcagattgcattctaagacttcagcaagatttcaacgaacattttcctattttttctttttctttctttcttttttttttgagacagagtctggctctgtcgcccaggctggagtgcagtggtgcgaccacggctcactgcaagctccacctcccaggttcasgccattctcctgcctcagcctccgatggtggctatgatggtgggggaggagagtagacaaggccgcggtgagtccctgtgtcc

SEQ ID NO: 9037 - DNA, 257 bp, Homo sapiens
  misc_feature 188: k=g or t
  misc_feature 190: y=c or t
  misc_feature 199: y=c or t
  misc_feature 213: y=c or t
  misc_feature 231: y=c or t
  misc_feature 249: m=a or c
tctctccttttttcctgtaactgtgctggttttgttttggtcttcctctcatacccgtttctgcatttcatcttttctttctattgtgacttcatttcattttttttttaaccttatcttttgtttctcttgtttatcccatcctttttgataaaatccatcgcatgtgtcttctttttttctttatktyctttccttycctttttccttttyctttctcccaaacttttyccttttcacagcattggmacacggga

SEQ ID NO: 9038 - DNA, 223 bp, Homo sapiens
agaatccattttctgttgcaacaggatgcaactggagaaactggttgttttaccaaggctttgagtgcaagggtatgcttccctttaagcagtcaagctcgagttgcagagccaaaaaaatccccttggggagaaaactggcttcatacccttgcctacacagtccctgtacagggttcctgacctgtggtcagtaaagaatgtcactttccttttttttttt

SEQ ID NO: 9039 - DNA, 153 bp, Homo sapiens
tgccagccgggccggtccgtcctccaggggaccccgcgcagtccaggtgagcggggccgcgtctgcttcggtgacaccagggtgaggccaggcctgcagcttctcacgttctcactatgtctgctccagacgaagggagacgggatccccccg

SEQ ID NO: 9040 - DNA, 278 bp, Homo sapiens
  misc_feature 66: r=a or g
cttggagaaccagtagatccttccaattagaaagcatatactagacactgaatgagtggatggatrattttcaaagaacctcaagtctgtctttctttctttccttccttccttccttccttttcttttttgagatggagtttcgcatgctctgtcacccaggctgcagtgaagtggcagaatctcggctcactgcaacctccgcctcccgggttcaagtgattctcctgcttcagcctcctgaatagctgagattacaggcgctcaccaccacgccc

SEQ ID NO: 9041 - DNA, 222 bp, Homo sapiens
aaaagtttgtaataagttgcactttcatcaagactgtattagggagtccagtctccccacatccttgtcagcacgggatgacatcagtcttttaaatcttaccaacttattgggaaaaaaaaaaatgatacgtcctgtttgtgaattgagcatttttttcacctatgtactagccatttacatatctccttctgtgaattgtctgtttatatcctttcctgc

SEQ ID NO: 9042 - DNA, 167 bp, Homo sapiens
ttgcgctgggattccgcagccagaatacttacatccctggggccccaaggggctcactaaactacgtgccttgtccaggtcgcgtttttttgtttttgtttgtttgtttttttcctcctggtcttgtcctttgtaaagccttagaacagtcgttaaacaacccagtc

SEQ ID NO: 9043 - DNA, 154 bp, Homo sapiens
caagtgattctcttaccagcctctccagtagctgggattacaggtgcccaccaccatgcccagttttttgtatttttagtagagacggggtttcaccatgttggccaggctggtctcgaactcctgacctcaggttatccacccaccttggcct

SEQ ID NO: 9044 - DNA, 331 bp, Homo sapiens
  misc_feature 198: k=g or t
  misc_feature 221: k=g or t
  misc_feature 258: k=g or t
  misc_feature 262: k=g or t
  misc_feature 273: k=g or t
  misc_feature 295: k=g or t
gttttcttgagctttttttgatatgtttgtttagcattttcatcaaatttggaaaaatcttggccactatgttttcaaatatttttcttctctctctaccttctcatctttggggtctcttactacacatatataaagctaactgaaattgtcccacagctcactaatgtcccacagctccattcatttttcttggtkttttgtgtgtgtgtgtgtgtgtktcagtttgcatagtttctattgttatgccttcaagtkctckaatcatctctkttgcaatgtttaatctaccatkaattctatccagtgtatttgtcacctcagacattgt

SEQ ID NO: 9045 - DNA, 186 bp, Homo sapiens
actaaccctttagggttcccagattgtttggtctcaggacccctgtgctcaaaaattaccatggactttaaagagcttgtggttatgtgtttttgtttgtttgtattttcgagacagagttttgctcttatcaggctggagtgaagtggcgtgatctcagctcactgcaacctccccccctccacg

SEQ ID NO: 9046 - DNA, 147 bp, Homo sapiens
cagatggctaccttctccctgtgtcttcacatggcagagagagagagagagagcactctggcctctcttcctcttctttataagcacaccggccccatcatggggtccctacacttgtccctcttctaaacctgataacctccccag

SEQ ID NO: 9047 - DNA, 155 bp, Homo sapiens
cctggctgatgtttgtacttttagtagagacggtgtttttccatgttggtcaggctggtctcccactcccaacctcaggtggtccgcctgccttagcctcccaaagtgctgggatgacaggcgtgagccaccgcgcccagcctctctctctctct

SEQ ID NO: 9048 - DNA, 202 bp, Homo sapiens
  misc_feature 181: r=a or g
ttcagcaaagattgacttgtctagattattatatcaggttatttatcaatcatgtggagcaggctgggagtggtggtttatgcctgttatcccactgctttgggaggctgtggtgggaggtttgtctgaggccaggagttcaagaccagcctggacaacagagcgagaccctgtttcttaraaaaaaaaaattagctggaag

SEQ ID NO: 9049 - DNA, 241 bp, Homo sapiens
tttcacttctctctctgggtgctgcttgtgatggaaaaccctctagtcctaatttagtatttacaagatgtgcacacgttcattcatagcaaatcctcaggattatttcctcagagctgaacccttatgtatagtactcccctttctccttgccttttcctcttccttaccttgcttctttcatcttgaaaactccatagttttatcccatcactctaagtaaatgtcattggggcctgga

SEQ ID NO: 9050 - DNA, 415 bp, Homo sapiens
  misc_feature 6: m=a or c
atagcmggtgaggctgggaggacatttcaggtaaggtagggaaacataaggtttagggaatggctagggcatcatgggagattagattggaaaggtaaatgggaaactagcttaggaagggcccgagtacagtttataccatctccatgtgaaaaatttactttagctctgtatgatggctaggactcattgtgaaagaagtattaatgttaaattccatctgctatgggcctgagattgatgtgtatttattgttagcttattctttttttgtttgttttttattattattattattacatttacttcagctcacaccaggccttattcttaacttgctgatatgtgtagagaaatataaattgctcttagaagttgacttacagcattactttttattttaaacttaagtaat

SEQ ID NO: 9051 - DNA, 370 bp, Homo sapiens
aaaggtacacaattgaaaaaaattgtatccttcacaacagatgtgggcagtcaacttttagaccttgtgtctttagtttgacctgtccttcagtgagtgtatataaaattctaagctaaaacatattttctgaaattgtgaaggtattgcatgtctatcttcttgcctactctaaatatatcaatcgttttcttgggaagttagtctttctttcacacttgtctgtagatctttacatgttctttcagttttggaagtcctctgcatatttaatatttgttagtatttgtaaaggttttcttcctgtctacctccttcttgttctctctctctctctctctctctgttgctctctcttgctctctctcca

SEQ ID NO: 9052 - DNA, 207 bp, Homo sapiens
agccactgcgcctggtgggtcacattttaggttcctttgttgtctgttgagaaggtttttatgtggcagtatcaagggagtggggaatagattatatttttcatttatttcccaagacccttttgcccacttccgttgtttcttctagcatcgatactcctggagtcatcagacgtgtctcgcagctcttccacgagcaccctgacc

SEQ ID NO: 9053 - DNA, 249 bp, Homo sapiens
  misc_feature 49: r=a or g
agagatggcagtgagcgagaggagggggctcggccgcgggagcccgcgragtgggggcagcggctacttctggtgctgctgttgggtggctgctccgggcgcatccaccggctggcgctgacgggggagaagcgagcggacatccagctgaacagcttcggtttctacaccaatggctctctggaggtggagttgagcgtcctgcggctgggcctccgggaggcagaagagaagtccctgctggcgggg

SEQ ID NO: 9054 - DNA, 285 bp, Homo sapiens
  misc_feature 235: s=g or c
  misc_feature 236: s=g or c
  misc_feature 277: s=g or c
cccacttgcctgggagcgcccaactctgccacttgttggaggacagcacaagcctgagacctgtgcagtcacacagggccctgcatgcagaaggccccccacatttggcactggaggtttttcgtaattttatattttaatttgtgttttacaactgaagtctgatggaacactggagtatgcttagggggctgggagtgtcacccacagctcatccctctcctcattccccctsscctcacgactagtatagcccccactgaaaatgatgactctstccctact

SEQ ID NO: 9055 - DNA, 166 bp, Homo sapiens
atttctttgtagagatgaggtttcactgggttgcccaagctggtcttgaactcctgggctcaagcagtctacccactttgacttcccaaagtgctgggattacaagcatgagccgctgtgcctggcccccacactttttaaaagtaaactttttactgaagaacaa

SEQ ID NO: 9056 - DNA, 230 bp, Homo sapiens
  misc_feature 163: r=a or g
  misc_feature 165: r=a or g
  misc_feature 175: y=c or t
  misc_feature 228: m=a or c
tttttgagaatgggggtcttgctctgttgtccaggctggagtggagtggtgtgattatagctcactgtatcttccacctccagggctcaagccttccaagtggctggaactacaggtgtgcacaaccatacccagctaatatttccattttttttttttttararatgggggtcyccctgtgttgcccaggctggtctcgaactcctggacccaagtgatcccccctmat

SEQ ID NO: 9057 - DNA, 311 bp, Homo sapiens
atgtgatctcggctcaccacaagctctgcctcccgggttcaagcgattctcctgcctcagcttcccaagtagctaggattacaggcgcctgccaccaagcctggctaatttttgtatttttagtagagaccgggtatcaccatgctggccaggctggtctcaaattcctaacctcaggtgatccacccgcctcggcctcccaaagtgctgggattacaggtttgagccaccgtgcccagcccggtgtattgtattattagtggagacagtttctccatgttggccaggctggtctcaaactcctgacctca

SEQ ID NO: 9058 - DNA, 217 bp, Homo sapiens
ttttaaatataacttttaaagaaactgtcaagttatttttcaaagtggctctaccattgttcatcctcactggcaatgtgtgagggtttcattttctatccttatcaatacttggaattgtttgcctttttgattcaagccattctgttgtgtgcaaagcggcatctcattgtggttttaatttgcattttccctaatgatgttgactttttttttt

SEQ ID NO: 9059 - DNA, 191 bp, Homo sapiens
tgagaggacactgcagttgtccgtgctagtagccttcgcttctggagtactcctgggctggcaggcgaaccgactgcggaggcgctacttggactggaggaaaaggaggctgcaggacaagctggcggcgacgcagaagaagctggacctggcctgagactctgcgccttccgccccattctgtcccccta

SEQ ID NO: 9060 - DNA, 312 bp, Homo sapiens
cagaactgtgcacagggtgaatgtttaataagtattgcagtaattacttattacttctgtgttaattgtagtatgttccgaggatccaacctctgcagcacttttgctcagtttcttgacctgcataaattcccaagaaaattaacaaaaagtttgttatggtctgaactatgtccttcccaagttgataggttgaaatcctaacccccagtatctcagaatgtgactgtattttgagatagggtatttgaggaggtaataaaggttaagtgaagtcattagtgtgggactggtgtccttataagaagagga

SEQ ID NO: 9061 - DNA, 368 bp, Homo sapiens
  misc_feature 145: s=g or c
  misc_feature 336: n=a, g, c or t
ggtgatggcggggccggtgaaggaccgcgaggccttccagaggctcaacttcctgtaccaggccgcccattgtgtccttgcccaggaccccgagaaccaggcgctggcgaggttttactgctacactgagaggaccattgcgaasggctcgtcttgcggcgagatccctcggtgaagaggactctctgtcgaggctgctcttccctcctcgtcccgggcctcacctgcacccagcgccagagacgctgcaggggacagcgctggaccgtacagacctgcctaacatgccagcgcagcaacgcttcctcaatgatcccgggcatttactctgggganacaggcctgaggccagctcgggagcaagcagt

SEQ ID NO: 9062 - DNA, 234 bp, Homo sapiens
cctatatgtccttttgcaacatatttcatgctcttttgacttttttttttcttgagacagagtcttgctctgtcacccaggctggagtgcagtggcatgatatcggctcactgcaacctccgactcccgggttcaagtgattcttgtgcctcagcctcccaagtagctgggataacaggtatgtcgccaccatgcctggctaatatttgtatttttaatagagacagggtccag

SEQ ID NO: 9063 - DNA, 176 bp, Homo sapiens
ttttgatttctctgtcagaaatgtcacatatctctatttctccaggattggtttttggtgccttatttagttcgttttgtaaggtcatattttcctggatggtcttgatggctgttgacgtttgttggtgtctgggcctttggtgagactcagtgctgtgctagcttcaattctga

SEQ ID NO: 9064 - DNA, 194 bp, Homo sapiens
  misc_feature 180: r=a or g
gatttgctgataatcaaagaagcattaaaagtcagacttggccaggcacggtggctcacgcttgtcatcctggtactttgggaggccaaggtggtgggaagattgcttgagctcaggagtttgagaccagcctgggcaacatggtgagaccgtgtctctgtatttttaaaaaattaagaraaaaaagttggggc

SEQ ID NO: 9065 - DNA, 351 bp, Homo sapiens
catccttctaatgcacaggtccagtagctccatctccaaaagatttccaggatctcactctccccaccgctaccctgggccctcatcttggtccatccttcttcttctgccaccagcactacggcagcagcctcttacctgctgtccccgtcctcctccaacatgcagccacagggacccatgaacacctgtcactttggagccctctttccctcagaggggtctgcctgctgcacctcactccaggtagaagccaaggctctcagcatggccacaagggctatgtgaacctgcccatcatctctgcactcacctcctctcaccctcttttgttcactccaccccagcaca

SEQ ID NO: 9066 - DNA, 190 bp, Homo sapiens
gagaagggagaatgacctggagtttgtttttttttctttttaattatactttaagttttagggtacatgtgcacaatgtgcaggtttgttacatatgtatacatgtgccatgttggtgtgctggacccatcaacttgtcatttaacattaggtatatctcctaatgctatccctcccccctccccccaat

SEQ ID NO: 9067 - DNA, 359 bp, Homo sapiens
  misc_feature 328: s=g or c
  misc_feature 329: m=a or c
caaatggacttctctgaagctgtgtttagtgaaatgagctcaagtacatgaatgttagttgttatcacatacagcaaattcctttttttttctttttctatgagcacactctgctgcttctaaactttacatgcctgatggcaccttactccagcagcctccaggtgctttcattttcacttccagtctaagccagtggctcctgccactgccctcccattacctagatggcacctcctttggtgaaaccacggccaatgttccttagctgcaccaggcccgaagctgttcccatgcttgagcttccatggggaggatgctgagtgasmgttttcctacgccgtggatctagcaagccg

SEQ ID NO: 9068 - DNA, 275 bp, Homo sapiens
tcacttttttttttgagactgagtctcactctgtcgccctggctggagtgcaatggcacaatctcggctcactgcaagctctgcctcctgggttcatgccattctgcctcagcctccagagtagctgggactacaggcgcctgccaccatgcccggctaatttttttgtatttttagtcgagacggggtttcacagtgtaagccaggatggtctcgatctcctgacctcgtgatctgcccatcggcctcccaaagtgctgggattacaggcgtga

SEQ ID NO: 9069 - DNA, 175 bp, Homo sapiens
tattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccctt

SEQ ID NO: 9070 - DNA, 259 bp, Homo sapiens
  misc_feature 72: r=a or g
  misc_feature 179: r=a or g
  misc_feature 183: r=a or g
  misc_feature 234: r=a or g
  misc_feature 235: k=g or t
ttctctttgaagcaattgtgaatgggagttcactcatgatttggctctctgtttgtctgttgttggtgtatragaatgcttgtgatttttgtacattgattttgtatcctgagactttgctgaagttgcttatcagcttaaggagattttgggctgagacaatggggttttctagataracartcatgtcgtctgcaaacagggacaatttgacttcctcttttcctaattgarkaccctttatttccttctcctgcct

SEQ ID NO: 9071 - DNA, 245 bp, Homo sapiens
atatttttagcctatttataggttctgcttacttatggcttcatcttcctcataagttttgcttgcttatgaccctcttgacctcacctctgcattgtgttggcttgctgtgtatcctttcagcttcagtttcctttgcgaactgtgattacttttaatagctcgattccaattcctgagaagacaaatttactaggcctgttgtatcccagtttagttaagatatttatatacccacagcaacc

SEQ ID NO: 9072 - DNA, 393 bp, Homo sapiens
  misc_feature 32: w=a or t
  misc_feature 375: k=g or t
ggagttatccatattcttccctctctcccatwctccatatccagtaaccgagccctacggactctacctcctatctcacatgtgaaccttctctcaataacaaacataataatctcagtccaggaagattattgcaataactgcctcacatgtcttcctgcctccaaccaactctctagttgcagacagagtaatccttccaaaagacaaatatgatcatgtcactcactgacctaaaaactttccggtgacttctttattgttcatagactgcagaacttcaaacttcctggcatggtaaataaggtcctttatgacttggttcctgcatatctctacagtctcgtccatactctattgctcaacaaccccttkaacctcaccccccccctg

SEQ ID NO: 9073 - DNA, 242 bp, Homo sapiens
  misc_feature 17: k=g or t
  misc_feature 28: k=g or t
  misc_feature 37: r=a or g
  misc_feature 39: k=g or t
  misc_feature 45: s=g or c
  misc_feature 85: k=g or t
  misc_feature 106: b=c or g or t
  misc_feature 114: w=a or t
  misc_feature 156: d=a or g or t
  misc_feature 160: s=g or c
  misc_feature 187: s=g or c
  misc_feature 200: m=a or c
ttggttacatggttaaktcctttagtgktgatttctrakattttsgcgcacctgtcacctgagcagtgtacactgtacccaatakgtagtcttttttttttaatcbtagagagwaatttattttctttctctttccatcattttttaaaatatgtdagtscatatataacctttcatttattttaastaaaatttttgcmcctattgacccatcctctaagtttcttcccctcacctcccac

SEQ ID NO: 9074 - DNA, 289 bp, Homo sapiens
acagtctcactctgtggccagcctggagtacagtggtgcgatgtcggctcactgcaacctccgcctcctgggttcaagcgattctcctgtctcagcctccagagtagctgggattacaggcgtctgccaccacgcccgggtaatttttttgtatttttagtcgagacggggtttcgccatgttggccaggctggtctcgaactcctgacctcaggtgatccgcccgcctcggcctcctaaagtgctgggattacaggcgtgagctccgcgcccggccgcattggcatca

SEQ ID NO: 9075 - DNA, 401 bp, Homo sapiens
cacatcccatcttcaagatccagtcactcattccctcaactgttggcagtgttggttggctgctgccagttctcaggtgttccaagttcacgtttcctccaggggtgaagcccgtgtccattgactggttgatgaggaagtataacctaacctcctacacccttgtctcaaggtgggccaactgtgaagagttgtcccatgggtttggcctgagacctctgttgcatctacaccacagttcaacccatccctctgcccttgcactctcttcactcccccataggtgtgggtcccaagggcattcctcaataagcttcttgcacacaacctctatctcagtagtttcctaagaaacccactaccacaatgactgttggcacaatgatcttttgcttctgact

SEQ ID NO: 9076 - DNA, 189 bp, Homo sapiens
acagaacatcatctctacagatgagggacatcctagtgtgtgtttgtgtgttttgggggtgtgaggctatggtggaatcctttcctcattctctctatgcccgagagctggctggaaatgaagtgataaaattccttctcaggattggctggcagagtgacaaagctcttctggaatgagcactaaggg

SEQ ID NO: 9077 - DNA, 136 bp, Homo sapiens
ccgttgtcaccagccttgtttctagtgtgtatatatgtcgcccccgtgatgcatatatacacaggtattaaatatatcgctctatataatattatatatgtgtgtggtatccaaggaatcacttttatgagggcac

SEQ ID NO: 9078 - DNA, 132 bp, Homo sapiens
  misc_feature 10: k=g or t
ctaatatgtkactctgctcccaacaaacaggtctcctcattgtccttggcatttgacaagttatcccaacttcgaatctcatttcttcctttgctggcagcctccacccttccccacatcagtcggcctacc

SEQ ID NO: 9079 - DNA, 186 bp, Homo sapiens
gccagggagccaagtggtctagctcagcagattccatccccatggagcccagcaagctgatatcgactggcttgaaattcttgctgccagcacagcagtctgaagtcaacctgggatgctggagcttggtgaggggaggggcatctgccattactgaggcttgagtaggaggttttcccctcacat

SEQ ID NO: 9080 - DNA, 255 bp, Homo sapiens
taaggaataagcaatgttttaaaaccactcaaaatgttcaactgttgccaaaagatgctacggagctctccctaagcccgtggcccaccctaaatgtaacaggcccatgtttacaaacccaaatccatgcatctcagaggctcccacacatatcctagctgtccctcctcagaactccgtttggacagtctctggcagcatcaccggcagctgctgcctctctgggtgttcctgccactcagcctgggcccccct

SEQ ID NO: 9081 - DNA, 448 bp, Homo sapiens
  misc_feature 10: r=a or g
  misc_feature 237: w=a or t
ggggtgtagrgaaattgattttttgagccatacagtttttcattttttcctggatttctgcttgccttatccaggtttagcctcttctgtcaccttctgctttcaatattgggtctgctactgggcttgggtagggacccatccttaggcgcatgcgctagtatatttttccaaacatttgtatgatgcttcttcattctggaattttctaaatgcatccttcccttctatccagtwcttttacatctttgattactctctccgctttacgtattccttagggttttttcttagtagtattttctcatatatgcatgttctaggaaactatcttggagaggatgagggtgagaaagagagtatatgtaataggagaaaggaatagagtatgtgtagccaaggaatctaaccaggaaagctgggacttgagaatttttcagaatcacgt

SEQ ID NO: 9082 - DNA, 206 bp, Homo sapiens
  misc_feature 157: m=a or c
  misc_feature 158: m=a or c
agtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgammagatattcaggagcccttccattttccttccagtaggcaccgaaccca

SEQ ID NO: 9083 - DNA, 209 bp, Homo sapiens
  misc_feature 136: n=a, g, c or t
  misc_feature 151: k=g or t
  misc_feature 182: s=g or c
agtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtggnaagggtgtgtgtgtkttgggggtttgccggggcgcggagaggagasccgggccgaggggaaggaaggaagccc

SEQ ID NO: 9084 - DNA, 322 bp, Homo sapiens
tagttgctgttctcttgtcctagcagatgtcctctgtcccaagggcacagctttcattaggcccctgtaactgctccctgcccctgtgttccttcaggtctacctgtggtaaagacagcttcattcttgccagaagctgggtgcttcatcatcctgttttggttcccttcattctgcccatacatttgtaaatagtcctgtgaaagggaaatatcttgggcccccaaaatcactaagctaaagggaaaagtcccactgggaactgcttagaggaaacctacctcccattctattcaaagtcaccgctctgctcactgagata

SEQ ID NO: 9085 - DNA, 135 bp, Homo sapiens
tgtcagccctacaatgctttcaggggagtgttgagtgcagacaatacaatgctcttcctggaaaccttcttcctcttacctccctgtcccgtgagtcctccagctattttctgatacccagttattgcccacgac

SEQ ID NO: 9086 - DNA, 255 bp, Homo sapiens
tcagcactatacaaaatggaactctattctatccctctaaacactttccatcactttttgatatcttggagttatctttgataattgcccttcttgtacctaatattcagcttctggggcagtccaccctcatccacaaaatctgttgcaccaagctccgccattcctcctattaccagcccccttagggtaccaatagtgtgaaatactaacaatgctgtctgcgccctctccttcctccagtggctccctcac

SEQ ID NO: 9087 - DNA, 445 bp, Homo sapiens
ctagcgccaacacgccctcaggtaaaggtggaagtaaatggccacgctgtattgacagaggtagggtttgttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaataga

SEQ ID NO: 9088 - DNA, 392 bp, Homo sapiens
  misc_feature 49: s=g or c
caactctaaaaatctttacacagcctatggagagaaacctaagcaagtscccaaatcctcaagtgttccaggagaatgaaaagaattataaaggctaaagaattattagaatcagtgcagtgaacatgtagaccaaagcattcctgcatgccaggaaaatggtgcatttgaatgtttttgcttctcatgagaaaggcaatttaagttgcaaggcaaaggcaaacttttgaagatggccacgtggactctggatccttctctctttgttcatgatttgttctcccttcagtggttttgctccttgccaagcattaggtacccttggggtgggatgccactttttccacttagccttgggcaggtttcttctctccttatccaataatatttac

SEQ ID NO: 9089 - DNA, 315 bp, Homo sapiens
  misc_feature 32: d=a or g or t
  misc_feature 49: k=g or t
  misc_feature 68: r=a or g
  misc_feature 69: r=a or g
  misc_feature 267: v=a or c or g
  misc_feature 268: h=a or c or t
tttaagtggggacacaaatcctaaccatatcdggcagctattaattgtkttcagatggataatttacrratattttctcccattgtgtggattttctcttcactttgtttcttgtttccttcactttaaaaaggctttctgactttctgtaatcccatttgtccatgtttgttttggttgtctgtgcttctgcggcattatttaaggaatttttgcccaaaccaatgccctaaagagtttccccaatgctttcttgtaaaagtttgvhggtttgaggcattaggtttaagtctttaattcattttaatttgattt

SEQ ID NO: 9090 - DNA, 176 bp, Homo sapiens
ttcttaagattccatgagttgactagttcaattctgttccatggggtgttggctggtccctgtgttcagttggtgccggggctgggctggaaggtccaagacatcttttctcacatgtctggtacctcagtgcttctccacgtggcctttctacctggcaggtttgggcgccctct

SEQ ID NO: 9091 - DNA, 221 bp, Homo sapiens
agctgggattacaggcacctgccaccacgcctgcctaatttttgtatttttagtagagaccaggttttgtcatgttggccaggctggtctcgaactcctgacctcagttgatccgccggccttggccttccacatagtgctgggattacaggcgtgaggcaccgcgcccagcctatatggaggttttcggctgagctgggggtcagtgcccctcgcccacc

SEQ ID NO: 9092 - DNA, 412 bp, Homo sapiens
gtccaatatgcagctaagatacagcgccattgctctatcatgtcttcagctgtggtcatcaacttaggctccaaaactgatattttatgaatgattggaaagtgcctgacaaataaaaggtcattttgctctttaaaaaaattgcatggactgaaagcagggctgctactgcagttggatttgaggaaatggtgtagttgcaggagcttgtacccttttgaaggctgccaacaattatctgtgggtcatgtgaaatgagttttatgtcaacagagttgaagctgttttctctgagtggttaactacttttgcctggttaaataagcaaacaaaagtgaaatagggaaaagagcagagtttgattagccttgtgttcacctgagataagtggcctccctttctcttaggttta

SEQ ID NO: 9093 - DNA, 208 bp, Homo sapiens
cacattctgcactctagcccagaagtcacaaactgatggctctagtgtcaattctgcctgtagtgctgaccactcatacagctggcctgcttccctgatttatctattagcaactcctacttctggccatatggaattttgttcagttcttcaaaggtgcctattctcctttgtcacttcggtctttcatatgctgttccctctgcct

SEQ ID NO: 9094 - DNA, 169 bp, Homo sapiens
catcagaactcactatcacaagaacagcatgggggtaactgcccttatgattcaatcacctcccacctggtccctcccacaacaagtggagattatgggaaccacatttcaagaagagacttggatgggaacacagccaaactatattattctgcccctggcccttccc

SEQ ID NO: 9095 - DNA, 449 bp, Homo sapiens
  misc_feature 10: w=a or t
  misc_feature 11: y=c or t
  misc_feature 325: m=a or c
  misc_feature 326: m=a or c
  misc_feature 389: n=a, g, c or t
atcacacacwyacatataaccttttctacagtaggtgcactgctgctcaagacatcaaacagaagattttcaagagctaaactagtaaaatcttcatttagtgaattgaattagccatctgtgctaggaaactaagacactgttcataaatgtaactaacaacttttggaactgcaaaaattccaattgagatcatttgggagcaatcccagaaagtaagcagataactaattatttgtattataaccctgttttgacaaggaccatgggaaacagaagcatagaatatggagagttgtcaagtctagcattggcggtgcccatmmatgcctcatgcaaggtgaggaaggcttgctcaccagattcaagtgctacagttttcttggcanggctgtcccttccatgggtggggggcctccggctgcgtttgctgaaagacacactgtagt

SEQ ID NO: 9096 - DNA, 389 bp, Homo sapiens
  misc_feature 318: r=a or g
  misc_feature 319: r=a or g
  misc_feature 330: h=a or c or t
  misc_feature 331: h=a or c or t
  misc_feature 339: r=a or g
  misc_feature 348: w=a or t
  misc_feature 349: s=g or c
acacaaaacccagccaaaagcggcgagaggaaaagcgaatatggcgctgctgaaaatggagactccgcatctagaaagtctttctttcctttcctcttttcgctcttacttcgtcgatcttttcccccttgccctctcacgagggcctcctgctttccttcgggtgttctctacccctcggcccctttcctgttcttatgaataacctcctttactcggttttccttcttcctttccactcccggttcctctttctccattttgtgtcacaggcgccttgcttcttgttccctttcagggcgcgcactcccccgcccrrctcactttathhtgtgtgtrggtggcggwsagggagggggtggcaaggatcgtgaggctaagtatcgagt

SEQ ID NO: 9097 - DNA, 392 bp, Homo sapiens
  misc_feature 350: s=g or c
tatttttagtagagacggggtttctccatggtggtcaggctagtctcgaactcctgacctcaggtgatcagcccgcctcagcctcccaaagtgctgggattacaggtgtgagccactgcactgggaccttgtatgtcttctttagagaaatgtttgttcagatcctttgcccatttcttttctttttcctatttcttgtctattgtttttctttttcctttttttttagtttaatttaattttaagttccaggatacatacgcaggatgtgcaggtttgttacataggtaaacatgtgccatggtggtttactgcacccagcaacccatcacctaggtattaagccccasatgcattagctatttatcctgatgctctccctccctcccgac

SEQ ID NO: 9098 - DNA, 223 bp, Homo sapiens
tttatagataacatcactattttagaacccaagattgaccttttgagatgtcttttcagactttgcatttctgatgaccagctgactccacctggacctgcaatttgtgactcaacaggtcctgtggccccacaggcacccagagactgactcagtgcacaagaaccattttccacacacctatgatttcattcccaataacactcctgttccctagcccccc

SEQ ID NO: 9099 - DNA, 290 bp, Homo sapiens
  misc_feature 11: s=g or c
  misc_feature 12: b=c or g or t
  misc_feature 43: k=g or t
  misc_feature 253: k=g or t
tttctaatctsbtcaaattttatcaccatacaatcagtggtaktgttggaaatagtgcaactgcattattgactaccattgaagaaatgcatttgctaagcaaaaaaatattcttcaattagcttgaagtcttcatgcaagtaaattaatggacaaggttgaactcccaccacctgatcttggaccaagttctgcactaaatcagacactcatgttgctgcgtgaagttttagcatctcacgattcttcagtkgtaccattagatgctcgtcaagctgattttgtgcagg

SEQ ID NO: 9100 - DNA, 402 bp, Homo sapiens
  misc_feature 10: k=g or t
  misc_feature 32: r=a or g
  misc_feature 33: d=a or g or t
  misc_feature 119: k=g or t
  misc_feature 124: r=a or g
  misc_feature 125: k=g or t
  misc_feature 138: v=a or c or g
  misc_feature 226: s=g or c
  misc_feature 227: s=g or c
  misc_feature 365: s=g or c
  misc_feature 367: s=g or c
cgatcttggktcactgcaacctccacctcctrdagttcaagcaattctcctgcctcagcctcccaagtagctgggattacaggcacccgccaccatgcttggctaattttttttgtatktttarktagagatggagtvtcactatgctggtcaggctggtctcgaactcctgacctcgttatccacccgccttggcctcccaaagttctgggattataggcgacassaccgcacccggcctaattttttgtatttttagtaaagatggggttttgccatgttggctgtggctggtctcaaacttctgacctcaggtgatcagcccacctcagcctcccaaagtgctgggattacaggcataagcsascgcgcccagcctactgtgtgtattttgttttttgt

SEQ ID NO: 9101 - DNA, 368 bp, Homo sapiens
  misc_feature 202: k=g or t
  misc_feature 268: k=g or t
  misc_feature 323: d=a or g or t
actagccatgctgaaccactagtacttccctaaacacaccacattgttttgcagctctatgccttggcccctactctcccctctgaaatgcatttccccttctagatgagaccacggaacctcacttccactgtgaagcctgcttccaccccacagcctcaccagcttccaccccacagcctagcactcctgtgtgcctgtkctagtccttttacttatgctaactggtgcacatcttgctgtctgttctaataatctggtctccttkctgtcttctgcacagtgaactctgaagtacaaatctaggcttttccctctctgtdcccagactctaaaggaaagtacctggagcacagcagctgttcagt

SEQ ID NO: 9102 - DNA, 241 bp, Homo sapiens
  misc_feature 118: y=c or t
agcctccccctgagaaagttccatctgacatccaaaatcgctctgaaacccgcgctctcctttctcctctccctccccaaggcctgtcctgatccaggaacctccaagccttttgccytggtctccaggctcctagactctcctgccttgaatccaccctccaaaaggactgggagccccagcaggacaggactggaaccatcgtggtcactgttgtgtctcctgcaccacccaacaccac

SEQ ID NO: 9103 - DNA, 343 bp, Homo sapiens
aggaggaaggagggaggcagcgctccggcggctccgcgccccgcactcccggacccgaagccgggaagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtggg

SEQ ID NO: 9104 - DNA, 482 bp, Homo sapiens
  misc_feature 49: k=g or t
  misc_feature 169: k=g or t
  misc_feature 173: k=g or t
  misc_feature 350: k=g or t
  misc_feature 373: k=g or t
  misc_feature 387: k=g or t
  misc_feature 391: k=g or t
  misc_feature 421: k=g or t
  misc_feature 443: k=g or t
tttaagtggggacacaaatcctaaccatatcatgcagctattaattgtkttcagatggataatttacaaatattttctcccattgtgtggattttctcttcactttgtttcttgtttccttcactttaaaaaggctttctgactttctgtaatcccatttgtccatgtktgtkttggttgtctgtgcttctgcggcattatttaaggaatttttgcccaaaccaatgccctaaagagtttccccaatgctttcttgtaaaagtttgatggtttgaggcattaggtttaagtctttaattcattttaatttgatttttgtaagtggcaagaaatagggttctagttttatkcttctgccaatggcttgccagtkttcccagccctatktatkacaaaaactgtctcatttttattgtgtgtkcttggcacttttgttgaaaatkaatttagctgtccctcccataggattccagaatgctgct

SEQ ID NO: 9105 - DNA, 157 bp, Homo sapiens
cacatggatagtttttgtattttgtctttcccttctagctgtttctgataattactgctctgccaaccacaagctacttcatttaagtagcttaaatggtgccaaaaatcaaataaataaaataaaatttataatttcttaatttaatgatgctatc

SEQ ID NO: 9106 - DNA, 372 bp, Homo sapiens
  misc_feature 117: s=g or c
  misc_feature 121: k=g or t
  misc_feature 353: w=a or t
agagttacattgatctttattttaccatcaggagagccatgaatataaaggcaagcacttctactctaatgatagtatttctgctgcaagtacttctgatgttcaagatcgcctgtsagckcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggawaagaaactctttcatctgc

SEQ ID NO: 9107 - DNA, 371 bp, Homo sapiens
cccttccctgccggcctctgatggatcagtgcctgacgcggcgtttcctcctggcacacactgctgtgttctcgtctcggttgtctgtgttcttggaaactttagtagaataaaacaaagtaaacaagaagcctggcttttaaagaaaatagcctctaaatagctcattcattataatgatttgggttccagtcctcttagagatgttcaaacataatgtctatgaaaacatctgcagagcggcttcacccaggaggtctggtggttgtgagagcgctgcttacttctgagccaaccaggttttcttttccctatcgcccttcagggttcccagggtggagagcctctgccaccctcctgtcccccgacat

SEQ ID NO: 9108 - DNA, 200 bp, Homo sapiens
  misc_feature 114: r=a or g
  misc_feature 127: y=c or t
ttcatttgtaaattctgttggatgctctgccaggcttttgttttctgttttctggtttgtttttaatttttttttaaacagtcttgcactgtcacccacgctggagtgtagtgrtgcaatcattagytcacttctgccaggcttttgaatcaccttctccccaaaatgttgcctctcatattatccaacttggccccact

SEQ ID NO: 9109 - DNA, 255 bp, Homo sapiens
gtcgccaaggcgggagtgcagtggcgcaatcttggctcactgcaacctctgcctcccaggttcaagcaattctttgcctcagcctcctgagtagctgggattacaggcgcctgccaccatgcccggctaattttttgtatttttagtgaaggacagggattcaccatcttggccaggctggtcttgaactcctgacctcgtgatcacccgccttggcctcccaaagtgctgggattacaggaatgagccaccgct

SEQ ID NO: 9110 - DNA, 378 bp, Homo sapiens
  misc_feature 296: w=a or t
  misc_feature 369: k=g or t
gtaatgtagaaaagacagctggagttaggcaactgtgaggagaggctaaagccacatcaggggtacaaccagcttaaggggcagcatgaggtcaaggagtgcatgactgaagctgcagcacgtttcttcacagccagtacagagtggagatgaggttgggcagttcatatggtctctattagatagataattttatcccatgcagaagggcttggtgtttaaactaaaagatggtaagaccattagagggttttaagcaagggcagggatgtacacagagttgctttttttttttwaattttactttaagttctgggatacatgtgcagaacatgcaggttcgttacataggtatacatgtaccatggkggtttgcta

SEQ ID NO: 9111 - DNA, 321 bp, Homo sapiens
  misc_feature 7: n=a, g, c or t
  misc_feature 92: r=a or g
  misc_feature 132: r=a or g
  misc_feature 236: r=a or g
  misc_feature 270: n=a, g, c or t
  misc_feature 271: n=a, g, c or t
  misc_feature 277: w=a or t
  misc_feature 278: m=a or c
gcagagntgagcggggcgggagaggcaagggagacaaggaacaagggctttttagaatggtacgcctaagtctcagttctctttgatgatgrgttcttgctccctcttctgtactatcccagtggggaaatrgaaaagagctgattttacttgcctgctgctgtttggtttgttgcttcctaccccaaagcatttccctaaaggaagacgggaaagaaaggagagagaaatcctaraaacaggactactatatgttgactgggatggtannggatawmtgaggtaaactcagtttcactgttttggattaattgcattaga

SEQ ID NO: 9112 - DNA, 177 bp, Homo sapiens
attctctttttgttttgtttctttgcttttcacatgttaccagctacataatttcttgacagaaaaaaataaatataaagtctatgtactccaggcatactgtaaaactaaaacaaggtttgggtatggtttgtattttcagtttaaggctgcaagcagtatttacaacagagggaa

SEQ ID NO: 9113 - DNA, 163 bp, Homo sapiens
gaggaaggaaacctcctcccatttggaagggcagaagctctttccaatgactatacttccaaatggtcacctggatacatctgtgaccaaatattagagcctctactgagcatctgctgtgtgcagagtactgctaatcaatttggaaatggctgatttggct

SEQ ID NO: 9114 - DNA, 211 bp, Homo sapiens
tagaaaagcaagaactgggactagtttcaggattttctgaatctagagaataaaataaacagttgctagatgagctaatgtcatctagaaactgtttctttccatctttcctctttgggctttattctttcagggctgttgacagttctaggattaagctcagtttattaaccaaggaggaagaaaccccttctgcctactacagatccct

SEQ ID NO: 9115 - DNA, 133 bp, Homo sapiens
gtctcccaagtagctgggaccacaggcatgcttcaccatgcccagccatttttttgtattttggtagagacgggtcttgccatgttgcccaggctggtctcaaattcctatgctcaaacaatccaccctcctt

SEQ ID NO: 9116 - DNA, 323 bp, Homo sapiens
  misc_feature 280: k=g or t
  misc_feature 281: k=g or t
ggagctacctgcataggagggacagcccgagctgctaagccgggtctgcacaggactgagggctggctgatgacaggagggcctttcgctggggctgctgggtcttggtttctcaggctggttttcctgtcgttggaaactgcattgccctgagctctgcgtgctgaaataaatctaagggcaagtccagctgttggaggaatgtagttgtgtttggaataagtagcatcggtagcgtgccttttcctcatgtgaatcaccagggctctttcttgctcakkaagttggaggcacaaatcctgtatcccctcacccccgcccat

SEQ ID NO: 9117 - DNA, 412 bp, Homo sapiens
attactggaagaaccatcttacagttacagtcacctcctggtcaattcccaacattcaaaagctaaagaaacaggctcagaggatgttatttgattggactatgttgtatctctggagagcacagctgagatcagactgtgtgtgtgtaactccactagactacgagggtgcttctcataaaggtaagaaatgcaaatttggcctaatatacgatgttgcccggggcagcactgggtcacttctatagacacttctgtgttaatcaagggaaatcttaagggaaggtgaaaatgcttctagaaggcgactggacaccagcacccttgcttgctgcctttgggctcttcctctaaggccaacagtgacctgaaattattgactggctggccgtgctaatcaactggagaaaat

SEQ ID NO: 9118 - DNA, 338 bp, Homo sapiens
  misc_feature 101: y=c or t
atgattgtaccacacaaagtaatgtaaaacattaaaggactcattaaaaagtaacagttgtctcatatcatcttgatttattgtcactgttgctaaccttycaggctcggaggagatgctcctcccaaaatgagttcggagatgatagcagtaataatgagacccccgggctccagctctgggccccccattcaggccgagggggctgctccggggggccgacttggtgcacgtttggatttggaggatccctgcactgccttctctgtgtttgttgctcttgctgttttctcctgcctgataaacaacaacttgggatgatcctttccttccatttt

SEQ ID NO: 9119 - DNA, 269 bp, Homo sapiens
  misc_feature 2: n=a, g, c or t
  misc_feature 4: b=c or g or t
  misc_feature 22: w=a or t
  misc_feature 32: d=a or g or t
  misc_feature 73: b=c or g or t
  misc_feature 191: r=a or g
  misc_feature 228: r=a or g
  misc_feature 229: w=a or t
antbgttcagcacttggacggwgatgccagcdgcttccaggcagagggagaatcgaagctaagcatattttcbtcaaatataacctggtctgcagaggtgcagctctgacttcaacatcaccattaataacttcatcaccaagcaattttaccttcttggagctgaaatgtcaagcatcaccacttgtgtrgagggactttgtagagctaaaaagcctactggagttrwttcagaacaacaaaaaaaccaccccccaacaattattgaa

SEQ ID NO: 9120 - DNA, 300 bp, Homo sapiens
agccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagaccctg

SEQ ID NO: 9121 - DNA, 172 bp, Homo sapiens
  misc_feature 62: n=a, g, c or t
  misc_feature 115: n=a, g, c or t
agaagcggccgcaggggtctgggcagggctgggcagtgctgccggagcaaaagcggtagcgngagcccggccggagctgggtctggagacgccgtggcagcctgaacggagtgtngcgacggattgggaggtttgtctacagattttgagcgttcgaagttgacccctaact

SEQ ID NO: 9122 - DNA, 218 bp, Homo sapiens
ctgtttgccatttccaaagtgtcagaaaaggagcacgttgttcttctaaacattgacagttcgctcgcattccctcctcacctgcctcccaggagttgcctgctctggcatctctttctacctttcagttgtcttgtgtatccagcagatctcggcagttttcgacagtgttctttaaatgattttgtttttaacctaatcgttagaagcaggggcaa

SEQ ID NO: 9123 - DNA, 317 bp, Homo sapiens
cttccttccatattgaacatacttggaagaggaaagggtagtaaaatgcagtattctcactttcttatgaggcttagattcagacatggattagttcttatttgcaatttctcctttaaaatcgaaggtgataacatattttaaacacataaagtggttcaatgcttagacacgaccattaagccttagcagtttgtttctccggcttttgagagcgctgcttattcatttacagtggttctgaaattgtttcacagtggcttccatgcaaattataaaagttgcttatattttatgaactctgtatcacaaagctt

SEQ ID NO: 9124 - DNA, 179 bp, Homo sapiens
  misc_feature 123: r=a or g
  misc_feature 130: m=a or c
  misc_feature 137: m=a or c
  misc_feature 141: m=a or c
ttttttttttgagacaaggtctcactcagccattcaggctggagtgcagcagcacaatctcggctcactgcaacctccacctcttgggctcaagtgatcctcgcacctcagcttccccagtarctgggamtacgggmacgmaccatcacacctggcaaatttttgtattttgtattttt

SEQ ID NO: 9125 - DNA, 152 bp, Homo sapiens
tgttttcttgctattgagttatctagacattttgaatattaactccttatcagataggtttgcaagcattttttcccattctttaagttgtctctttactctgttgattgcttgcattgctgtgcagaagccttttagtttgacgcagcccc

SEQ ID NO: 9126 - DNA, 298 bp, Homo sapiens
attccaggttgactccaccagcgagaatcacaggtagaacggtcagagtagcgggaggactgggaaggtgggaagtgggaagaccgtccaacatggcgctgtggaaagccagcgcagggccccaggggatcttccggggcggatgcagctgcctaggagtgctggggctcgcgcgcctcggcggctcaaactctgaccccttgagatcctttccagcccgaccccttactttaggggtcagcctgcccccgtaagtcctgttatttattgtatttatattctttttttagttggtccc

SEQ ID NO: 9127 - DNA, 338 bp, Homo sapiens
caaattgtcagtctgctaatgagaatcgtgtgttataaatggcactcccatgggtaggtattcccaggtctttattattaggttggtgccaaagtaattgcagtttctgccactatattcacagagcccatcacatgtctgctgcgtggtcctcggtagtgacagtctgttcaatagggtcaccatgagggcaggctcctgaaacccctgtggtaagggaatttactaattaggaaaagtggcatttaagcctcaccacaagtaagcccatagaagttcttaaatattaattaaagtaataaagatagcatactaaataatgtaaacattccatctaa

SEQ ID NO: 9128 - DNA, 292 bp, Homo sapiens
  misc_feature 119: y=c or t
  misc_feature 138: n=a, g, c or t
  misc_feature 139: n=a, g, c or t
tatatgattaactgaaatttggggcatgcattatttattatacatggcctacaacggttctgtctgcgctgttacgtattacctacacttctgggtttttttgttcttgttcctcagcytctctttaagagttcttgnnccttccttttccctctttctattttaacagttttaattttagaaccatttacattccagtaggtaattcactatgcgctttatatgccttagggcatccaaataaaaaacaatagggtaaacatccccaaaacccacctttaaaaaaaaaaaa

SEQ ID NO: 9129 - DNA, 317 bp, Homo sapiens
tatagaatactaaggagttttttgttgaatatatatcttgcagctatcttccactcagtggcttgccattcattttaatgatgtcctttgatgaacagaagttcttagttttaggccaagtatggtggctcatgcctgtaatcccggcgctttgggaggccagggcaggaggattgcttgagtccaggagtttgagaccagcctgggcaacagagtgagaccctgtttctgcaaaaataaaataaaataaaattagctaggtatggtggcatgcacctgtgtggtcccagctactcgggaggctggggccggggcac

SEQ ID NO: 9130 - DNA, 131 bp, Homo sapiens
aactaattttgtatttttagtagacaccgagtttctccatgtgggtcaggctggtcttgaactcctggcctcaggtgatccatcctgcctcagcctcccaaagttctgggatcacaggcatgaaccaccgc

SEQ ID NO: 9131 - DNA, 141 bp, Homo sapiens
tgcctttccattttccgttccttgggtttgtgtgtctgcatctccatcttaccccttgcctgactgtaccccgtagacccctgtttctcctcctgcacctgtgtccccatctgcccttcttgttgctcctgtcatgtgtcg

SEQ ID NO: 9132 - DNA, 152 bp, Homo sapiens
tgtagagatagggtttcaccatgtcgcccaggctggtctcgaactcctggcctcaagtgatccgcccaccttggcctctgaaagtgctgggatcacaggcgtgagccactgcgcccagcctttaccatgttttaaggagacttttttttttt

SEQ ID NO: 9133 - DNA, 254 bp, Homo sapiens
  misc_feature 218: r=a or g
aaaagggaaaggggctgggatcgcgtggggaggaggaacgaaatggaatcccgcgtgggcaggcggctggccaggagcacattcccctagcctccctacgcgccagccccgcggcgttgggaagctcctccctgacctttccttcctcctcctcctcctcattctaggcggcagtggcgggcgaacgtgagcgctgcggtattttgtcccgaacggtracccctcctcccaggcaggctgcggcggcgtcgacg

SEQ ID NO: 9134 - DNA, 163 bp, Homo sapiens
ataaatactccctgggtcctgggtcagtttgaccctagccctggggtgaggcaagccccctcctatgaggatgagcaaaaatactactctcttcgccctgagttgctttctggatctggggcttcaggacttgctgcttcagtcagcctttattagcaccaaa

SEQ ID NO: 9135 - DNA, 418 bp, Homo sapiens
  misc_feature 8: n=a, g, c or t
  misc_feature 162: k=g or t
aacgaggnctttgggaaatgattaagtcatgagggctctgccctcatgaatgggattcgtgcccttacagaagaggcttcagagagctgcctgctccttccatctcttccaccttggggaggacacagtgttcgtcccttttgtcctttgtccctccgccakatgaggatgagtaagaggagccaactatgaagtggagagagacagccctcaccagacaccaaatctgctggcaccttgatcttcgacttcccagcctccagaaccgtgagaaatgcgtttctattgtgtattaattactcaatctaagctactttgtatagtggcaggaacagattaagacaatagctcattttcgtcttcctgcaatgtttatatcagtggagggagacttactacataatgcttgctggatggt

SEQ ID NO: 9136 - DNA, 135 bp, Homo sapiens
actcagctggtcggggctttcgtccaggctttgcgctccctgctcaggcctcccgcagcaacctcaggtccagctcttcacctcacagccgccccatcctccttccctgtatctccagcatattaaaacccaagc

SEQ ID NO: 9137 - DNA, 274 bp, Homo sapiens
cattccactggcagtgtacgaggactccacgtccccaccaatacttgctcttttccattctttttccaccgcaacctccgtctccccggttcaagtgattctcctgcctcagcctccctcttttttttttatttttgagacagtctcgctctgttgcgcaggatggagtgcagtggtgctatctcggctcactgcaatctcagtctcctgggttcgggtgattctcccgcctcggcctcccaagtagctgggattacaggcatgcgccacgcac

SEQ ID NO: 9138 - DNA, 282 bp, Homo sapiens
tgatattcagtgtttaatatttaatgattgaagctgtgcgtttacacacacagatgtgcacacacataaccagcatagggctgttgttattaattgaaggacctttattaaatgtaatatttccatgtgttgttttttttctcccccagctatgggaggtttatggagaacggcgctgtctgagaacatttattggtaatgcttcttttctctccaacataaatctgggaagaatttttaaagtaagataacatcattgacaataactttactacaccgata

SEQ ID NO: 9139 - DNA, 400 bp, Homo sapiens
  misc_feature 320: s=g or c
  misc_feature 359: n=a, g, c or t
acatcttcgagcgccccatcgtgtccgtgtccttctttagcgactctgcgctgtgcttcggctgcaagttccagttcaagcctattcgggtgtcggaaccagtgctttccctgccggtgcgcaggggaagcgtgactgtgctcagtggatatgctgctgatgaaatcactcactgcatacggcctcaggacatcaaggagcgccgagcagtcatcatcctcaggaagacaagattagatgcaccccggttggaaacaaagtccctgagcagctccgtgttaccacccagctatgcttcagatcgcctgtcaggaaacaasagggaccctgctctgaaacccaagcggtcccaccgcaangcagaccctgatgctgcccacaggccacggatcctggagat

SEQ ID NO: 9140 - DNA, 154 bp, Homo sapiens
ctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccg

SEQ ID NO: 9141 - DNA, 210 bp, Homo sapiens
ccttttatggttcagacttccttcttcatcgactctccctaattctcttcactgttcatccccagcaacttttcttcccaagcatttcctgcgggcttttattaccccaggagtgccaatcaaggcgtggaacagataaagctgtgtagcaactaacgcgtgactcttgtgagtgtggagggcaaacgaagctccctgaaacctccgact

SEQ ID NO: 9142 - DNA, 499 bp, Homo sapiens
ctttttttctgaaaggcaaatgcatgacttttattcttttgggtctcagtgtgtttcttgaactgtgtgacttcaatatctgtgacaagtttttattttcccttagttgtatgtgaagaatttattctatagtcgtgatcatgtagtcctccattgtttggaagtgcagaccatggattcctatgcagcagatgggggttgtctgtttgtgcacttttttcctaagctgctgaaattcctccgatgtgaatgggccatagtaatctttgcctcctgcgtgactgtaagcatggcctccagtggatcagagaaagcagctcagtgattgttctcatggccaaaaataaagcacaagggttaccggaattgaatgagccctgttcagggcagcacggggcatctgcaccccagctgggcagcatgatccttgtattcaactatactcttctggcagtagttggtggcagcattcgcgtgcctctgtcacaccatacgtaga

SEQ ID NO: 9143 - DNA, 282 bp, Homo sapiens
aatttcagaacattttcatcactgcacaaaggagccgtatacttgttagtgatcagtctccactcttctctgcctccttcctctggcaaccaccgatcgactttctgcctctgtggatttgccagttctggacatcccatataaatggaattatacaacctgtggtcctttgtgactggcttctttcacttagcataatgtcttcaaggctcatccatgttgtagcaggaatttctattacatcacaatgttacgggatccagtgtcacgttacctgaacct

SEQ ID NO: 9144 - DNA, 215 bp, Homo sapiens
caattttgttgatcttttcaaaaaaccagctcctggattcattaattttttgaagggttttttgatgtctctatgtccttcagttctgctctgattttagttatttcttgccttctgctagcttttgaatgtgtttgctcttgcttttctggttcttttaattgtgatgttagggtgtcaatttcggatctttcctgctttctcttgtggggcaa

SEQ ID NO: 9145 - DNA, 255 bp, Homo sapiens
agtgcgtgggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgcagaggccgtcca

SEQ ID NO: 9146 - DNA, 199 bp, Homo sapiens
agtgctgtgggcaataatctgcttgaggtttaaaagttcctcagcagtttactttttgtataatacttgtaccagtttttggaaacttaagtttcattttgttttactttattatgcaagatttgaggctctataccagcaagtctgacacttatacaaacctagctgcctggaagggatgggttttgtaaacactccg

SEQ ID NO: 9147 - DNA, 213 bp, Homo sapiens
ttgttgttgttgatgtttcatttgaatttatttattttttgagatggtgtcttgctctgttgcccaggctggagcgcagtgatgtgatctcagctcactgcaacctctgcctcctgggttcaagcgattctctcacctcagcctctggagtagctgggattacaggagtgtgctgccacaccccaccaattttgtatttttagtagagacagg

SEQ ID NO: 9148 - DNA, 436 bp, Homo sapiens
  misc_feature 344: s=g or c
tctagtccctcagtaaatcctcttgacttatatttgaaatatatcctacatctgactgcttcccatctatcactgtcacctttttctgagtcaccattggctcttgtctggactatgatactagtcttctcactggtctcctggtctcaatccttgcccccctacagtctgatctccatagaacaaccagagtagtaatttaagaatataagctacatattgtcattcctctgcttaaaactttctaatgactcccatcacacactgaggataagattcaaagttgtttccttggtttataatgtcttaaaaattctcattcctttgcttgcctggcttcagasacactggtttttgtacttgccttaaacacactaagattgtccctgcctcagggcctttgtcctcgatgtttcctccacctgggtgtctgtat

SEQ ID NO: 9149 - DNA, 337 bp, Homo sapiens
cctaaaatatattctaagaggttgatatcctcattatgataaatagcagctttttagaagatagccactacttatcaatctttcttttgatttcttattggctctcgtctggacttttgaactcctggccaccattcaactccctattcaaatgctgtttctttttggtatcctctctttcactggatcttctctctcctttccctttttctctaatacttggatcctcattatagtattttcattagtctactttttacagtcacatttggacctggactcatgtaaacagaaatggtgagatgtctctagagacactcattgaatcagggattac

SEQ ID NO: 9150 - DNA, 213 bp, Homo sapiens
  misc_feature 121: s=g or c
attcccaggctggtctgagctccggggccgtggtcccgctgcctcctccggtcgtcgtgcggaagctgcgacgcaggcagaccatggcagagttctcccagaaacgggggaagcggcgtasgacgaagggctgggcagcatggtggacttcctcctggccaatgcccgcctggtgctgggcgtgggcggggctgctgtgctgggcattgccac

SEQ ID NO: 9151 - DNA, 397 bp, Homo sapiens
  misc_feature 285: w=a or t
tatttgtctgaactctgttacataaaaattggtatgattcatacgtggaatcagtttttggactgtgacccatgcagtgttgggggacaaggagttgcttcaggagttagtgcggtgcgcctccaaggggcagtgagccatggaggcacctgccttctcactgcagtcaatgcagccacacttgtgtatactgagtgctgcttcagatctcagtagataaaataattccacatttaaaatgattctgctattttttataaagggtttgaaagccactactataawgactttgtcacctaattgattttctactaatttttacatattcagaaacttcgtgtttttttggtggacagaatattttggaggtctccgtcgctgtttagaatgcggccac

SEQ ID NO: 9152 - DNA, 150 bp, Homo sapiens
atacatatacttatacttatattgtttgttttttgagacggcgagatggtgttttgctctgctgcccaggctggagtgcagtggtgcgatctcatctcactgcaacctctggctcctgggttaaagcgattgtcctgcatcagcctgtta

SEQ ID NO: 9153 - DNA, 449 bp, Homo sapiens
ttgtacctgcaggaataactttgtttttaacattaatcagtgtgagtataatttatttgtggtattattataccacccactgtcatttgtacctttcgtttctcatatctcccttaccctcttcccaaattttcccttatgtttccccttctgcctttctgccttttaagtggtatcagagatactgcacagaccaacctgtaattctcagagttgcagaggctgccacctgaaactgtgtcagggtgtatgtattctgactcctaaaaaatcacctaaggcttctaaagaacaaaattaaatatttaagaaaatccctaggaaaactaagataggaaaaacaaggtgaagctacaggtaaagttagcactccaatgcatgccatagctccttcactttgataaagatgggcatcaaatcggcccctaagctaccaagcagccatcaca

SEQ ID NO: 9154 - DNA, 138 bp, Homo sapiens
acttacttccttcttttccttcacctcggcccggctctgaaaggatcgggcccctccggcccgcacccacccccaagaggggccttcagctttggggctcagaggcacgacctcctggggagggttaaaaggcagacg

SEQ ID NO: 9155 - DNA, 236 bp, Homo sapiens
cagaagtacaaagaacaaaggacaccagccaggtagggcaaaggcctgtgcacccccttttgctgttacatgtttatcagatgcgtgctctgtttctgttatattacattacttttctcttcaatgtttactgaggaagaacaagtagctcctcaggcaaatcaactgttaactttgcagtttttatttaatctcccaggaatgtaacccttaactttaaagaatgtagtgaccac

SEQ ID NO: 9156 - DNA, 213 bp, Homo sapiens
gagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatcggcgagaaacgtttcctgccccctgaaccacccca

SEQ ID NO: 9157 - DNA, 253 bp, Homo sapiens
cttctttgtaactcctgcatatacctttgcatttatgtagcttctggagggcacatggaggtagctcaccatggttttaatttgcatttctctgataatgaatgagacttagttcttcctgtgggttgcctgttaagactttgccatttatctgttgcaatctttatttcttgctgttttgtaggagttcttttttatattttggatatgatcccattaatacttacatgtattacaatgttttctcccactc

SEQ ID NO: 9158 - DNA, 413 bp, Homo sapiens
  misc_feature 33: y=c or t
  misc_feature 37: m=a or c
  misc_feature 75: s=g or c
  misc_feature 77: n=a, g, c or t
aatgctccgcgggggcgcgggcggcgcatgcgyaggmgcgcgaggtctccgttaagaaggtgccgcggcggcgcsgnagatgtgtaattaagtgaaccatatatgtttcatcatcatggagatcttggagaattatctgagcaccaggttcatatgtattcgatctcagaggcatctattggacaacaaaacactctttcagttgtgaactttatttatttattattattattttttgagacagagttttgctcttgttgcccaggttagagtgcagtggcacgatctcggctcactgcaatctccgcctcccaggttcaagcgattctcttgcctctgcctcccgagtagctgggattacaggcatctgctaccacgcctggccaattttttgtatttttcagttgaaacga

SEQ ID NO: 9159 - DNA, 339 bp, Homo sapiens
aacaaaccctctccaggggctcgcagtgtgcagttgagtcgcgagtacggctgagctgcgtaccggcctccctggctctcacactccctctctgctcccgctctcctaatctcctctggcatgcggtcagccccctgcccagggaccacaggagagttcttgtaaggactgttagtccctgcttacctgaaagccaagcgctctagcagagctttaaagttggagccgccacctctggggagcagactggtgctttatatatacacacacacagcagaaggtacagggcctcaataagaaaatacactctgtgttcaggtgaacccccatcaccaccca

SEQ ID NO: 9160 - DNA, 398 bp, Homo sapiens
  misc_feature 349: k=g or t
tattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctgtttggggatgtgggctgttttccaaggcgactactgagctagagggtgaggaatggtctaaggcaagtkaacacaaatctcactgttcttacagaaatttttcttgaataaatgctcc

SEQ ID NO: 9161 - DNA, 437 bp, Homo sapiens
  misc_feature 172: m=a or c
  misc_feature 173: k=g or t
ttttattccgatagtttgtgatatccttgacttcacagcagaaagctgtgaatctcccaaaccccttcactcaggtcccatggggactgccctctaaagtctcttcagtcttctttctttgaatgttcatggctaccttgtcgtttagactcttatccctgactgtatgagmkccctcaggtcttcctgcctgtggccatgcctaatttatacccttcctaaaatgtgatgtgatcatgtcactgccttgcttagaagccctgcactggcgtccaacacgtgtagaatcaagtgcttgctgtttaacatggtctacccagtcctccagattctggcttccagttatttctcagcctcaaaaaagcacctaactctccaaacatatcaaatagcttgtgccctcctgcctcccgttcacacctccattccttcccctc

SEQ ID NO: 9162 - DNA, 134 bp, Homo sapiens
  misc_feature 20: m=a or c
  misc_feature 21: w=a or t
agctccgctctgcctccggmwctgcgctcacctgctgcctagtgttccctctcctgctccaggacctccgggtagacctcagaccccgggcccattcccagactcagcctcagcccggacttccccagacccgt

SEQ ID NO: 9163 - DNA, 355 bp, Homo sapiens
cggggaaatattcactgagaaagggagtaggaaagagaatcagttttgtcttgagtctttgttttttcttgtctttgagtcataatggtggaagattagatgataaatttggtttggtacatgctaagtttgaagtacctttgaggtatgcacagggaaatatcaggtaggcagttaaataaaaggtctagtgcagtggctctaaaatcagggataatttttttcctccaggggacatttgccaacgtctggagatattcttggttgtcacaatgtagtgagaggtgctattggtatctggaaagtagaggccaaggatgttgccaaacatgctacaatgtgcaggacaaccaca

SEQ ID NO: 9164 - DNA, 196 bp, Homo sapiens
  misc_feature 7: w=a or t
aaggacwttttcatttctgtatatttctcctgtgtttgctgctttttgcttgccagtttttctttgtctctatcattttatcactgaaaccatctgtgtagaaaatagtatgcttggttttatcattttaaattgttttctatttttgttattttgtcctcccaacttgttttcaccttaagtattcaggctcaaa

SEQ ID NO: 9165 - DNA, 158 bp, Homo sapiens
  misc_feature 7: v=a or c or g
cttcttvgtattcgacttgctattttagaaattatggatccggatgagcaattggaaacccttcatgaagcactgaaactactgccacctgctcactgcgaaaccctccggtacctcatggcacatctaaagagagtgaccctccacgaaaaggagaa

SEQ ID NO: 9166 - DNA, 162 bp, Homo sapiens
  misc_feature 7: v=a or c or g
ctccttvggatttatttggcttcttaaatctgagaatttctatatttcataagttctgcaaaattttcagccattatgtcctcacctgtttcttttgtcctattctccctgtgttgcccaggctggtctctaactcctgggctcaagtgatccacccacctc

SEQ ID NO: 9167 - DNA, 185 bp, Homo sapiens
  misc_feature 68: y=c or t
  misc_feature 157: w=a or t
tatttatatatgtgcgttcatggatgtttgtgtatgtggtcttgtgtgtgtgtgtgtgtgtgtgtgtytctcttgatccaccaccaccccattcaccagcctgacagaggacagtgtttccagaaggaatgtaattcatgcgcatttttttcatgtwaagttttataagaagaccaaacagctgc

SEQ ID NO: 9168 - DNA, 157 bp, Homo sapiens
cagagacatattcctcttatatatttggccagaaaacatttaaatgcttctttagaaagcgggcttacatctttctattaattatatgtcaaacgtccttagtagcgattggtaggagggtaggtatttggggagaaaacacatcaaacagggacca

SEQ ID NO: 9169 - DNA, 225 bp, Homo sapiens
  misc_feature 14: k=g or t
  misc_feature 25: d=a or g or t
  misc_feature 28: w=a or t
  misc_feature 37: w=a or t
  misc_feature 83: d=a or g or t
tttaagaggtgttkttttgtttgtdttwttgttttgwtttttgagacggagtcttgctctgtcacccaggctggagtgcagtdgtgtgatctcggctcactgcaacctccacctctgggtttaagcgattctcctgcctcagcctcctgagtagctgcgactacaggcatgtagtccccaggagactgagctgtgattacagatgtgagccaccatgccccgccc

SEQ ID NO: 9170 - DNA, 355 bp, Homo sapiens
  misc_feature 19: s=g or c
  misc_feature 324: k=g or t
caaaatataattgcctctsccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgtkcaggccctgggatgctgcatctccaggcccc

SEQ ID NO: 9171 - DNA, 385 bp, Homo sapiens
  misc_feature 12: h=a or c or t
  misc_feature 14: r=a or g
  misc_feature 19: d=a or g or t
  misc_feature 82: r=a or g
  misc_feature 365: n=a, g, c or t
cttttgatggahgraaatdcagttccagacttgggtggaacctgagttggggtctgccgtgccctggtgtctcggggggctrcccggcccctgaagtggaggagccgccttcacccaggcatctgtcccagcctgtgggctcccttccttgtgcagatgcctggcccagcccccgtgctgaagttgccagatgtataggtcctccttgatggcacgctccgggggctgtcactatgccacctgtgtcctcctgtggctttgtcctgcaggcattgtgaggtcatgcagcattttaactgctgtgaaatttgctccaccgagtgaacacaccagaatgcatccacagacccacagtggacactgangctgtttcctgtcggctgcc

SEQ ID NO: 9172 - DNA, 271 bp, Homo sapiens
taaacttttcaaaagcatttttgtcccatgcaacagtaggtatgaaatagttaataaaaccttgagttactgtaatcagggaggatttctaatagtattttgtccaaacgtgtgcagtggcgatgcattttcagggcaaatcaattctggaagcatcctcacccaaaaaaagccacatttaacattcatttgccataatgaggcaggatatagggcactcagatttcaggaggggagagagtgagcaaaggtgacgtctcagcagaggtat

SEQ ID NO: 9173 - DNA, 160 bp, Homo sapiens
actaacaagggtttcctgtattcccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgc

SEQ ID NO: 9174 - DNA, 333 bp, Homo sapiens
aagaatggctccagagctgtggtgggagagacatgttccccagccccgcctgcaaaaccaggcccccagagccacaacagactgctttgtgtaaggcaccctgccagtctcctgctcctgacctccactcgcacatctcctctgcaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaa

SEQ ID NO: 9175 - DNA, 419 bp, Homo sapiens
  misc_feature 384: h=a or c or t
gttgtgagctagcatcagctctgcctggcatggaaaagggagagttggcattgtcagcctgtaggtgcttgtggggagaggtagaggatgttggttactggcaggcaaacctgttgccactaaaacttggcacgtctgggcggcttcagcagtccagagagagaattagcagggaggaagagctccacagaagtgcccgtctggctccttggtactgtccacggaaagagatttcttccttggtagagaacttggtaccttgcagaggcaaatatattcatagtagggtaagtctataagtctaaccataatcctaggatgactctgaccccatcatctaggagaggtctcctagggttctttttgtcctatgtgtggggaathcacacataaacacacacacacacacacacacacac

SEQ ID NO: 9176 - DNA, 183 bp, Homo sapiens
  misc_feature 7: s=g or c
acatacsaggtgacacccctcgagtcacttcccttcaactccagctggagcgcctgcttggctttgggttcgttctgcagccttcgccccgctcctagcctcagggccggactccagcgcagagcccagcccagcgcagctgccagcagccacccagccgcccagccgcccagccccgcacct

SEQ ID NO: 9177 - DNA, 214 bp, Homo sapiens
  misc_feature 32: h=a or c or t
  misc_feature 33: d=a or g or t
ttattattattcattctgtcttctgtcatcthdattttttatcttaacttttttcttagtcttgttttatatagcatggcacatattttccttttggtttttcatcttgaaacaattacctatatatttgccaattttactatctgtttttcttttaggcctcctgttattactagttttacaaactttattcttcagatacatcaccccgtcg

SEQ ID NO: 9178 - DNA, 137 bp, Homo sapiens
  misc_feature 12: s=g or c
acatcacatttstctgccacagcagcaacaacagaaaagcggagggagggagggaggcgggaggaggggagcagagctccgcaagtcttgggctctgcgtggaggttgcgtttggctggcgtccccgaccccgcgct

SEQ ID NO: 9179 - DNA, 137 bp, Homo sapiens
gttgttgtttgtttgtttgtttgtttttggttcatgaacaacagtgtctagaaacccattttgaaagtggaaaattattaagtcacctatcacctttaaacgccttttttttaaaatttataaaatattgtaaagca

SEQ ID NO: 9180 - DNA, 256 bp, Homo sapiens
gatagaagttggttgggtgtggtggcatgcgcccgtggtcccggatactcggggggctgaggtgggaggacagtttgagcccggaaactctaggctgcactagagtttgtgtgattgcaccactgcactgcagtctgggcgacagagccagaccctgtctcaaaaaaacaaaacaaaacaaaacaaaaaaggattgtgtatccattagttgaatcgctgcaaaggtaaacattcattcattcattaagcaagcgat

SEQ ID NO: 9181 - DNA, 451 bp, Homo sapiens
  misc_feature 243: s=g or c
  misc_feature 277: k=g or t
  misc_feature 278: b=c or g or t
  misc_feature 279: y=c or t
  misc_feature 280: n=a, g, c or t
  misc_feature 289: k=g or t
  misc_feature 293: w=a or t
  misc_feature 294: d=a or g or t
  misc_feature 295: b=c or g or t
  misc_feature 368: w=a or t
tggaatgaaataaaaaagaagtctcacaacctccggtaagaaacaggtgccttagggaattggcttagatggtgttgggctccttttgctgctgcaccctgtccttctcctctcagcctgtgcatccccctttccttagcccacccacttctccctttcctacactggcactggggaaacagccttgctttagaagtcaggagacttggatctgagcctcagttttaagtagttgtgtcaccstgaatactttgtttgagttctcgaaatgttagckbynatttgtttkttawdbggacaaaaaatgagtggaggaataatacctgttctaactacctcacagtgtggtcatagggattcaaatcagwtgtggaaatgctttctaaacttaaaaatgccgaggtataaatgaaggggatgatgctccttctcctcttcctctcatagctgt

SEQ ID NO: 9182 - DNA, 243 bp, Homo sapiens
ttcattcataaatattactattcattccaatattgacaggcatatctttaaattattaatgtgcatatttggttttaaaagttcaaagttgaagatattatttcagttgcttctggcttctgttgttgctcttggaaagtgttctaagttttaatccttcatggataatttgtcttttctcttgggcgtttataaagatctctttgtcctttgttttctgcagtcacaacatgtctaggttgt

SEQ ID NO: 9183 - DNA, 246 bp, Homo sapiens
attcattcctttgggagagaaagcacgaccccttagtggttaaagtcacagtcactgcagcagacatcatggctgtggatgtggcagaataccatctgagcgtcatcaagagcccccctggctgggaggtgggtgtctatgctgcaggggccctggccctgctgggaatcgcagctgtgagcctgtggaagctctggacgtcggggagcttccccagcccctctccgttccccaattacgactaat

SEQ ID NO: 9184 - DNA, 233 bp, Homo sapiens
  misc_feature 128: k=g or t
attaaggaagtcctttagtaaactgtatgaaattggatgacatgttagaaaataactttcatctaattatgggttgtataggtgtggattctgtatatcagaatttattttattttactttttatttktactttttacagagatgtggcccagcctggagtgcagtggtgtgatcctagctcactgccaccttgacttcctgggctcaagtgattcttctgcctcagccctca

SEQ ID NO: 9185 - DNA, 432 bp, Homo sapiens
  misc_feature 266: s=g or c
  misc_feature 418: w=a or t
cccttttggacaccctgagagtgcagggctcctgttccccatcggtatgcaagagctgtgctcactcagccccctccctttatgcacggctttgctctacaagttttggtcagtggccccagtccctcctgggagctacagggagcggcagtggcttcagcttctggtctaagctcccccttgtcactctttcaaagccttcaccctttgaataaaattaagacggaaaaggtttgtgtaccacgaggcagagtttcttggcagtsagggtgataaaaacctaactgggctccccggagagacagcagggtctcccccagtggagagcttcaaggggaaaaaaaagagagcacgtgtctctgaaggctttggtgtctgccagctagaaggccggagactgggcgacgtgatgccactwccccttccagcccc

SEQ ID NO: 9186 - DNA, 181 bp, Homo sapiens
attctgttcagatgatctgtctaatgctgaacatggagtgctgtggttttctactgttattgtgtcacagtcagtctctctctttaggtctgttaatatttgtcttttatatttgggtgctctggtgttgactgcatatatctttataactgtaatatcctgttattgtattgaccccccg

SEQ ID NO: 9187 - DNA, 152 bp, Homo sapiens
agagctgccgctacatttaggagaaacagcggtgtctgcggctcccacccttcggggggcccgtggggggggcggtgtcaggggcatggacgccaccccccaggggtctctgctgccggctactctcctctccacgtgctcccctccaggac

SEQ ID NO: 9188 - DNA, 151 bp, Homo sapiens
agtcttttgctcctgtggttaagattattctgctaggctgctcacggtggctgatgtctgtaatcctagcactttgggaggccgaggcgggcggatcgcctgagatcgggagttcgggaccggccgcaccaacatggagaagccccgtcca

SEQ ID NO: 9189 - DNA, 328 bp, Homo sapiens
ctttctttctttcgttcgttctttatttcgttctttcgttctttttttgagacggagtttcactcttgttgcccaggctggagtgcaatggtatgatctcggctcactgcaacctctgcctcccgggttcaagcgattctcccacctcagcctcctgagtagctgggattgctaacacctgccactacttccagctaattttttgtatttttagtagagatggggtttcaccatgttggccaggctagtcttgaactcttgacctcaggtgatccgtctgtcttggcctcccaaagtgctgggattacaggcatgattcaccgcccca

SEQ ID NO: 9190 - DNA, 434 bp, Homo sapiens
  misc_feature 275: s=g or c
  misc_feature 313: r=a or g
actcttaaggttccgatcacagactgcggagtgggtcaggggctgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggastcgcttagtctgcacctcaaccgtgcggaaagtgactrccctgtttactgaggaaaaactggggctcagaaagataccatggagtagtttgaaacaggaacaaaatcttctgaaagctcggagcagaagcctttttggtcaacatggaggaaaaaagac

SEQ ID NO: 9191 - DNA, 437 bp, Homo sapiens
  misc_feature 150: s=g or c
  misc_feature 200: s=g or c
  misc_feature 201: k=g or t
  misc_feature 250: k=g or t
  misc_feature 251: r=a or g
  misc_feature 257: y=c or t
  misc_feature 258: y=c or t
  misc_feature 261: k=g or t
  misc_feature 262: k=g or t
  misc_feature 270: s=g or c
  misc_feature 271: r=a or g
  misc_feature 293: r=a or g
  misc_feature 294: s=g or c
  misc_feature 295: r=a or g
  misc_feature 370: y=c or t
  misc_feature 423: m=a or c
acaactaacccggataagggactgatattcctccttcagtcgctgcacccacaactcacgatctcggggtccggcgttagtcttcagcaccgggatctcagacacaacacgtcgcgtggcttcatccgccatcttggaccagggcgcaasagaaacgcggaagtggtgttgcctgtagcttacctcaaggcgccgtcatskttactatgggaagatgagacgttgggttgctgtaagacctcttttgaakragatcyytgkkttcttgtsrcctagttacccgcttgtgagtrsrtcgacgaagaacagaatgtaaacagattactccgtcctatatatgacacctatcattaaaatcaccgcataaggyacaaagggtgacttccgttcatgctcagagaagtaaatcgcagaaacccggamaccttcccaaactt

SEQ ID NO: 9192 - DNA, 215 bp, Homo sapiens
aagaagaaaatgagtgttgtatctcagctgcgcccatcagctctattccccgaatgaccgtgagcttgaaggaaagccatttaacgcacacggtgccgatgggtgtcttctgcttggcgacatcgtgggctttatcctacttcctcaaggaggcataaaagatgatttttttccccacaacaatgagctttcttacagacatattaaacggaaat

SEQ ID NO: 9193 - DNA, 295 bp, Homo sapiens
ttttttttttcgaggccgagtctcgctctgtcgcccaggatggagtgcagtggcgcaatgtcggcttactgcaacctctgcctcccaggttcaagcgattctcctgcctcagcctccagagtacctgggattgcaggtgctcgccaccacacctgactgattttttgtatttttggtagagacggggtttcaccatgttggccgggctggtctcaaactcttgacctcgggcgatctacccgcctcagcctcccagggtgctgggattacaggtgtgagccattgtgcctggcca

SEQ ID NO: 9194 - DNA, 182 bp, Homo sapiens
  misc_feature 43: s=g or c
  misc_feature 85: d=a or g or t
  misc_feature 86: n=a, g, c or t
agatagatgttatcttccagaggaagaggaggaggcggcgaasgttttcccagcctcagtctctctttcgttttccttttccctdnccccaaccctccgcccttctctaaatcagccggccttccttgacctcagtgacccgtctggccccgcccaccctcgtcgacgtgattcccgccgaa

SEQ ID NO: 9195 - DNA, 389 bp, Homo sapiens
gaactgtgttgtttaagcccctcagtctgtgatattttgttacggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataattt

SEQ ID NO: 9196 - DNA, 165 bp, Homo sapiens
ccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccc

SEQ ID NO: 9197 - DNA, 147 bp, Homo sapiens
  misc_feature 118: d=a or g or t
  misc_feature 119: n=a, g, c or t
  misc_feature 121: s=g or c
agtctctcccattcctcgcagcacgggttcctgtggcggcagcttttccttccatctccttctctccacccgctggcttccagtctccaccttcccgcctattcccccagcagcgtcdncscgccgctccctcttctcccctcccca

SEQ ID NO: 9198 - DNA, 343 bp, Homo sapiens
  misc_feature 3: y=c or t
  misc_feature 4: y=c or t
  misc_feature 5: m=a or c
  misc_feature 26: y=c or t
ccyymagacacagtggctttcaactygttcatttctatgttgttgtttttttgtttgtttgttttgagtcagagtctcactctgttgcccaggcttgagtgcagtggcatgatcttggctcactgcaacctcctccttttgggttcaagcgactctcctgcctcagcctcttgagtggctgggattacaggcatgtgtcaccacacccgactaatttttggtagttctattacagatggcagttttgccatgttggccaggctgattttgatagcctggcctgacgtgattcagttgccttggattcccaaagtgctgggattacaggcatgagcacagccca

SEQ ID NO: 9199 - DNA, 168 bp, Homo sapiens
tagactttgagtgtagcagagtggcacagcggaaaggtatagactttgagaggtccagtaatttatttacgtacacaggacagcaggacctggatgtgggcagtttgacaccagcctgtgctaccagccatgcacaaccttgcctccctgttaggaaggagagagagc

SEQ ID NO: 9200 - DNA, 398 bp, Homo sapiens
  misc_feature 228: k=g or t
  misc_feature 262: k=g or t
  misc_feature 263: k=g or t
  misc_feature 270: k=g or t
  misc_feature 276: k=g or t
  misc_feature 302: k=g or t
  misc_feature 303: w=a or t
  misc_feature 309: k=g or t
  misc_feature 312: d=a or g or t
  misc_feature 320: s=g or c
  misc_feature 324: k=g or t
  misc_feature 339: k=g or t
  misc_feature 372: k=g or t
catctctatacagttttcaccaattttcaatctccttgaataagcactgaaaaatttgagtctctttttatcactcattgttagaagtatccattttccctaacttcaaattcaacagctgagacacagatatagaatattttcttttattttgtggcttatttcagtgttcatgctagctaaacatgactttgataatctacttcccagtttacattaaaacctctkcttccttcctcctcttcctcttcttctttcttckkccttcckcttctkcctcttcctcctcctcctcttcttckwcttcckctdtctctgcsagtkttcccatcacataaktatgtagctgatggagcttcaccatcttgttckaaactgccccaataaagccactaaga

SEQ ID NO: 9201 - DNA, 155 bp, Homo sapiens
  misc_feature 71: v=a or c or g
agcgtcaagggtatcctttgccaaactcagcacgcttttcagacctcctctccctaggccctgtgcagcavgccccccacccatacccctgctgggcatgctctccccacagctgtgatcccacacaggaagccatctcctccctcccgcccaga

SEQ ID NO: 9202 - DNA, 161 bp, Homo sapiens
ccattttctgagacaagcagtgcagcttcctgccagctttcttcccctgaagatttgcgtggccggatctggtatctaacaatgtgtgactttctcatccaattcctgttcctctgtgtgctctcgcagggactctgccatctccagtaacaagacccctc

SEQ ID NO: 9203 - DNA, 213 bp, Homo sapiens
aggttttgtctttatagctggtttgcagcaacctgattatgttgtactttgctttgatgttctttatgtttatcttgcttggggccgtttgagcatttgcagtctgtgggtttatcgttttaatcaaatttggggaaaatttgtccttgtccattatttctttaaatactatttttcttttccttcccttctcttttgttcttaggccccaga

SEQ ID NO: 9204 - DNA, 139 bp, Homo sapiens
tcttttttgagatggagtttcgctcttgttgcccaggctggagtacagtggcgcaatctcggctcactgcaacctccgcctcctgggttcaagcgattctcctgttttagcctccgaagtagctgggattataggcgcc

SEQ ID NO: 9205 - DNA, 366 bp, Homo sapiens
  misc_feature 131: m=a or c
  misc_feature 132: m=a or c
aacaggagcataaacacaggatgcggagagatgtagatcctatatcctaaggtcttctaagcaaattgttttcttaggtgtaagtctggttgtgaatgtttttgcaccatcctgaatttaatgttcaaggmmatgtgttctgggcctagcatgattccagctcaatgtgtaagcattttggtgcctgtgcacctagtttcagggagcctcattcttccttcactcagggcagcatttgctctgagagaggcggcagattcacaagactggttttccaagaattgatataaagcgggaagaacagaaaacagcagtcataagagtggaagcaaaatgtcagtcagtgtgctgagaaccgcaagtcca

SEQ ID NO: 9206 - DNA, 283 bp, Homo sapiens
  misc_feature 28: s=g or c
  misc_feature 29: s=g or c
  misc_feature 118: r=a or g
acacatctctaccctatgtcccgaacassctggctttacgtcctcccaggctttgccttggccctctcccctgctgcctaaatctcaccagctcggcgctggccttctgctgcttgargcctcgcacgcgctctccctgaagtttcaccagctcctccagcgccgcacgctctgccatcccggctgtccacttgagccgcctgctgtctcgacctgcggtggttgccccagcctcagcaaggatgacttccggctatcgagtcgctgggtcgcacgcctagag

SEQ ID NO: 9207 - DNA, 151 bp, Homo sapiens
  misc_feature 14: n=a, g, c or t
  misc_feature 20: w=a or t
  misc_feature 37: k=g or t
ctagagatgggggncatgtwaggaggtcactactgtktctcagtttaaaaaggttaagatccttgtcagaggacacaacgtttcagttagacaagaggaataagttcaagagatcagttatacaacatgataactatagttaataagcaat

SEQ ID NO: 9208 - DNA, 405 bp, Homo sapiens
  misc_feature 298: r=a or g
attgtaacaaaagtgctttatgcaaacttctcgcttcatcatacagaatattaaaaggacgtatactaatgggtggagatataatgtaattaattattactgctttatcaaggacactttaatactggcattttctttttttgccactgtgagtggtggtaaagaatacaaggacaatattggtaataacagtagttacatagtagtagtgatgccagtgtcttgatatatcctaagacatcagttaggttttacccatttttgcttttgcacttgagcgcagtgaaaaaagcaagtracattttaatgtcataatgaaaacatagtttgactttatgaactcttaagagtcttggggaccctcagggtcctgagaccatactttgtgaactagtctcttacaga

SEQ ID NO: 9209 - DNA, 276 bp, Homo sapiens
cagtaacttatctgggaaatctgggactttcaatccacagccatacttgtttgttttgttatatttaaattattcactttttctttgtacaggtttaatttggtttttcccaaagcatggtatacatatcaccgatagtatataaaatgatttttaggtatgttgtgagctgagataaacaaatttgggcatttgtaataggtataaaaatggtcatttaaactgttcctataagaatagagtccctctctgttctttttaggcattccagcaagt

SEQ ID NO: 9210 - DNA, 212 bp, Homo sapiens
aggaacattttttattttatttttatagagatagggtctctttctgtagcccaagctggagtactgtcttagtctgtttttatgctgctgataacgacatacccatgactgggcaatttacaaaagaaataggtttaattggacttacagttccatgtggctggggaagcctcataaccatggcagaaggcagggaggagcaagtcacgtct

SEQ ID NO: 9211 - DNA, 496 bp, Homo sapiens
  misc_feature 432: m=a or c
  misc_feature 436: h=a or c or t
  misc_feature 446: s=g or c
gctctgcggccggggaagtggaaggcaggtaggcgaccggccgttcctctaagtctccgcgacgcaggaaacaaaagcgatagaaggtccgttcctgtcctccggtgctttgatgagttcaggctgaagccgatgggggaggaggagaagctgcaagttaacaggcaatctgagttatctttctttattaacgctgtagaggagtacttcagatttctcgaggctgtattgagtctccttccacggtctccctctgatgccgagccaaggctggacggtgctgctgccatctcggctcactgcagcctccctgcctgattctcctgcctcagcctgctacgcctcactggttttcgttttttttttggtggagacggggttttgctgtgttggccgggctggtctccagctcgtagccacgagtgatccgcmagchtcggcctccsggggtgccgggattgcggacggagttcattcactcagtgctcagtggtgc

SEQ ID NO: 9212 - DNA, 146 bp, Homo sapiens
tttattttttgggacagagtctcgctctgtcacccaggctggagtgcagtggtgcggtcttggctcactgcagcctccgcctcccgggttggagcgattctcctgcctcagccctcccgggtagctgggagtgacagacgcccacc

SEQ ID NO: 9213 - DNA, 432 bp, Homo sapiens
ctcctgcaactgctgtttctcctgtccctcctatgcagggcttgcagcagcagcagtgtggccatctccatcccccaaagcacacttgctctctcaatatgtcctagttttcttcagccttttctggttcagttcccttgtcctgatctcatcctctctggtctcccaataactcacccttgggatgtgtttagagcgtgggaggtgcctttgagaactgcttgactccatgatctcctagaacaaaaccgccctgactttacagggggaacactcatgctgagctgagaaagcagagaagtggcgtgggagccagctgggggtgaagagcatttgggccagtcccgtggcccccttcagattcctcaagcaggattgttcggttctaaaaagctgttgcacagcattcgcaatgagatctttagttggcag

SEQ ID NO: 9214 - DNA, 267 bp, Homo sapiens
  misc_feature 3: k=g or t
  misc_feature 10: d=a or g or t
  misc_feature 11: k=g or t
  misc_feature 12: b=c or g or t
  misc_feature 32: k=g or t
  misc_feature 101: h=a or c or t
ttktattagdkbcaaaatttgattagggccakatggaattcatactagagatgcttctagagagaaatactgattttttaaaatgttttgtaacagcagthagattaaatatttctgcttcacttagagattctcagatggttgtgtcatttttatcttggcatcaagtgaattgtgcacatttacactgtgacttttgtcttgagtaatcccaaatgcctgcatattgttgtatgtttgtaatcctttactctccctccaccccga

SEQ ID NO: 9215 - DNA, 168 bp, Homo sapiens
  misc_feature 7: k=g or t
caatgtkttgtttgtttgtttgagtcagtcttgctctgtcgcccaggctggagtgccgtggcacgatctcggctcactgcaacctctgactcctggattcaagggattctcaagcctcagcttcctgagtagctgggactacaggcacccgccaccaccacacctgcg

SEQ ID NO: 9216 - DNA, 316 bp, Homo sapiens
  misc_feature 18: s=g or c
  misc_feature 106: s=g or c
tcattctcctgcctcacsctcccgagtagctgggactacacatgcctgccaccacgcccggctacttttttgtatttttagtagaggcggggtttcactgcgttasccaggatggtctcaatctcctgacctcgtgatctgcccgcctcggcctcccaaagtgctgggattgcaggagtgagccactgcgcccggcctgagtttttaatggaatagttcagatatacacaaatttttgggtaaatcaaaacatgtatcttcacctttcagcttaagaactaaaatgacaaatacagttaaaatctttttttttttt

SEQ ID NO: 9217 - DNA, 463 bp, Homo sapiens
  misc_feature 341: v=a or c or g
  misc_feature 342: n=a, g, c or t
  misc_feature 343: k=g or t
  misc_feature 344: y=c or t
  misc_feature 443: y=c or t
ctgtgaggtggcaactgcttctggagaggggatgccgagccgaaccagagctgggttactacaagtgtgaaccggcagcctgtctgttgccacagaagaacttggtcaccacactgagaagccgtgttttctcacctccctgttactgttgtagctgtatctggcttctctagcattttaaaggaatttctgattgaggcgctaacagctaattccacaggagttgtaaggcagcctgtgcataaactgagacagaagtttctcctcagagactctctttttattattattattattattattggcaaagacttctggctctcctcagaggaataccttgvnkycttaagatgagtggctgtagaaagcggtgtaaacgtgaaatactgaaatttgcccagtaccttctcagactattaacaggttctcttcatacagacagygtggaagatgaactggagac

SEQ ID NO: 9218 - DNA, 171 bp, Homo sapiens
  misc_feature 21: y=c or t
  misc_feature 32: w=a or t
cagtaagatatgttgtttgtyttttttagagwcagggtctcactctgtcatctgggctggagtgcagtggtgcaattatagctcactgcagcctcgagctcctgggctcaatgagtcctcccacctcggcgctcctaaagcactgggattacatacatgagataccacatg

SEQ ID NO: 9219 - DNA, 419 bp, Homo sapiens
  misc_feature 9: w=a or t
  misc_feature 10: n=a, g, c or t
  misc_feature 11: n=a, g, c or t
  misc_feature 12: v=a or c or g
  misc_feature 19: r=a or g
  misc_feature 31: s=g or c
  misc_feature 32: n=a, g, c or t
  misc_feature 33: d=a or g or t
agatcaggwnnvtggccgrgtgtgtcgccgsndacatcaggcacttctccttcctgcccttgtatgaagaaggatgtgtttgcttccccttgtgccatgattgtaaatttcctgaggcctcctcagccctgcagaactggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacaactg

SEQ ID NO: 9220 - DNA, 263 bp, Homo sapiens
actcagtgcacatatgcacacaatgatagaagagttttacaaaatagtactgtgcttagccatttatgtaagactgttttgttattatttacagaaatgctagccacaatcctctcaattggtttcactattttatggattgtgatccagagttttagcctgagggctttcccacattctttcaagacctttgtgtcatggcagcagccttgaagttaggggaaacaggtagatgaatccatatatggagaattggccatata

SEQ ID NO: 9221 - DNA, 223 bp, Homo sapiens
ggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatctggtccacggagaagtgctaaaccccaaagggtaaatgagattcccacagaaggagcc

SEQ ID NO: 9222 - DNA, 416 bp, Homo sapiens
  misc_feature 12: s=g or c
agggcttcccastaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagta

SEQ ID NO: 9223 - DNA, 239 bp, Homo sapiens
  misc_feature 10: k=g or t
  misc_feature 121: w=a or t
tgattattckcaaagaaaagtggagatattagaatttccgagtaaattgcattgttttaaaaagtactttaatgcattgttcacattgttgccagctattgaccaaaaaagagaagaagawaaaagaaataaaaaaagcagtatctgctccaaacgtcaagttttgcagtttgaaagacttgtacattataattgtttttttcttttttggaaagcagtagtaattaataccaaaggct

SEQ ID NO: 9224 - DNA, 420 bp, Homo sapiens
  misc_feature 21: r=a or g
  misc_feature 35: m=a or c
  misc_feature 278: k=g or t
  misc_feature 324: b=c or g or t
gttactttctggtacccagtrtattggagtctgtmagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagtkcatcctcatccacactaagccatcctgttagcttttaaaggaagtbaatttaattaacattaatatactctatgggctccctctcccacctgtctgcatagaaaggcagaattagacatagcatgctttggaaaagcaaata

SEQ ID NO: 9225 - DNA, 253 bp, Homo sapiens
  misc_feature 134: d=a or g or t
  misc_feature 178: k=g or t
  misc_feature 189: d=a or g or t
  misc_feature 201: k=g or t
cttctttgtaactcctgcatatacctttgcatttatgtagcttctggagggcacatggaggtagctcaccatggttttaatttgcatttctctgataatgaatgagacttagttcttcctgtgggttgcctgtdaagactttgccatttatctgttgcaatctttatttcttgctgtkttgtaggagtdcttttttatatkttggatatgatcccattaatacttacatgtattacaatgttttctcccactc

SEQ ID NO: 9226 - DNA, 218 bp, Homo sapiens
  misc_feature 14: k=g or t
  misc_feature 102: s=g or c
atggcccggaggakcgccttccctgccgccgcgctctggctctggagcatcctcctgtgcctgctggcactgcgggcggaggccgggccgccgcaggaggasagcctgtacctatggatcgatgctcaccaggcaagagtactcataggatttgaagaagatatcctgattgtttcagaggggaaaatggcaccttttacacatgatttcagataagc

SEQ ID NO: 9227 - DNA, 169 bp, Homo sapiens
  misc_feature 43: w=a or t
attaaattttgatgtaatccaaaatatttcggttgtttgtgtwctttgttatcctgtctatttttgttgttgttgttttatagatatgggggtctcactacgttgcccaggctggtctttgaatctcctgaactcaagtgatcctcccacctcagcctcccatccaaat

SEQ ID NO: 9228 - DNA, 249 bp, Homo sapiens
cattctttaagaatgttgaatattggtccccactgtcttctggcttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgagaagtatctttgtggtgttctctgtatttcctgaatctgaatgttggccttc

SEQ ID NO: 9229 - DNA, 131 bp, Homo sapiens
  misc_feature 15: n=a, g, c or t
  misc_feature 25: m=a or c
cattttgtgcgagangccgcagcgmcgcctcttctctcgcgccctcgcctcttcctccgcctcctccttcgcctcttcctgcctcctcccggcttccgccgccgccactccagcctaatcccaaccccaga

SEQ ID NO: 9230 - DNA, 299 bp, Homo sapiens
  misc_feature 234: m=a or c
  misc_feature 238: s=g or c
  misc_feature 287: m=a or c
tctctggctgagctgttcattgccagccaccctgagactccccacgcggcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattgggtgcgctcmggcsgggcaggttttgagctgcagagacccgtgcccggtagcagcgctttgcmaccgagtgcacc

SEQ ID NO: 9231 - DNA, 337 bp, Homo sapiens
aacaatgccaaccttaacacacaaatgtgataactaaaaacagctaaaatcattttttttcttcaattctttgtgtcctcagcatttatgcgattagggacagacagtcaacttactgttgtaaagttacttggaatggttcccctctctgtggcatgctccaaactagaatcaggatttactgattatacctccttcattttcctgaaatttttagagattgctttttaattttaactttgttttataattatgtaaactatttacatggttccaaagtcaaatctacagaacaaaatgtattcagagtttatcttctgaccggttccctccacca

SEQ ID NO: 9232 - DNA, 191 bp, Homo sapiens
  misc_feature 112: m=a or c
  misc_feature 123: m=a or c
tcctcaaggtttcttggtgcaaacacagccctgggaaatgggtcaggtaaagagcagtcaaggccttacattcttggcatacccagcaggaacttcagggcatgctcagggmccatggcagamtgcctctcccaacatagatctgcacggaacgtcaggtccatgaccaatgtctaccatcacaaggcaac

SEQ ID NO: 9233 - DNA, 257 bp, Homo sapiens
  misc_feature 234: v=a or c or g
  misc_feature 235: n=a, g, c or t
  misc_feature 236: y=c or t
  misc_feature 238: m=a or c
aacacacgtgtgcgcttctctgctccggagctgctgctgctcctgctctcagcgccgcagtggaaggcaggaccgaaccgctccttctttaaatatataaatttcagcccaggtcagcctcggcggcccccctcaccgcgctcccggcgcccctcccgtcagttcgccagctgccagccccgggaccttttcatctcttcccttttggccggaggagccgagttcagatccgcvnycmcgcacccgagactaacaca

SEQ ID NO: 9234 - DNA, 446 bp, Homo sapiens
  misc_feature 319: r=a or g
  misc_feature 325: s=g or c
  misc_feature 342: s=g or c
aagcaataaacgctgagcgcccggctgcgctggagccgcccggagctaggggcttcccggggcgcaggagagacgtttcagagcccttgcctccttcaccatgccggttgccgccaccaactctgaaactgccatgcagcaagtcctggacaacttgggatccctccccagtgccacgggggctgcagagctggacctgatcttccttcgaggcattatggaaagtcccatagtaagatccctggccaaggcccatgagaggctggaggagacgaagctggaggccgtgagagacaacaacctggagctggtgcaggaraatccstgcgggacctggcgcastggctgagcagagcagcacagccgccgagctgggccacatcctccaggagccccacttccagtccctcctggagacgcacgactctgtggcctcaaagacctat

SEQ ID NO: 9235 - DNA, 254 bp, Homo sapiens
  misc_feature 5: k=g or t
  misc_feature 6: s=g or c
  misc_feature 8: s=g or c
  misc_feature 184: w=a or t
tctgkscscctagcgcccgccctcctcccttccgccggccccgcgcgatccatagggtttgggtcgctgggcgccaggtacccgcacccggcaagcagccacggagcccctcgcgcacttgtcctcgatacccttgagttggggctacgcaggccactcctaggccactggctgggcgtccgawcgtgggtcaccccgcgcacagtctagaggttcagaaagatgctgtggcccactttaaaacaaagcccccg

SEQ ID NO: 9236 - DNA, 237 bp, Homo sapiens
cttctggtagcttttgaatttgtttgctcttgcttctctagttcttttaattgtgatgttagggtgtcgagtttaaatctttcctgctttctcttgtgggcatttagtgctataaatttccctctaaacactgctttcactgtgtcccagagattctggtacattgtgtctttgttctcattggtttcaaagaatgtatttatttctgccttaattttgttatttacccaatagccc

SEQ ID NO: 9237 - DNA, 345 bp, Homo sapiens
  misc_feature 1: n=a, g, c or t
  misc_feature 2: n=a, g, c or t
  misc_feature 4: v=a or c or g
  misc_feature 5: v=a or c or g
  misc_feature 253: k=g or t
nncvvgcacccccaccaccctttcctgcctctggtgaccactattctactttctacttctgcgagattagtttgttgttgttgttgttgttgttttgagacggagttttgctcttgtcgcccaggctggagtgcagtggcgcgatcttggctcactgcaacctctgcctcccaggttcaagtgattctcctgccccagcctcccgagttgctgagattacaggtgcctgccaccacacctggctaatttttgkatttttaatagagacggggtttcaccatgttggccaggctggtctcgaactcctgaacttaggtgatccccgccggcgcgcccccccccccc

SEQ ID NO: 9238 - DNA, 490 bp, Homo sapiens
  misc_feature 311: d=a or g or t
  misc_feature 475: n=a, g, c or t
gagaagaagggagtgagactgctcagagaggcaggattcctgctgactccagggggacacctggcacctcagcttcctttcccacttctccaggctgcatggaggggtgccgggcaggggcctcctggaagggaacctcctgcagcctcaagcaccaggtcatgacatgacatctatccctttcccaggtgaccgactcctgcaggtggatggagtgattctgtgcggcctcacccacaagcaggctgtgcagtgcctgaagggtcctgggcaggttgcaagactggtcttagagagaagagtccccaggdgtacacagcagtgtccttctgctaatgacagcatgggagatgaacgcacggctgtttccttggtaacagccttgcctggcaggccttcgagctgtgtctcggtgacagatggtcctaagtttgaagtcaactaaaaaagaatgccaatggtttggatttaaaanttcgtgcagatggag

SEQ ID NO: 9239 - DNA, 388 bp, Homo sapiens
tctttttaaaatatacttctctttttagaggaggttaaatggtgtcataattcatacttgtgaaataatttgaaagtcaaattcccaacagcatccgagaccgaagtggttgtttggagttatggtcagcttcttcataaaggaagacactgggttggcgttgacagacatactgacggacacatcgtgtttcatttctccgtctcaatttaaatgtagaccatggcttcttcacctcagcagtattgacatttgggctggatcattgtctgttggtgggcgttgtcctctgtgtgcattgtagaatgtttggcagcatccctggcctctgcccactagatgccagtagcactcaacccccattccctgccaagttctaataagtaga

SEQ ID NO: 9240 - DNA, 227 bp, Homo sapiens
  misc_feature 7: v=a or c or g
tcttctvcctttttttcggtcgcaagtaggaagctttttgcactccaccacctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtga

SEQ ID NO: 9241 - DNA, 280 bp, Homo sapiens
  misc_feature 12: y=c or t
gaaaccctagtygatttagccttgggaatttaggtctggccttgcttttgcacgagttggtcagttgttattcctgtaaacgggctttttcctttcctttcctttgttcacattctagtgcttgctctatagactgtggctgttgtaagcctccttgccccttgggacctcataacccacatgtgttctgtgtaggccttatcttatctcccacaacagaagtggggtatccagcaagcagcaagagcctctcatatacaacggttgaatttcactccac

SEQ ID NO: 9242 - DNA, 212 bp, Homo sapiens
attctggccttggcggagttggggatggtgtcacctagcagccgctgccgctttggcttgctcgggaccatttggctggacccagagtccgcgtggaaccgcgatagggatctgtcagggcccgcggccgggtccagcttggtggttgcggtagtgagaggcctccgctggttgccaggcttggtctagaggtggagcacagtgaaagaatt

SEQ ID NO: 9243 - DNA, 324 bp, Homo sapiens
  misc_feature 17: k=g or t
  misc_feature 193: s=g or c
cattctttttctttgtkctctgtttctcaaatcttagtgctcttcatttaaactttttattttttattttttatttatttatttatttttttgggggggacggtctcgctctgttgcccagactggagtgcagtggcacgatcttggctgactgcaacctccaccttctgggttcaagtgattctcgtgcctsagcctctcgagtagctgggattgcaggcatgcaccaccatgcccggctaatttttgtattgttagtagagacggggttttgccatgttgcccaggctggtcttgaactcccgacctcaagtaatccaccca

SEQ ID NO: 9244 - DNA, 280 bp, Homo sapiens
gaatcctactgcctcagcctcctgagaggctggcactacaggcacacaccaccatgcccagctaattaaaaacatttttttttgtagagatggtgtcttgccatcttgcccaggctagtcttgaattcctgggctcaagtggtcttcctgctttggcctcccagagttctgggattacaggtgtgagtcaccatgccaggccagtaactggtcgaccatcttgaatatttgtttttgccacattgcatcatgtcatgcttttctaaaagcagagagagca

SEQ ID NO: 9245 - DNA, 314 bp, Homo sapiens
  misc_feature 278: m=a or c
aatctcggctcactgcaacctccgcctcctgggttcaagctgttctccggcctcagtctcccgaatatctgggattacaggtgcctgcaatcacatctggctaatttttttatttttagtagagatgggatcttgccactttacctatgctggtctcgaactcctgagctcaagtggtctacccgtctcggcctcccaaagtgctaggattacaggcctgagccaccccacccggcctgttcattattcttataatctgtttttttttttggattggmaataggctgagtgtggaaaaccagtagattcccaga

SEQ ID NO: 9246 - DNA, 199 bp, Homo sapiens
  misc_feature 107: k=g or t
tattcacatatgggcttaataaagaagcattctatgtgttggcattggattcagaccctaaatagtggcaactttttggcacttggttttgtattagcaatgatgtktaacttcttgtcatccatttatacttctccctttattaatttaggacaatagttataagcccatcttccttgctagaaataaaactgagcca

SEQ ID NO: 9247 - DNA, 388 bp, Homo sapiens
  misc_feature 40: r=a or g
  misc_feature 178: m=a or c
ctcatgctctacctctggttcgccatcggcctggcctgcrccggcttctgctgccaccagctgctgttgatcctccgcgggcagacccgccaccaggtgcggaagggggtggcagtgagggcccggccctggcgcaagaacttacaagaggtcttcggaaagaggtggctgctgggcmtgctggtccccatgttcaatgtcggaagtgagagctccaagcagcaggataagtagtagacactcccgtcatttatctctctgtctctgtcttgactcctcctgagcataaaaccatggcagccttgtctccacccatgactcactacaaccttgtgctggtaaggtcctagcatcttcccctcaccttccacccatgagaacagcgtga

SEQ ID NO: 9248 - DNA, 219 bp, Homo sapiens
  misc_feature 44: s=g or c
agacgatggttctgggtgctactctgctactctgctcctctgcsggactgttgctgcggggctgggaggataggcttctcatctccttccccaagcgcccaccgcctccccgtgcgtcttgcaggagacctacaaattgccgcaccggctcatcgagaaaaagagacgtgaccggattaacgagtgcatcgcccagctgaaggatctcctacccgaaac

SEQ ID NO: 9249 - DNA, 238 bp, Homo sapiens
  misc_feature 190: s=g or c
  misc_feature 191: s=g or c
  misc_feature 193: n=a, g, c or t
accgagcccgtggacatcccgttgtcccccttgcccacacgcgtcctctttcctcccccctggccagtctcgctgtctccgccttccgctccctggcggaggcggaggccagagagcgctccaaggaagactaaaaacccaggccgggaagcgcggggtgagaaagcgaggtgggtggcgagagcgtgasscnccctctgctgaccccggggagcgtggactacgagttggcgcccaa

SEQ ID NO: 9250 - DNA, 446 bp, Homo sapiens
  misc_feature 420: s=g or c
aagaactctgtgaaggatggaactttcagatatcaactatttagagtccagagggagccatggcactagaaatagttgataatgaaatgagattttatgaagtataccgctccacctatgagcgtctgtctctgtgggcttgggatgttaacaggagccaaaaggagggaaagtgtgaagaataaagtagatctgagaaattctgagccaatcaggcttcttaattcaagagacaaaccaagacgttctgtcaactgtgctgtgctcttctttaagccaatgaaccccaattcctggcagtctacaagaagtctcttaatgctaatgaagaatttaaaggtctttttaaggaaatgaagggctttccaaatagaatgatttactctgaagaaacaaacaatggtaatctctgaaactcasaacctaaagcccaatcttgaaaatat

SEQ ID NO: 9251 - DNA, 156 bp, Homo sapiens
aacaaagggacagaatggtcccagggttccttcttcttccttccagttaagagctcagagtggaagtgggctggggatggtgtcgggggcccaagctcccagctcccaaaggcccctgcttctatgccctttgagctcaggtagcccctgcccccg

SEQ ID NO: 9252 - DNA, 435 bp, Homo sapiens
  misc_feature 321: r=a or g
tatagtttcagttatgacatgagcacaaacatcatgatttctgttctttttaatgcactcagactggctaagaatatgttctgtgttggtgaatattccatatgtatttgaaaataatatatactctgctcttgttaggttctagaaatgtcaattacctcaaattctctgagagtgcagctcagttcttctatatccttactggtttctgcctacttgctctgtcagttactgagcaaaaagtagcaaagtctgcagctgtaatacatttgtttatttctctcatttttgttagtatttgcttcatgtactttgaagctrtgttgttagcatgcatacacataggatgattatggcttcttggaaaattgacccctttagcattatgtaatgttcctctttttctttggtaacagtccatgttgtggagccaca

SEQ ID NO: 9253 - DNA, 284 bp, Homo sapiens
cttgccagaattccctgcaagaggcttttagctttagtttggtcgtctcactatccctgatacaaactgttgctaattaccatctttatggcctgagggtttctgcttcattactcgatttaggacttattttaatcttgattatctgtctttcagcatcagaagattggctctgttcttttctccttgaaaacatttgtgtatttgtaaagtacactgaaggagtatatgctttgatatttagatggcacaaatgtaaattttggtgtgggaagaacggtcgc

SEQ ID NO: 9254 - DNA, 351 bp, Homo sapiens
  misc_feature 52: d=a or g or t
  misc_feature 111: w=a or t
  misc_feature 262: k=g or t
  misc_feature 291: b=c or g or t
  misc_feature 328: k=g or t
  misc_feature 338: d=a or g or t
caaaaatataaagtttttccttctctgcaaaatttgttccttcatatgagtdtctgcaacagcaagagaaagtctaaagtcttcctgatagcagccgaaaagatgtgaatwactttgtttacggagagtaaaggaaaatgctaagggggacattatgtgttaggctgcaactatggttgtacagtccctcaggcctccagtcacttgggaagatgaaagcaatttaccagaggaactctcccttgtcttataatttactgtkaaaaatagctgctaaaaggtaagaaagtbaagttcctgaatagagcaagtactttggatttatgtktatcattgtdataactgggaaaa

SEQ ID NO: 9255 - DNA, 158 bp, Homo sapiens
cattcgtttattattttagtaaggaatataggttaatgggcacttacacattatatgccagtctcagtctagtgctattgaggaatgtacactcagggatcattttcaagatggaaccattttataaatgtttatgtatgttataggatgtggtgcta

SEQ ID NO: 9256 - DNA, 271 bp, Homo sapiens
ccatgtctatgtttatgtctatatctctctatatatgtgtacacatatacctattgataattgtttcacagtcgtatctttcaggaataggtatgttgtagagctagtacttaggttgattttgctttggtctcaatatcttttgatacggggacagggaattatgcctggtcttagtattgtataacacaatgtgatataataagtatatatttgtactctgcccctggttttggagacagagcttctaaaacctttgtagatggagact

SEQ ID NO: 9257 - DNA, 394 bp, Homo sapiens
attctttctgtctctatgagtttgactactccaggcatcttatatcagtggaatcatacactatctgcccctttgtgtttattcctttttttgcaacataattcttttggttggagacttcacagtttttctttcctttgattgtttagtttttgctttgtacctagacctggccagtgatgcatgtgcaatgagtatgcaaagacaagttaattcagcagcttgttgcataccactagggagttattaaagctttcaaaatgtgattcctcatctgtatgcctgtggcttatctactccaagtcttgctgataaacctgcactgagagtaatagcaaagattagtctttctccatgtttcataaaacaaattgttctcattcttacagcctga

SEQ ID NO: 9258 - DNA, 342 bp, Homo sapiens
tttttcttagagacagggtttcaccatgttagccaggctggtcttgaactcctgagctcaagtgatcctgccttgcccttccaaagtgctgggattataggtgtgagccactgcgcctggccctttctttccatttttgcctacagaccttttgaactccttttgagaaattggagctgaactgtttcttctgagccagtgatttgatttgtagactgcggaagatgatgacttaggcgtggcagttggatgattcttgtaatattcttttgctgttgacattaatggtttctgattcaggcagagttgtcatctagaccatattaccacctccaggaccat

SEQ ID NO: 9259 - DNA, 190 bp, Homo sapiens
gaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacccag

SEQ ID NO: 9260 - DNA, 189 bp, Homo sapiens
ggggctctgaggagacacttttttttcctccctccttccctcctctcctcctgccttcccttcccctttcctcccctctctcctccttctcccctcggtcagccggagcactgctggggcgagcggttggtattgcaggcgcttactctccggggccacccggcgagtagctggccggggaaggaggcc

SEQ ID NO: 9261 - DNA, 192 bp, Homo sapiens
gttcagtctcctccgactgcagtgttttccctggggtcctggccagatctctcccctggggtcattttatttcctgcccttctggatctgtgaactgtgttcccagcccctggctgccccagatgtcatactgcctgacaccaatgactggctggcctccaaacccacccctcgctattttcccagaagaaa

SEQ ID NO: 9262 - DNA, 326 bp, Homo sapiens
aatcggctgtcagcctccctggctgttagtaccttctttcccggagtcctggtccacgagttggatttactgctgtcgcgggtgggcctcacgccattccctgtccctcggcccccttgaagtgagtccggtctcccggcgaaagtgagcgaggtttgcccggagcgcgcacgaggggaaaatgcctaaaaaaaaagactggtgcgaggaagaaggctgagaaccgccgagaacgtgaaaaacaactaagagcatcaagaagcactatagatttagctaaacatccatgtaatgcctcaatggaatgtgacaagtgtcaaaggcgt

SEQ ID NO: 9263 - DNA, 431 bp, Homo sapiens
tgttcaattcccacctatgagtgagaagatgcggtgtttggttttctgtccttgcgatagtttgttcagaatgccatcattctttgtatcactcttaagggatttagaatgttcttttgacacagccccactaccaacacatacactcccttagagccctccccctgatttctcagtctccatagccattggatgatggtgatggtggtggtgatgatgatgatgatgatgatgatgatggatgtgtctgtttatttgggaagcagtgagcatctagacactgaacccggctgccggttcttaattctagggctgtcacttcctgcctgtgtgaccctgggcaaggtactgcattgctgtgggctttggttttgttatctgtaaagttggggtcatgatagtacctactcataggactatcaggatgacta

SEQ ID NO: 9264 - DNA, 356 bp, Homo sapiens
  misc_feature 233: b=c or g or t
cggtggcacaatctcggctcactgcaacctccgcctcctggattcaagcgattctcctgcctcagcctcccgagtagctgagactacaggcactcgccaccacggccagctaagttttgtaatttttagtagagatgaggttttaccatgttggccaggctggcttctaactcctgacctcaggtgatccgcccacctcggcctccaagagtgctgggattacaggtgtgagbcaccgcgcccggcctcctccttcttttctaacttcttttcagtctttaaagttcagctgaagtgtcaccccctctgggagtcttccctgacacccccactccatagagctctcctagcacttc

SEQ ID NO: 9265 - DNA, 164 bp, Homo sapiens
atattttatacacatgtgcatattctgcctttttcatttactatatcataaacttctttctagatcattatttttctgctgcattttttcaggatttatcacctttatttttagttttagtttttgtgagtgtatagtaggtatgtatatttatggggcacgaa

SEQ ID NO: 9266 - DNA, 455 bp, Homo sapiens
  misc_feature 159: s=g or c
  misc_feature 206: s=g or c
gcggttcctacctggtagctgctgaggtcgtggttgtggcgctcctcgatgtcgctgagctgccgctccagggactccttggtgccgcgcaccgactctagctcgatgctcttggactgcagctggcgccggtactcggcgatctcttccttggcggasggatggcctccttgttctgctcggccgcctcggtgagcttggcgtasggcatttgaaccactcttcggcctggtgcatattctggtctgagtggctttcgagctgggagcggatttccttcagcgccgtcgagatgtctgtcttcaggtagtctttgcgctccaccgtgatgtgcgatgcctggatctgggccagaaggtcggccacctcctcctcgtggttgctccgcagaaggccacctcatcctgcagcgactgcaccttcttgtccagctccaccttgaccagcaacgcctt

SEQ ID NO: 9267 - DNA, 174 bp, Homo sapiens
  misc_feature 122: m=a or c
  misc_feature 125: r=a or g
  misc_feature 134: m=a or c
  misc_feature 145: r=a or g
tcggcttactgcaacctccaccacctgggttcaagcgattctcctgcctcagcctcccgagtggctaggattataggcatgtgccaccatgctccactaatttttctatttttagtagacamgarggtttcacmaggttggccargctgggtcttgaatttctggcctcccaaa

SEQ ID NO: 9268 - DNA, 222 bp, Homo sapiens
ttgtaactttgtaagaacacagttaaccattgataaaatccagatccttctatctagaagttattttaattttgatttaaaatttggacgggtgcggtggctcacacctgtaatcctagcactttgggaggccgaggtgggcggatcacctgaggttgggagttcaagaccggcctgaccaacatggagaaaccccatctctactaaaaaaaaaaaaaaaaa

SEQ ID NO: 9269 - DNA, 455 bp, Homo sapiens
  misc_feature 259: n=a, g, c or t
tagaatctccagtcattctcggacctgttctcagtctgcgctgctcactcagggctggtgtctcttgacacccagttacaacttccttttgcctattttgagtcaaaaagtcacattcctcacctaatttatgaatacacacaaattggaaagccatgcagtagcctctcaggagcagactgatttgtagctgtcgtggtttactgcatgacgtacaggctctctgtatgcactgtgtgtgcgtactgtacagggctgnacacagcaaactgtgtctactttatggaaaaaatttaaccatctgtgaacagttttttgccttaagtgctgcttttagaaccaaactgtcatataagatttatcagctcttttaacacctttgtagattcctgatgctgtgtacaaatcatgtcatctatgaatagacagtttcacttcttcctctcagtctagat

SEQ ID NO: 9270 - DNA, 321 bp, Homo sapiens
ctctgttttggtaccagtaccatgctgttttggttactgtagccttgtagtatagtttgaagtcaggtagcatgatgcctctagctttgttcttttggcttaggattgtcttagcaatgcggactcttttttggttccatatgaactttaaagtagttttttccaattctgtgaagaaagtcattggtagcttgatggcattgaatctataaattaccttgggcagtatggccattttcacaacaatgattcttcctatccgtaagcatggaatgttcctccatttgtttgtgtcctcttttatttcgttaagcagtggtc

SEQ ID NO: 9271 - DNA, 433 bp, Homo sapiens
  misc_feature 18: s=g or c
  misc_feature 20: n=a, g, c or t
  misc_feature 265: r=a or g
  misc_feature 266: n=a, g, c or t
  misc_feature 267: n=a, g, c or t
  misc_feature 288: k=g or t
gcaccacgcgccccgcgsgncccgcccggatcgtggcctctcgagagcaagacatgggaaagcggaaccaccaaaaggagtgatgatcaacgatctcatgataaatctggatgctagttctcatgcctcaggacatcctactgggaacgacacaccagctcctgggatcagactttcatctacttaggacccctctttgcccagactactaaagccagtcttcactagccacgaatggctacccaaaggaaacacttggtgaaarnnttaatccttacattacctgckatatctgtaaagggtatctgatcaagccaacaacagtgacggaatgcctccatacattctgtaagacttgtattgttcagcactttgaagatagcaatgattgcccaaggtgtggcaaccaagttcatgagacaaatccattaga

SEQ ID NO: 9272 - DNA, 344 bp, Homo sapiens
agctgtggtggttcacacctctaatcccagcactttgggaggctgaggcaggtggatcacttgaggtcaggagttcgagaccagcccggccaacatggcaaaatcccatctctactaaaagtacaaaattagccacatgtggtggtgggcgcctgtaatcccagctacttgggaggctgaggcaggagaattgcttgaacccaggaggtggagactgcagtgagctgagatcgcaccactgcactccagcctgggtgacagagcgagactctttctcaaattaaatgaaacatttaaatgcgaaaaatgtaagttaaaatcaaaaagcattcagaaaagggtga

SEQ ID NO: 9273 - DNA, 320 bp, Homo sapiens
  misc_feature 103: n=a, g, c or t
atcagcttgatttttgttgggtgcaaaaacttgtttccttcataatattttatttacaagctttgattacattcaacatgggcaagctccttaattcacaggntggtcttctttctttaaagttcaggactcttggccaggcatggtggctcactcctgtaatcgcagcacttagggaggctgaggcaggcaaatcacctgtggtcaggagttcgagatcagcctggccaacatgatgaaaccccatctttacaaaaagtacaaaaaaattagccagtcacgatgccgggtgactgtaatcctagctactcgggaggcat

SEQ ID NO: 9274 - DNA, 273 bp, Homo sapiens
  misc_feature 39: k=g or t
tactcttaagaggtgggcattatgattattttttatttktttattttttatgagatggagtctcgctcttgtcacccagactgtagtgcagtggcacgatctgggctcgatgcaacctctgcctcccaggttcaagcaattttcctgcctcggcagagacggggtttcaccatgttggccaggctggtctcgaacccctgacctcaagtgatcagcccacctcggcttcccaaagtgctgggattacaggtgtgatccactgcacccggtcca

SEQ ID NO: 9275 - DNA, 139 bp, Homo sapiens
tcttgtagaatttgatgagaccctcctagtcattctcaactggggcggtgctgtcaccgaatggtgtttgagagtgttggggctagggcacatttttggttgtcacagcaactggggtggcatttgctgcccagtgcca

SEQ ID NO: 9276 - DNA, 142 bp, Homo sapiens
ccaagaccaggagggtagggtcgaagatctcctatttcatgttgtgagcactcccaccaatggtcagctagtgctctcaagaaatggaaaagaggttcagctggacaaggctggccgttttagctggaaagatgtgaacaag

SEQ ID NO: 9277 - DNA, 440 bp, Homo sapiens
  misc_feature 433: s=g or c
ttggtaacagtatatgccaaaagtaatctttatttggtttccagtttacttttactcttttttttcagagacagggtctcactctattgcccaggctggagtgcagtgtggtgtgctcaaagctcactgcagtctcaaactcctgggcttgagccatcctcctgccttagtctcctgagtagctggcactgcaggtgcacaccatcacatgcaaataattgtactatttttcctttttgtagaaacagagtcttgttatgttgcccaggttggcctcaaactcctgacctcaagagagcctctggccttggcctcaaaaagtgctggaattacacgtgtgagccatcatgctcggtttaatttacttttcaaataaaatccatgtacagttttgacaatggattttagataaattaatatctagttacctcasatcttca

SEQ ID NO: 9278 - DNA, 138 bp, Homo sapiens
  misc_feature 7: r=a or g
  misc_feature 11: y=c or t
  misc_feature 12: s=g or c
  misc_feature 25: y=c or t
gcgtccrtgtysttattgtggtggyagcggcgtctggctgctgcggaccccgccgagtcctagcgcctggcctgcgcgccgctgcccgcgccacaggattaatttatttttggaaatcaagtgcaatattggaagcca

SEQ ID NO: 9279 - DNA, 216 bp, Homo sapiens
actgtgtagctgttggatggaatgttccgtaaatgtctgtttgctctatttggtctacagtgcagttcaagtccagtgtttctttgttgatattttgtctggatgatctgtccattggtgaaagtggggtgttaaagttttctactattatttcattgctgtcttcatttcccccttggtctattaatgtttgatctttgtattttctagtctcat

SEQ ID NO: 9280 - DNA, 199 bp, Homo sapiens
atcttttagtgaaatgtactgaaaagtatgctgttaaaattatctcagttttgcttcaaaataatctaatggggttgactgtagaagaaacggagcatctgttaagttatagcttggtgataggcgcatggacattcatggttttgttttcttttgtgtttgaaattttctgtgataaaaaaatttttcaataggtccc

SEQ ID NO: 9281 - DNA, 330 bp, Homo sapiens
atgaatatgagaattaaatcacatgaggtatgctaagaactcaacatggcagagagcccaaggaagcactgggaaaaggctagctcctgacactacccctcaccaaacttccaggcctttctgaagactatgagaatatttctgttctaaaatggcagagatattactgacgcttctaccaccattctccttaagctccacattgcttctccttaagctatcttccttttccagccatattccattacttttaataagatttgtcctcttaataagcaggctggtaaacacttgacttgttccaattcctgaatccctccccaaacaaag

SEQ ID NO: 9282 - DNA, 370 bp, Homo sapiens
cctcagcctctggagtagctggtgttacaggcacacaccaccatgcctggctaattttgtatttttagtagagacagggttttgccatgttggccaggctggtctcgaactcctgacctcaggtgatccacccacttcagcctcccaaagtactgggattacaccacacccagccatagttttaaatttaatttaatttaattttcatagttacagagtcttgttatgttgcccaggctggtgtcaaactcctggtttcaagggatcctctctccttggccctttaaagttttgggattacaggcataagacaccacacttggctttattttcttttacagatacgttttctctctcttccccaggttgg

SEQ ID NO: 9283 - DNA, 343 bp, Homo sapiens
  misc_feature 7: s=g or c
  misc_feature 8: s=g or c
  misc_feature 10: y=c or t
  misc_feature 141: r=a or g
caggtcsstyggagtttgctggaggtccactccagaccctgtttgcctgggtatcaccagcagaggctgtagaacagcaaatattgctgcctgatccttcctctgcaagctttgtcccagaagggcacccgcctgttgaargtgtctgttgacccctactgtgaggtgtctcccagtcaggctacacaggggtcagggacctgcttgaggaagcagtctgcgttcttggagctcgcacactgtgctcagagaaccactgctctcttcagagctgtcagacagggacgtttaagtttgcagaagctgtctgctgccttttgttcagctatgccctgcccctccg

SEQ ID NO: 9284 - DNA, 202 bp, Homo sapiens
  misc_feature 7: h=a or c or t
  misc_feature 8: y=c or t
agtaaahygtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtgagcg

SEQ ID NO: 9285 - DNA, 192 bp, Homo sapiens
ttctgagaaagcttttcaagtgcgtctgtcactttcttttttgcattatacttcctgcttcttatagtgaggttttaacttcagccattcatgcaaccttacctgagggcagctccttccctctggatcagaggaagaggccagattcagtcccactccctcatttacatattgtttctacttagggaagct

SEQ ID NO: 9286 - DNA, 202 bp, Homo sapiens
  misc_feature 3: y=c or t
  misc_feature 4: h=a or c or t
  misc_feature 7: n=a, g, c or t
  misc_feature 8: n=a, g, c or t
ttyhgtnntttgttttgagacagggtctcgctctgttggtcaggctggggtgcagcgggtgcagtggcaggatctcagctcactgcaacctccgcctcccgagttcaagtgattctcgtgcctcagccacctgggtagctgggattgcaggcgcctgccatcatgcccggctgatttttgtatttttagtagagacggagga

SEQ ID NO: 9287 - DNA, 375 bp, Homo sapiens
tggcagctgagtccactctgtcgtgtgcagcaggccagaagtactggaatctcatccagtgcctcgccctcctgtttttcaaagactgagaggggttggtgtatgaagaccataacatccttgtccctttggttggaaactctgaggtgccagactgcacgggctcccagaacccttaagaggacagtgtgatctagtcactcacagtgagaactagatgcaccctttaaaatcttccttcccatccctgtctcatttctctgctctcttaccttgtttcttgggatcgccttgcagagaaattaatgaatcctcctctaaagggaaactcaaatcaaaacactaagtatgacaggctttctagaaagctctctc

SEQ ID NO: 9288 - DNA, 325 bp, Homo sapiens
  misc_feature 305: s=g or c
agactcagctcctggtgaagctcccagccatcagccatgagggtctgggatctcctcttctcgttcctcttcatattcctgatgcctcttccaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaascaaattaaactatggtgtca

SEQ ID NO: 9289 - DNA, 318 bp, Homo sapiens
  misc_feature 67: r=a or g
  misc_feature 86: y=c or t
  misc_feature 289: w=a or t
attaagggttttgtcagacaattgtcacacgaagaatagtgtcacttatctactcttgacacacagractggcctggcatataggytttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacttcatgatagcagtgtatatatagtcttgtwtgtagttggaagtcatcttttaggagtta

SEQ ID NO: 9290 - DNA, 132 bp, Homo sapiens
  misc_feature 50: s=g or c
tggagcagctgttcctcttcgcggaattttctgtgacgctcctggcgcastgctgttcctcctccaggaattttctctctcgttcctggcggcgcacctgctgttcctcttcacggaattttctgccacgct

SEQ ID NO: 9291 - DNA, 162 bp, Homo sapiens
  misc_feature 13: b=c or g or t
  misc_feature 21: m=a or c
  misc_feature 89: k=g or t
  misc_feature 129: m=a or c
  misc_feature 130: m=a or c
  misc_feature 135: r=a or g
  misc_feature 142: w=a or t
  misc_feature 144: w=a or t
  misc_feature 158: m=a or c
ttttttttttttbcgaactamacttgggctcctttttttgtgctcgacttttccaccctttttccctccctcctgtgctgctgcttttkgatctcttcgactaaaatttttttatccggagtgtatttmmatcgrttctgtwcwgtcctctccatcamcccc

SEQ ID NO: 9292 - DNA, 298 bp, Homo sapiens
  misc_feature 97: k=g or t
  misc_feature 106: r=a or g
  misc_feature 267: r=a or g
tgtagtctttaacctgctctgatacatattcagagtatggattgttgtttaaaaagagttgcatgtttaaagagttttgtactagcttttcattatkttgtatctrgattatcaacaatggggctaccactttccttggttttatatccatttcctcttggaagttcttgttgcttatgtgacctgttggttgttccccggactgggcacctacaggagtcagggcagacggcagatgtggctggaggtcagggctcttctgcttarttgtgttagagtcttccagcatgggactgat

SEQ ID NO: 9293 - DNA, 256 bp, Homo sapiens
atcaattacagtttttagagggctcagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacaggga

SEQ ID NO: 9294 - DNA, 359 bp, Homo sapiens
ttgtaaatggaaatgtatcaggagtgcctggaacacttttccctcttgataggagttggagaacactgcctagccctctgccaagaagtaagtcaagcaaatgaagataccagttggatcagagggcctaataatagtctaaaaccaagcttcagaaattgcttcgtgactgttgtaagatcaatattgtgtttgcgtattagttggacagaaagcatgtgtggacattcatccaacctgaccccaggtcattcattctccatccaaaaagggttataggtatggtttatggtctttgtttcagcaaaacgtcctacagcttggacttggggtggatttatatagtgtagcatttgtat

SEQ ID NO: 9295 - DNA, 333 bp, Homo sapiens
  misc_feature 105: v=a or c or g
gttctcatgcctcagcctcctacagagctgggtctacagatgcctgccatcatgctcggcttatttttgtatttttagtaaagatggtgtttcaccatgttggcvagtctggtctcaaaatcctggcctcaactgattcacctgcctcggcctcccagagtgctgggattacaggcttgagccaccagacccgaccccctttttctctttaatattttatttattttttgagacagtctcactcgttccctcaggctggagtgcagtggtgcaatcactgcagcctcgacctcctagctcaatcgatcctcccacctcagcctcccgggtagg

SEQ ID NO: 9296 - DNA, 208 bp, Homo sapiens
  misc_feature 7: n=a, g, c or t
  misc_feature 8: y=c or t
  misc_feature 117: r=a or g
  misc_feature 120: h=a or c or t
  misc_feature 151: k=g or t
gcgttcnygggctggctgggtgcagctctcttttcaggagagaaagctctcttggaggagctggaaaggtgcccgactccagccatgctggcgctactgtgttcctgcctgctcctrgghagccggtgcctcggacgcctggacgggcgakgactcggcggagccaactctgactcggcggagtggatccgagacatgtacgccaaga

SEQ ID NO: 9297 - DNA, 152 bp, Homo sapiens
  misc_feature 7: n=a, g, c or t
  misc_feature 8: n=a, g, c or t
accatannactcatccactggcctggcggtccctcctaggtatcatcctacttttctccttcctcatccagacttctaaacagagtaatctacatcctcaatgcctaccttaccttcacttcacacctcaacccccagtaatccacccacct

SEQ ID NO: 9298 - DNA, 201 bp, Homo sapiens
  misc_feature 144: m=a or c
agaatttctccagggcagaaggttgaataaatgcaggggaacgtcaggggcagatgaggggaacgtcagtgacagagctgacgcgggttccctccctctctcctggccgtggaccctcgcttgcagagaggggccggcccgcgmacccccggcttccgaagcttgtctccagtgacttattctcgtctgtgcagcggccac

SEQ ID NO: 9299 - DNA, 266 bp, Homo sapiens
  misc_feature 7: n=a, g, c or t
  misc_feature 8: d=a or g or t
  misc_feature 57: k=g or t
  misc_feature 101: r=a or g
aagtgandagagagtggtttttaaattcatcttggtcctttcaactcctagcactgkgcctggcaccaataggtactcaggaaatgtgtgtggaaagaacracagagtcagtgtctatccctgaccaagtatttttgtcagatgtctacctcctctctttggttctgtcccagtcaatggaatgagccttccagagatataaagtgaactttctggctccctgaaggcacacaagatccctccccaaagccccacttcacccgaca

SEQ ID NO: 9300 - DNA, 190 bp, Homo sapiens
  misc_feature 7: d=a or g or t
  misc_feature 8: n=a, g, c or t
  misc_feature 9: n=a, g, c or t
  misc_feature 49: w=a or t
  misc_feature 50: y=c or t
  misc_feature 142: n=a, g, c or t
cacagtdnntctctcataactgttgatagtaatgtcctcattttcattwytgattatagtaatttcatccacttgcttttcttgttttaaagtcagacaagataaaggcttgtcaattttgtctcttcaaagaaccagcttntttgtttcattgattctctgtttttctgttctataatttctctccacc

SEQ ID NO: 9301 - DNA, 217 bp, Homo sapiens
cttgaaatgggctgagtccctcttgctcacccttgacttggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccga

SEQ ID NO: 9302 - DNA, 256 bp, Homo sapiens
taatcacccgtcttctgcgttgctcatgcagggagttgtagactggagctgttcctatttggccatcttggctccacccctatttatttttattatttatttattttttgagacggagtcttgctctgtcgcccatgctggagtgcagtggcacaatctcagctcactgcaagctctgcctcctgggctcacgccattctcctgcctcagcctcccaagtagctaggactacagtcacctgccaccacccctggct

SEQ ID NO: 9303 - DNA, 325 bp, Homo sapiens
agctaggtcatgggtacatgagattttattatgctattctgtctactgttgtgcatctgttaaatgcttgtaatgaacagtttttaaaaattcaatgtatcttaccactgggtagtcgaagagaagaccacacatcctgaactccccagtctggtgtgaggggaggacagctgataactggatatgcagtgttcccagacatcactggtcccaaaccattacttctgcctgccactgccacaaatacagtaggaatgccatcccctagggaaatgacaagagtataattatgctaaacattcaaaacagatttaaagacagggtc

SEQ ID NO: 9304 - DNA, 311 bp, Homo sapiens
actaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacactt

SEQ ID NO: 9305 - DNA, 262 bp, Homo sapiens
ctctcttgactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggcccg

SEQ ID NO: 9306 - DNA, 201 bp, Homo sapiens
catggcaaaatcacgtctctattaaaaatacaaaagattaggcctggtggcgtgcacctgtggtcccagctacttgggaggctgaggcaggaggatttcttgagtctgggaggcggaggttgtggtgagctgagatcacgccactacactccagcctgggcaatagagactctgtctcaaaaaaaaaaaaaaaaaaaaaaa

SEQ ID NO: 9307 - DNA, 226 bp, Homo sapiens
tttacatatatgattcccagatctgtatcttcaagcctgccccatcactcttccttcagtcctgtcttgtgcactgggacattgccctgtggctctttgctgctccctgaaactgaatctgttgaatatagagtctcttctcttgcaaatcttttccccatgcacagctttgcaggcctctgaaggacttcactagacctgtcatcccatctagaaggccagctga

SEQ ID NO: 9308 - DNA, 354 bp, Homo sapiens
aattttatagatcagaaaactgaggctcaggatactgctaataagcagcagaaataggattcccacccacatgttcccaaagccagcattttttctagttcatgactctaattttcaacaatcatataaccttgaaataataatatgtaccttcattataccacttgcattttcaggaacatcgttcaataatgcattctttatgtattcctgattttattaagaaagccatttgtgtttcaccattaaataaggtgatagttatgactaagaaaaatatttttattacattttcttaagcaatgtttaaaaggtattaaaaattaagtgaacacccatgtacccagcacccag

SEQ ID NO: 9309 - DNA, 447 bp, Homo sapiens
  misc_feature 7: n=a, g, c or t
  misc_feature 132: w=a or t
  misc_feature 233: k=g or t
  misc_feature 277: n=a, g, c or t
  misc_feature 278: n=a, g, c or t
  misc_feature 328: n=a, g, c or t
  misc_feature 329: n=a, g, c or t
  misc_feature 335: w=a or t
  misc_feature 345: k=g or t
  misc_feature 348: k=g or t
  misc_feature 357: r=a or g
  misc_feature 376: w=a or t
  misc_feature 384: r=a or g
  misc_feature 402: w=a or t
cactttntcttacctcaattgagtaacagaatatagctcctgaaggaaacactgatttgctttctgtttcccatatctcacctctaggatatgatggaagaagtgcttgaaagagaattttagcagatggtwcttttcttagtgacctctggaataaaagaactgacttttgatagttttaaaattaatctttgcatgaaggttggtttcgctttttttcctttaagtttgtktttaaatgtattagtccaggggattttgccttatgctgaggtcnnactaaggataagcaagcttttgtccttcattttaactgttatgtcatatnnttatgwtgacatattkctktataagagratagaggcaaaagtatagwactgaggrtcatttgtatttttgagwtggaaattatgaaacttcaccatattatgatcatacatattttga

SEQ ID NO: 9310 - DNA, 436 bp, Homo sapiens
  misc_feature 366: s=g or c
  misc_feature 410: s=g or c
tacttcttgtaaagcctgcagaaccgtgagccaatgaaatgacttttctttataaattacccagtcttgggtatttccctgtagcaacacgagaacagactaacacagatacttaacaattatgtgtaattataaacatgaacggcctgtggtacccacatgttatgtgggtgcatttttcattgtgctggacactcctgggaaggagcactgcctgctttgaaagtcgaaggttggaggtgttgccagtgttcaacaggctggctggatgcaaagcttgtgctgtgtttaaaatccttcctggggttggcagcaatgagtaagataatgctccttgctcacagagagtagtcggccagctgaaascctgcttggcagtactgccatgggctacttctctccacttaacstttatccaaattcagtgacccaacca

SEQ ID NO: 9311 - DNA, 353 bp, Homo sapiens
  misc_feature 19: w=a or t
  misc_feature 99: k=g or t
  misc_feature 250: r=a or g
  misc_feature 257: w=a or t
  misc_feature 315: n=a, g, c or t
  misc_feature 319: k=g or t
acttggcttcgtgccagtwgctccaagtctatggcacctccctccctctcaaccacttgagcaaactccaagacaccttctaccccgacaccagcaatkatgccaagggccattaaggtcttggagcctggatgagcctgtggtcaagagatggcaggcagtgtccttgaatttggaatgtgactcacactctgcctgtaggggaagaaaagagagatcagactgttactgtgtctatgtagaaagggargacagawgagactgcattttgaaaaagacctgcactttaaacaattgctttgctgagatgttgtnaatktgtagctttgccccagccactttgccccaaccac

SEQ ID NO: 9312 - DNA, 287 bp, Homo sapiens
  misc_feature 228: k=g or t
  misc_feature 229: r=a or g
ttgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgkrtccgttcccctcctacggtgtgctcctgaatgaaggtttctatgtaagcagatggact

SEQ ID NO: 9313 - DNA, 447 bp, Homo sapiens
  misc_feature 209: k=g or t
  misc_feature 342: s=g or c
  misc_feature 343: s=g or c
actcgctgagaggccctaggcctacgtccagatggtggggaaactgtgggggcccaacctgttcgaagggaggaattggggaagggacgggctggccttctccccatgggaaaggggaggacattcagaaggacctcttggcatttgggagcttctgaaggagctgcggccaccgccgccctgtctcctgtgcccatgattcacggagkgcccgggacagagcagcctcttcgcagaaccctcagggaggctccaggcctcagggaggaggcagcaaaggttggttttgctattgtcaaagtcttcagtgggcccttggcaggagactggtggaattgaaasscactcccttaggggaagggtcccagcaggcgtggctgtcttgtctctggttcggattaggtgacaggcactccaaatgtgacactttctcgttctcatcttagt

SEQ ID NO: 9314 - DNA, 207 bp, Homo sapiens
  misc_feature 131: k=g or t
attaccatgttgcctcaattcttaggaagacttctttttaattgagaggtcttcttgctcctttatgtcagaaggaatggtcacattgctgactttttcttgtttatggactgatgactcatttatgagtkatctaaacgtcttgttccttctttctctcttctgccgtctctatcatgggactattttctttctgctagcacttct

SEQ ID NO: 9315 - DNA, 187 bp, Homo sapiens
ctctcttgctcccactcttaccacatgatgcacctgcttccccgttttcttctgccgtgggagttccatatgcacctaaccctggagctcccaaatttataaaacaattgctaatagacataagaaatgagatagacagcaacacaatttgagtattgaagggggacttcaatactccaccgacagc

SEQ ID NO: 9316 - DNA, 266 bp, Homo sapiens
ttcattcccctctgtggagacaagagtaggatgaacatgttctctcctaacactgcatggtgaatctggacctgagctggttggcaccgcctgcagctggaggtaactgggacaggcaggacctgtcccacccaatcaagaggaatggtaggagccccacccaccttggactcagctgtagctaccagacagccttggaggtttctcaaagctgttatccagactgagaggagatgttgactaagacattgatcatctggcccgct

SEQ ID NO: 9317 - DNA, 134 bp, Homo sapiens
actccactgcgactgcagaactcagagctgctcttcctctgtggccagttggggaccagcatcatgaagtggatggtggtggtcttggtctgcctccagctcttggaggcagcagtggtcaaagtgcccctggt

SEQ ID NO: 9318 - DNA, 316 bp, Homo sapiens
atgctgctgcatctatggttggttttttatttttatttttattatttatttatttattttttgagtctcaccctgttgcccaggctggaatgcagtggtgcaatctcggctcactgcaaactctgctcactgcaacctctgcctcctgagcagctgggattacaggcacatgccaccatgcgtggctaatttttatatttttagtagagatgggttttcgctatgttggtcaggctggtctcgaacccctgacctcaagtgatctgcccgcctcggcctcccacggcctccgaaagtgctggggttacaggcgtca

SEQ ID NO: 9319 - DNA, 180 bp, Homo sapiens
  misc_feature 135: k=g or t
atattctttatcagattgaagaagtttccctctactcatagtttgctaagagtttttctcatgaatgtatattgtatttgttttgttttgtttttgagacagagtctcgctctgtctgtttcccaggctggagtkcagtggcgtgatctcgggtcactgcaacctccacctcccggattg

SEQ ID NO: 9320 - DNA, 388 bp, Homo sapiens
  misc_feature 154: b=c or g or t
  misc_feature 335: b=c or g or t
gttttttgtccacattaatcaagtatctttgtttcccaacattttcgagtggcctaggcattgttccttcttctgaaaatattttgaattagcttataaaatgaaatcaattctcagagatatgtacctgtttttgggtgtgtgtgtgtgtgtbtttccagatggagtctcactctgtctcccaggctggagtgcagtggcacaatctcggctcactgcaacctctgccaaccgggttcaagtgattctcctgcctcaacctcccaagtagctgggattacaggcgactgccattgtgcccggctaatttttgtatttttagtagagatggagtbtcaccatcttggccaggctggtcttgaactcctgacctcatgatccacccagc

SEQ ID NO: 9321 - DNA, 227 bp, Homo sapiens
tttttcagctgggcagctctgggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactgggtaagtctgctctgaggcaggggatctctgacctggggggcga

SEQ ID NO: 9322 - DNA, 197 bp, Homo sapiens
tttctgttggcagtggctttgaagattatttttctttttattttattttattttattttattatatgttaagttctagggtacatgtgcacaacgtgcaggtttgttacatatgtatacatgtgccatgttgttgtgctgcacccagtaactcgtcatttacattaggtatatctcctaatactatctctccccgat

SEQ ID NO: 9323 - DNA, 178 bp, Homo sapiens
tgagatggagtctcactcttgtcactcacgctggagtgcagtggcacggtctcggctcactgcaacttctgccttccgggttcgggcgattctcctgcctcagcctcctgagtggctgggattacaggcgtgtgccaccacgcccagctaatttttgtatttttagtagagacgggtg

SEQ ID NO: 9324 - DNA, 160 bp, Homo sapiens
  misc_feature 43: k=g or t
  misc_feature 44: k=g or t
catcatcttgctctatgtatatatatttttttgtcttatgtgkkctgtctcacttcattcttcttgtcttaccttgtttaattttttcccattttactttatttttattttacagtgccttattagatatacctctttttttcaagtattccctgatcga

SEQ ID NO: 9325 - DNA, 369 bp, Homo sapiens
  misc_feature 12: s=g or c
atccggcctgasgcaggtgctcgcttggtctagtgcccatttactctggactccggatggctgccgcacgcctctgcctctccctgctgctcctgtccacctgcgtggctctgttactacagccactgctgggtgcccagggagccccactggagccagtgtacccaggggacaatgccacaccagagcagatggcccagtatgcagctgatctccgtagatacatcaacatgctgaccaggcctaggtatgggaaaagacacaaagaggacacgctggccttctcggagtgggggtccccgcatgctgctgtccccagggagctcagcccgctggacttataatgccaccttctgtctcctacgactc

SEQ ID NO: 9326 - DNA, 142 bp, Homo sapiens
aattatattattttcttctttataaactaggttctgcttatttcctcttaccaaatacctggcaatcccagaccctctacagtgacttgtttaacctacaaatatcatacccctggttaatacactattccctctttccccc

SEQ ID NO: 9327 - DNA, 348 bp, Homo sapiens
  misc_feature 341: y=c or t
ttaggcttatgtcataggaatgttctgaagctttctccaaggccagtttgttacccagtaaccaggggtgataggagaaatacttaaaatgtactggaggcaggccactcccaaatggactgtggccagccagaggaccagcagggtctgttggatagtcttctgtgccaagtgtgaacacttcagttgctgggtcttgtggagctccagtgagtcctggggaagtaggtgcagaaggagagaacactagggcagcttttatctactgaatattttaacaactgctgtagaggtaacggttggtactcagtgaatatcagctttccctctgcactcttgayacccact

SEQ ID NO: 9328 - DNA, 193 bp, Homo sapiens
tgtttttagtagagacggggtttcaccatgttggccaggctggtcttgaactcctgacctcaagatccacctgtcttggcctcccaaagtgctggtattacaggcatgacccactgcgcccagcctcgtctaggttttaagtcccgtacgcattaggtatttgtcgtaatgctttccctccccttgcccccac

SEQ ID NO: 9329 - DNA, 413 bp, Homo sapiens
  misc_feature 10: s=g or c
  misc_feature 43: b=c or g or t
  misc_feature 78: r=a or g
  misc_feature 87: k=g or t
  misc_feature 339: r=a or g
  misc_feature 346: k=g or t
  misc_feature 364: k=g or t
  misc_feature 380: r=a or g
  misc_feature 397: r=a or g
taaaattccsaatcctagttatttggtcaaacagaagattaabagaactccatggcttaccacaggaatatttatcargagaaaaakaagatacctatttgaatttacatgacactttctgtgaaatatctggattaccagattagtctgaaacaaatgccttccaaattctacagcgcatgcccaaggcactctttacagtacctgttcgggtcttttcttctaattttaagcacctacccaaacgtcttcccaggcttgtcataataagcaaataacctcagagcagacaaagtgattcaatctaagaaccttgaatttctctccttttcacctcaraatttckattctcacactttcttgkttgtttctctttccargaagtggttctccatcrgcaaataccagctgtt

SEQ ID NO: 9330 - DNA, 138 bp, Homo sapiens
aggtgtgatagatttctctttttttctgacactcacattctttctatcctcaagtcttgccaactttactttcaactctgttccagtacagtcaattccccatacccccagaactaccgctttttctgaagccacctt

SEQ ID NO: 9331 - DNA, 223 bp, Homo sapiens
aacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctccc

SEQ ID NO: 9332 - DNA, 211 bp, Homo sapiens
  misc_feature 8: s=g or c
  misc_feature 45: r=a or g
agcgtgasactcgcgccctccggcacggaaaaggccaggcgacargtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacaat

SEQ ID NO: 9333 - DNA, 189 bp, Homo sapiens
  misc_feature 15: r=a or g
  misc_feature 48: s=g or c
attttttctttagarctgtggtcttgctctctcacccaggctggagtscagtgttgcgatcacagctcactgcagcctcaaactcctgggctccaggagacctcctgcctcagcctcctgaatagctgggactacagtcgcgcaccaccacgcctggctaattttttatttttgtagaaatggggtata

SEQ ID NO: 9334 - DNA, 491 bp, Homo sapiens
  misc_feature 404: k=g or t
  misc_feature 414: s=g or c
  misc_feature 428: y=c or t
  misc_feature 444: m=a or c
  misc_feature 449: m=a or c
ctctttgaaatactctctgcacttagcttccaggatacaacgcctcctggttttcttcctgcttcactaactactctgtcagtccccttgactaattttcttatgtctccagccaactaaggttcagtcctttgataatctctttttctacacttattcctaatggctttatttagtcttctggctttgctcagacttttcccctgaactgtagactcttatatccaactgcccgctcagcatctcctcttagatgtctaataggctgcccaatttaacatgtttagaactgagctcttgctattccctcctcaaatctctcacagtcttcctcactttaataaatagcagatctaccagttgctcaggccaaaaaaactttggagcctttcttgactcctctktttctctcasaccccacatctgtyaccaaatccccttggmtgtamtttgaaaataatatccagaacctgatgactgtttcttacttt

SEQ ID NO: 9335 - DNA, 313 bp, Homo sapiens
  misc_feature 45: r=a or g
tgtttttttgttctgtttcgtttttcaaaataatgctttttgcaraagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccg

SEQ ID NO: 9336 - DNA, 157 bp, Homo sapiens
ctctacactggttattctagttagcaattcgtctaacgttttttcaaggttcttagcttccttgcattgggttagaacatgctcctttagcttggaggtgttggttattacccaccttctgaagcctatttctgtcaatttgtcaaactcgttctcc

SEQ ID NO: 9337 - DNA, 310 bp, Homo sapiens
  misc_feature 41: n=a, g, c or t
  misc_feature 63: v=a or c or g
  misc_feature 249: m=a or c
  misc_feature 276: w=a or t
  misc_feature 290: n=a, g, c or t
  misc_feature 291: n=a, g, c or t
tcaggtgaggctctctggaaggacggggagggccccaagcngacagccccgcgccgcctccavctttgcgggttttcccgtggaggccagaggtctggcttggctgctcgttctcgttgggggaaaccgtccagacgcacttgctgcccattctttacatcctgggggtgaatccctgaggggcctctccttgctgaagagtagcctggagctggacggagactgacccgccacgtttccagccgccgmgagtctgctcaggaactctgggctctwtgcttcgcgaaatnnaaaaatgcaaaaaggcagc

SEQ ID NO: 9338 - DNA, 351 bp, Homo sapiens
  misc_feature 60: n=a, g, c or t
  misc_feature 64: r=a or g
  misc_feature 67: r=a or g
  misc_feature 245: r=a or g
tcatttatgaaattggaataatatacctttcttagaagtattacatgaggaataaatganatarcaratgtgaactagcatcctggttggttcatacaacttcacagtaaacgatagtttcttctctgtcactcagagttgaaaactgcaaagtctatcacattattcccgatgaatgtagtaatgtcctaagagtgatcactcattgatgacatgtcagccatttgaacatttcaaacacagargccactttgtccccctcattgatctgtcaggcctctcacatactaaatctttgccttacccaccttcgtggtctatcaccttaactctgatcagtgtcttttaact

SEQ ID NO: 9339 - DNA, 212 bp, Homo sapiens
ttttctggccgcctctgcctccatctctgtgtgtctgcgtcttcgtccctgtctctgagtttcggcttgggtgtctctctcctaccccggtctctctgtgtcctgtctgtctctgcctctcctgtccctctctccgcagcgccctccccgtctctgtctctctgagtccctagctcgctccttctctaaatctgtgtccctatagccccctg

SEQ ID NO: 9340 - DNA, 188 bp, Homo sapiens
ccttccataggtggtgtaccgttttgcattcccatcagcactgtatgacaatgcccatttcttcatattcccagaatgtgttgtcaaactttcacgatggctattttatgttaattatactttctgccattttactaaattcttttattggttgtgtcagcttttatcattgcttttcttggggttca

SEQ ID NO: 9341 - DNA, 325 bp, Homo sapiens
caatggcaaacataaattttaatcctctaaaagtatttgcaaagttgattcccctgtgtttttctttgtgtgtgtgttattttcaaatatacattaagtatagaaagagtagtgtaattaaccctcatgcacccatcatgcagcttcaacagttatcagtatttggccagtctcctttcatctatactcctcaaccccacaggtatcgagttattttaaagccaatcccagacactatataatttcatccttaaaaaaatttcagcataaagactccttaaagaataaaggctaaaggctttttcaaaacaaacaaatcaaccac

SEQ ID NO: 9342 - DNA, 271 bp, Homo sapiens
cctgtatagaaagtaatatcaaattgcctcttttattcattcctggatagggaaaaatgcatggagtctttggagttcagtcccctgggtcaaggtatcagctctcttacataccaggtgtgagactttggtccttgtgtcattccctcacccaagcctcactttctttccttgtaaagtggaggctcctagtttctccttcatgggtttctgtgaacagactcacacaatgaatgcattcacaacaatgagaatttctccttccacccca

SEQ ID NO: 9343 - DNA, 325 bp, Homo sapiens
  misc_feature 287: v=a or c or g
  misc_feature 288: n=a, g, c or t
  misc_feature 292: v=a or c or g
  misc_feature 293: h=a or c or t
ttccgtttattgggctgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttvnttcvhgatgagcttcctactgcccaagctgactagca

SEQ ID NO: 9344 - DNA, 160 bp, Homo sapiens
atctgctaacaacaaactactctctcttttaatttctacctcttttctttaccctttttctatttttattttccctttttctttgttttctttccttgtcatttccttttcaccagatgttcactttctcctgttctcttctctccctatcacaccacaa

SEQ ID NO: 9345 - DNA, 351 bp, Homo sapiens
taagaggaacaaaggaggtaatgtacctcatctataggatggcaaaagtgaactgtcatgaacagtgcttgggtccagggcaggggtggtaggaggcaggtcatgggcatcattgtcagcaaagtgagagccactccagctgcttgccttctctgtgcctttgtgtccccaaccagccatggagaagaaggattggggatcataagagagtctccaaagcacctgactttgttcccagagcccttagcccctttccacattctgccatttgatggacgaccatgggcagatcttaccttttaaataacactctgcagcccagcaagcatcctcacccacatcaggccacta

SEQ ID NO: 9346 - DNA, 416 bp, Homo sapiens
cttctgctctcagattgggatttataccaccagctttcctggttctccaccttgcagaaagaagatcctgggacttctagctcagcttctataaccatgtgagcctgcagcatgggttgcatctcttcccgtggggatggagtaagagttgcagtggactgctgtccaaaggagatagcaggagaagaagccacgcctcgaacaggaggtgttgggaccctatcatcatcttcttccagttcatcttccagaccttggtgttgactaagacagcacttcgttcagtcgggactttggcatctaaattctgccacgaagatgtcgcctgcagacctgaagtctgacgatacatcactcggtagccttggataaactggggttggcgatcaacctgaaaaacatagttaagggcaaga

SEQ ID NO: 9347 - DNA, 426 bp, Homo sapiens
  misc_feature 286: r=a or g
  misc_feature 287: r=a or g
  misc_feature 304: h=a or c or t
ggaaattggaatcacattgtgttgtttttgattttgagacggggtctcactctgtcgcccaggctggagtgcaatggcacaatcatggcttactgcaacctctgcctcccaggttcaagtgattctcttgcctcagcctcccgagtagctgggattacaggtgtgagccaccacgtccggctattttttgtatttttagtagagacggggtttcaccatgttggccagactggtgtcaaactcctgacctcaagtaacctgcccacttcagcctcccaaagtcctrrgattataggcataagchaccttgctcagcctagtcatgcatttttgacttaggatattttcaatttacgacagcgttatcaggacataaccccatcgtaagtcaagatgtatctgtacatgtgaagtgcttagaatagt

SEQ ID NO: 9348 - DNA, 308 bp, Homo sapiens
  misc_feature 275: r=a or g
  misc_feature 305: m=a or c
gaaaaaaaggactggaaagacattggtgaatagaaagatgaaaagggtgaagaaaaaaatgatgatggtcaatagggtggttttaaaagaggcttttgttttattaatttgtttttgtgtgagtgtgtgtgtatgtgtttgttttttgcctaaaagtatttaactccgcattacaccactgatttcaaagaaaaaaagctgaaatgtaagatcatatgatttgtttttaaactgaacactgtatactgtctttttatttttgcaaattaatgtartatccagtgtgtctttagataacccaccamtcg

SEQ ID NO: 9349 - DNA, 377 bp, Homo sapiens
catcaaaaaattttctaggaaaaaacttcatacctgctggttgttctggctgattctctgttttctttacggagtattaagaatgaaagtacctggcataagctatccttgtaacatttccatcaactctctcatttgttgacatctgttttaccttgttttgaattattccaggacatttttttgttgttgtttctttttgacatagagttttgctattgtcgcctaggctagagtgcagtggcatgatctcagctcactgcaacctccgcttcctgggttcaagcgattctcccacctcagcctcccaagtagctgggattacaggtgtaagccaccacgcccagctaattttcgtatttttagtagagacggga

SEQ ID NO: 9350 - DNA, 331 bp, Homo sapiens
  misc_feature 241: w=a or t
  misc_feature 242: r=a or g
  misc_feature 291: s=g or c
  misc_feature 295: w=a or t
atctattatggtctgtccttctaagaagtccctaatttggctgcgaggattaggacatagttcccaagcagggcccacgctggcagggggcccaggagctgcggaggaaatgggtctaagcgaagagaccatctgttcgctccaggtgagctcattcattccacagctgctgctgaaacaatgactcccacagaaccatctccagaccctcaccccaccccgagttccgggtcagaaagtwraactgtatcctggacatgtggatgtccctggccaccgaaagtggctcasatawacaaggacaacacagaactcatgttcttgtctctgc

SEQ ID NO: 9351 - DNA, 195 bp, Homo sapiens
ttcgtttgtgttccctgcttgtgtctcttgcatgattcttcttggtctactgtgaactcttacccttcccctcacctctgccccctccccacgtctctctctcggcccctccctctccggtggcctcttttctttcagacagagaagattacagtatgtggggacacccatggccagttctatgacctcctcaac

SEQ ID NO: 9352 - DNA, 176 bp, Homo sapiens
  misc_feature 24: v=a or c or g
  misc_feature 27: h=a or c or t
  misc_feature 28: m=a or c
  misc_feature 97: m=a or c
  misc_feature 98: y=c or t
  misc_feature 104: m=a or c
  misc_feature 107: w=a or t
  misc_feature 155: v=a or c or g
  misc_feature 156: y=c or t
tcaacagttatcaactaaagactvcahmttttttcatctctacactcaccctctttccctcccaggcactagataattttgaggcaaattttggacmytgtgtmatwctagccacaactatttcagacaaagggcctttcaatatcatatatatvyatacacatatatatacacac

SEQ ID NO: 9353 - DNA, 219 bp, Homo sapiens
atctctggatagcacacctctgaatgtaaatcatgataaaatggatatttggaaacttactcctaagctgtgatttagggtgtatttctacttctggactgcctcaatatcaagggctgagacttttgaattttgaatattcgttgggtttcatgttaagaagcctgtggtctaggagtgctattcagtgtttcttttcctgataaacactttgaatat

SEQ ID NO: 9354 - DNA, 367 bp, Homo sapiens
  misc_feature 8: h=a or c or t
  misc_feature 12: m=a or c
  misc_feature 36: k=g or t
  misc_feature 118: w=a or t
  misc_feature 141: m=a or c
  misc_feature 187: m=a or c
  misc_feature 272: m=a or c
  misc_feature 273: w=a or t
  misc_feature 323: d=a or g or t
catgtcahgcamacttgtgcgtttcagattaccackatggagagcaacctgaagaccatcgaagaggagaacaaagtgattgagcagcagaacgagtctctcctccacgagctggcgwacctgagccagtctctgatccamagcctggctaacatccagctgccgcacatggtaagtgactgagcamgcaaggcaggaatgtggagtcctccacagcgcacagcctaaagtagatgccgtttttatcgttattttcatggttcttcagcctmwggcaaatgtttgtggttaccaccccgaaaccataccattaactgctagadacatgggcggggctgaccccagaaacttaagtgtgctctgagcc

SEQ ID NO: 9355 - DNA, 384 bp, Homo sapiens
  misc_feature 2: n=a, g, c or t
  misc_feature 41: h=a or c or t
  misc_feature 326: k=g or t
  misc_feature 351: s=g or c
  misc_feature 355: r=a or g
cnttccttccttccttctttcctcgtccctccctccctcchtacctccctcccttccttcctttctttttttggaggcagactgttgctttgttgcccaggctggagcgcagtcatagcttactgcagcatcaacctcctgggctcaggcgatcctcccacctcagcctctcaagtagctggaactatagatgcacacaccgccacacccagctaacttttttattattattattttttgtaatgacagggtctcgctatgttgcccaggctggtcttgaacttctggccttaaatgatcctcctgcctcagccttccaaagtgckgggatcacaggcatgagtcacggcsctgracctacagatgaagagaaacttgcggaca

SEQ ID NO: 9356 - DNA, 259 bp, Homo sapiens
aaaataatcacttactatgaccagtttcttctctctcccacgctccaaattgccatttcattttcttctctttctgccaattccaagtcttcttaattctcagttgatggctttacttcttacttctctgagaggtggaaggataggaagccactgccatctccctgcacctgtgcttctgtgccccctttacttcctattatttatgaataacctatccttgtgagtctcaatctccttcagtgcaccagatcccgcc

SEQ ID NO: 9357 - DNA, 267 bp, Homo sapiens
agaacaagcagctgacatgattgctgtcggtgttcacagagccaaatatgaagataattgtaaagaaagagacggtcgcatcggatagaagatgtgatcctgctctcacgtttttccttctggcatgaccatacacgttttgagaaaatgttgccaaatgggtagactaaacaatgaatggctgccgggtttagtcatacctctctgtgtgagccgtcaattgctgacgggagctaggacattattccagctacaaaatgggcccgc

SEQ ID NO: 9358 - DNA, 441 bp, Homo sapiens
  misc_feature 346: s=g or c
  misc_feature 347: v=a or c or g
  misc_feature 348: b=c or g or t
agtaggccagcagaggccgctgggctgaagcctgcaggggtgcctcctctgccggatctggccaagcctcctgccagtcgaggccctttaccttccagtcacaccaagaactaaaacaggatcagccaaagataaaaccgaatcagtttgaaccctacagaggagcccagaatgatttctctttgtctcagaggcctgcctttctctctctgtctcagaggtttgcctccacctcccctgaaccttggcccagaagtttgccttctctctcttccttcccccttcttagtggcctctgaacccaagaatctgtcctggaagccaaatggaaattctacacagaagsvbgtctaagtcttagcagcaatgttgtactcgttttcttctttaaaattaatgaatacacagccagaggtttattatgccacacacattgtgttc

SEQ ID NO: 9359 - DNA, 427 bp, Homo sapiens
actcactcgctcctgcaatggcttccaccaggctcccggattctactctttcctttacagtcaagttcttaaacagcagccagggtggcctttaaatgacaggcttgtctagctgcaagactgatatgcgacctctatgcagaggactcagctggctgcttgttgcctcaacccccatggggaaagagtggaggaagaaaagtttgtgctggaggaagtaacaatttggttatgccatctagggtggggtgtacaagtctggagtgcagagaagaggctggagctggaaatagaaatgcagcgttctcagtaaagagagggcacaccagtctcagctagatgagtactggccatgggaacagtggggcaagagcagatctgctccactccacgcacatggcacaggtcccaccctcagcttcctcct

SEQ ID NO: 9360 - DNA, 287 bp, Homo sapiens
ttgtatagtttctaaaattcctgttattgatttctacttttattctattgtggttagagaagaagatgcttgatatttccatttattaatgttttaagacttgttttgtgaattaaaatgtagcctgtcctagagaatgatccatgtgctacagaagagaatgctgcagccattggattaaatgttttgtaaatattaagtccatttggcctatagtgcagatgaagtccaatatttctttgttgattttctgtctggaagatctgtccaatactgaaagtggagtc

SEQ ID NO: 9361 - DNA, 306 bp, Homo sapiens
  misc_feature 28: y=c or t
  misc_feature 284: s=g or c
cactgcgcccggcctattttttattttytttgagatggagttttgcttttgttgcccaagctggagtgcaatggtgcaatctcagctcactgcaacctctgcctcccgcgttcaagcaattctaccgcctcagcctcccaagtagctgggattacaggcgcacaccaccacgcccagctaattttttgtatttttagtagaaacggggtttcaccatgttgggcaggctggtctcgaactcctgacctcagatgatctgcccgccttggcctcccaaagttctsggattacaggcccaagccacca

SEQ ID NO: 9362 - DNA, 328 bp, Homo sapiens
  misc_feature 61: d=a or g or t
  misc_feature 313: r=a or g
  misc_feature 314: s=g or c
  misc_feature 315: w=a or t
agattgcagaagccaccttcatcatggccagctatatgaaccattgcactacaactgtgadcccccccaccaacccacccggagcctgccagctgtgggaactggatggacgacagttcttttcttctgtttcctgtgctaccaaggggccaacgttgctgtgaatatttctcctacccgattccccaccaccactagtgcctctggatttagagatatatatcctagggtatgatactactgtgacgggtctaacagcccccggctactcttgttctgtgaaatgtgtattttagtctctgtgaagcctttrswctctaggtggcca

SEQ ID NO: 9363 - DNA, 436 bp, Homo sapiens
  misc_feature 137: r=a or g
gggtttttagggcaatgaaactattatgtacagtactataatagtgcatacatgtcattatacatatgtcaaagatggtagaatgcacaacatcaagagtgaaccctaatgttaactatggactttggttgataatrctgggtcactgtaggttcattgatggtaacaaatgtaccattcttctgtgggatgttgatattggaggaggttgtgtctgtgtagggacaggcggtaaatgggaactctgtactttccactcagtttggctgtgaccctaaaacagtcttaagaaacaaatttttattaaaaaataagtctcagaagaaaaaatatgcaaaggatatctgcagaaagtttacaaaagcagctaggcttttccaggtggccaggaaaatggcctggatataatcccagctaattcagaaaagtacatggg

SEQ ID NO: 9364 - DNA, 398 bp, Homo sapiens
acaatagaatgttctaaaaccagaagtccaagtgcgtgtctacttatgggaccaataaataaagaacagacatttgatttgaggtgaggtaaaagcctgaaacatggaatggcattctgttttgatggattttcatttcttcgcacttctgagacggcaaagccaaccacttagaagccttccacatctttgtcacctgcctggctcctgctctctgatgtacctctgggtagtgagatggaaatggtgcctgcagaagttggggagaaggatacttttgcacagcctccatgatgtctttattgcaaatatggatgacaagggtctctgttacaggggcctcagagcaccttcgtttctcctctagaccagggacaggtgtagagataaggtctggc

SEQ ID NO: 9365 - DNA, 284 bp, Homo sapiens
tacttctatcatcccaaatcaaagaactcttctctattatgtttaatcaattgcaagcaaatagatttttctttgtaacaatttgttctgcagaaggctgtttttcacttttcctttcttttgcttctttctgtctttccttctcttttgtctggagaaatcacttagactctgtgtgcctcttctacattgcattctgctctgctatgttacctgctaggctggcttctttggactccctatatgattgatgatgtgaaaacctaaattacttgcagcatgtt

SEQ ID NO: 9366 - DNA, 302 bp, Homo sapiens
  misc_feature 8: k=g or t
  misc_feature 73: m=a or c
  misc_feature 78: m=a or c
  misc_feature 81: m=a or c
  misc_feature 89: k=g or t
  misc_feature 129: w=a or t
  misc_feature 130: k=g or t
  misc_feature 302: r=a or g
cttttgtkttgctttgtggtcccagctactcgggaggctgaggcaggagaatcgcttcagcctgggaagcctmaaggmtgmagtcatckgagatggtgccgctgcagtccagcctgagcgacagagtgwkacctcgtctcaaagaaaacaacaacaacaaaaaaccttgcttaatactgcagggttattgttggatccccgcttttccatttgttcactgtcatcaaaggagagtcaaatttcacagttgcatggactttatttttctataactgaactaaatgtctttcttaagccccaar

SEQ ID NO: 9367 - DNA, 182 bp, Homo sapiens
ttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttctttttt

SEQ ID NO: 9368 - DNA, 188 bp, Homo sapiens
  misc_feature 61: r=a or g
tagtattcatttctttgttgcatgtattccatatactttatcacatgtgttggttcatgtrcctaccaccatagtcaagacactgacttggtattctgttaccctgggatccctcctgttaccctttgtaaccataccaatttccatcccaccctgctctggccccctagtaatactttctggcagtc

SEQ ID NO: 9369 - DNA, 215 bp, Homo sapiens
ttcctatcccaagttgtattactagttttggggagtttgcagacaattgaatattctataggctgtgttgcagctttagatggatcgacctgtcatgtttttgaggttatccaggctgtatatctctggagagaagggaatggcaaagagtgggagtctgagtcaagtttggttttgtttttttaagagacaaggtctctgtaatccaggcctgc

SEQ ID NO: 9370 - DNA, 272 bp, Homo sapiens
  misc_feature 112: m=a or c
  misc_feature 116: r=a or g
acatgatattgacattcagtattttaacctttaaatgcttacattatttatcaagatgtggttattaccgttaagattaattgtctttggtgtcctaggacagcattctgcmaaartaatacctgtaagccaatcctgcccaccacttgtttttgtaaataaaactggaacacagccacacttgtttgtttacatactgtctgtggctgctttggggataaaacagtatagttgagtagttgcaacaacaactgcctggcctgcgaagtcca

SEQ ID NO: 9371 - DNA, 254 bp, Homo sapiens
  misc_feature 70: k=g or t
ccagtgtctcgttttcccagcatctttcactgacctgaccgcaagctctttagctggagccaggagtttkgtagcgcgtggggactttgtgtgtgatggatccaggaacccctcggccagagccagcaccctccttgtcaccttcctccactaaaaattgaaatgtgcctcccttcccccatccagaggtacttgggaggagtacgctgtgtgtgcgcaaggaaagagctgagcgtgctctttataccccagat

SEQ ID NO: 9372 - DNA, 290 bp, Homo sapiens
  misc_feature 142: r=a or g
  misc_feature 159: s=g or c
  misc_feature 187: y=c or t
  misc_feature 192: m=a or c
  misc_feature 195: m=a or c
  misc_feature 198: y=c or t
  misc_feature 203: m=a or c
aggaggattgaggctgtcgcagctgtcagcactatcactgctggagatctcatcatctgagttggaaactgatgagcccacatccacatcatcaaacttcctcttgagacccgagcccgtgaatgcatccattggtttcaarggggtttccttggggascccaccaagttggccccaaagcccctaytcacmacmagytagcmaggtacattaggattctgcccagggaaaaaaaggaatcagcattcctgtccccagacagactcctccccagtctatacacacagcta

SEQ ID NO: 9373 - DNA, 293 bp, Homo sapiens
tccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacca

SEQ ID NO: 9374 - DNA, 208 bp, Homo sapiens
  misc_feature 19: s=g or c
attgttccgcgccgatggsgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccggcgaggc

SEQ ID NO: 9375 - DNA, 201 bp, Homo sapiens
  misc_feature 15: k=g or t
tccaaaaatcttcakgactcctattcaaagagcactgctgagccatcatatattttcctattcaatttctcatcagccttactgattttttcctacttagcttctctctcctcagattttctatctcttctcctctttctcactcttagataatgatctttctcttttcactgagcaaaaagcaataaccagaaggctcaa

SEQ ID NO: 9376 - DNA, 206 bp, Homo sapiens
cctcgtcaaatgcatgctgcaggagcttcatttctggcttacgggtcttggcatgatgtgccatggcctttgtgatctgtcccctgcctgtccgtacacacctctctctgtaggcgcagttcctcctactcactgtgctttctctctcctgtgcccttggagaggctgttctcttagactggacaccggttacctgtgataccccc

SEQ ID NO: 9377 - DNA, 159 bp, Homo sapiens
gacttggaaatgtgaacgcaagaagcaggcttgatttttttttctccccccttctctctctctctctctctctctcttcctctctccctctttctcctctctcacccacactcacgcacacctccaaaccgcacacccagacgcacacgcattcccagc

SEQ ID NO: 9378 - DNA, 264 bp, Homo sapiens
taacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggacc

SEQ ID NO: 9379 - DNA, 219 bp, Homo sapiens
atatcaatgagattgcaaataaccaaacaaaataatgctatgatttccaaagccttcagaagggctacttttcttagacctaacgtaaaaccaattactttaggtggatgttgttttgcagccagttgcaattcaagtaggaaaaggatgtgctaaggctctttcttccctaaatggtgtcagaatttcactttcatcaatcaatcttctagcccacaa

SEQ ID NO: 9380 - DNA, 209 bp, Homo sapiens
taatatcaaacagaataaagtaaaccccctgaggcaagtaaacacattctctgcctgttctctctttcactgtagaatgatgaatgctcagccatctgcatgtgctttgttctttgttacttcctttagtctaactcagtggttcttatgtaaataacaattcgtatatggccttagatctataaaagtatgtattgtactttgtaaaa

SEQ ID NO: 9381 - DNA, 174 bp, Homo sapiens
  misc_feature 28: m=a or c
  misc_feature 116: m=a or c
  misc_feature 121: r=a or g
  misc_feature 160: m=a or c
  misc_feature 163: m=a or c
acggactctctcttccagcccagcgtgmcccccactctcgctccattcggcgggagcacccagtcctgtacgccaaggaactggtcctgggggcaccatgcgtttcggcggcagcmcccarcctcctcatccttctgttgctgctcctggggtctgtgcmtgmtaccgaagccc

SEQ ID NO: 9382 - DNA, 183 bp, Homo sapiens
tgttactaggcaataggagtttttgaactgcattataatcttatgagaccaccatcatatatacagtttgttgttgaccaaaacgttatatggtgtatgactattttatttcccaacaactgctgttctcttttttactctctactatccccacatcttaccacctttcccttacttgccagc

SEQ ID NO: 9383 - DNA, 188 bp, Homo sapiens
  misc_feature 165: y=c or t
attccatctcagttgctggtttcacaggcaggaccacccctgggcgcctctgtcccccggtcggggagtctgatcctgcctcccatgcagctgggtccccttcacactgtgtctacaccctttttcttctgttggggttttctcctcactggccattctctttcycactcctctaagtcctgccacct

SEQ ID NO: 9384 - DNA, 307 bp, Homo sapiens
  misc_feature 12: n=a, g, c or t
  misc_feature 13: n=a, g, c or t
  misc_feature 34: w=a or t
  misc_feature 35: n=a, g, c or t
  misc_feature 36: w=a or t
  misc_feature 37: n=a, g, c or t
  misc_feature 257: n=a, g, c or t
  misc_feature 258: k=g or t
tagggcaattannggctcatctcatttgtttccwnwnctctcaggggccacagccctgcattacctgtttgccaatgtgtgaaagcaattgtttcatgtattttgcccagttttctagtttcttatggcaggaagttaagtccaatgattgttattccatcatggctggaaaacgagggtctggaattgggattttcacataggacctttgcttttcctgtgacacatgcttcctctcagtacatatggatgaactnkctgactaggactacagtagcaatatcagtttatttttggacccacacag

SEQ ID NO: 9385 - DNA, 132 bp, Homo sapiens
actttgtgtgtttgtgtgcgtgtgtgtgtgtgtgtttagtagagacagaatttcaagaccagcctggccagcgtggtgaaaccctgtctctactaaaaatacaaaaattagccaggcacactggcaggctag

SEQ ID NO: 9386 - DNA, 502 bp, Homo sapiens
  misc_feature 11: b=c or g or t
  misc_feature 87: y=c or t
  misc_feature 88: y=c or t
  misc_feature 178: m=a or c
  misc_feature 179: m=a or c
  misc_feature 196: m=a or c
  misc_feature 197: m=a or c
  misc_feature 212: m=a or c
  misc_feature 213: m=a or c
  misc_feature 378: k=g or t
  misc_feature 392: k=g or t
  misc_feature 393: k=g or t
  misc_feature 464: w=a or t
tgctgggtctbcaacctcatatttagtagctctttagatatactataaatataagcagcacttacagggaaaagtggagaaaatgtyytattttgtcacaaaattcaaatcacactataatagtcatcaataaattgatgacccaactctgatggttgactgtttgttctccaagaammtagaaatgatcattttmmaaaatgttttgtttmmtgtcactgctgtttggggactcatttttgctaaactcttttctgaggtggatgcagaaaaggtaggggaacttcactgtattattcagctcagtcttgaaccaagagtgactttctgaggattgggaaacctcaactgttggttcatggcatgtgtttgattctktttatatatttttkktatttttatactttaagttctgggatacatgtgcagaatgtgtaggtttgttacattggtatacatgtgtwatggcgatttgttgcacttatcaacccgtcatctacat

SEQ ID NO: 9387 - DNA, 391 bp, Homo sapiens
taattcttggctgccttcccagtgtgggcagcatcttgcctaagctcaccacagaatacgtgtttgtccaaatgttacactacaagccatatagtgtggactgcttgcttttcattaatgggttctcagtcttcccattgtctctctttgtaggtattttcccccaggtcatggattgatgtctaactccaaatcaatttttaagcttaaatttcaacaaagaaagtgcttataaccacttgtcatcctcaattatccattgtgaggaggtggatgtaagatgacttctggaggccagtacttcctaatgattaagagcccacgctctagagtcaaaatgatgtaggcacaaatcctggcttccccacttattgtgtgatcttcagcaagt

SEQ ID NO: 9388 - DNA, 156 bp, Homo sapiens
  misc_feature 13: r=a or g
ctaaagaattatrgatgtttttctaaaagtaagggttggtttttttgggagggtggtttagacaacactctatgttttattactctttttagtggtggaatttttgttagtccttttgcaaattttgagaattttaacatctactttcccccccgc

SEQ ID NO: 9389 - DNA, 161 bp, Homo sapiens
ccatcagagattacttggcgttctatatcagggttgatacaactgtgtttccttatctgcttccaactgtgcacccttagtttgggacttatcctttcctgttacaagttgccccaggccacgaggacttctaaccatcatatcttactttccttgtccag

SEQ ID NO: 9390 - DNA, 351 bp, Homo sapiens
  misc_feature 284: y=c or t
ttggttttttttttgagatggagtctcgctctgtcgcccaggctggagtgcagtggcgcgatctcggctcactgcaagctctacctcccaggttcacgccattctcctgcctcagcctcccaagtagctgggcctacaggcacccgccaccacgcccggctaattttttgtatttgtagtagatacggtgtttcactgtgttagccaggatggtctcgatttcctgacctcgtgatctgcctgcctcggcctcccagagtgctgggattacaggcgtgagccaytgcacctggccggtatgattttttaaaatgaaaaaggaagtcaagagaaaggtgttcacacttcagc

SEQ ID NO: 9391 - DNA, 197 bp, Homo sapiens
taaatctcacaattagaattgcataattgattcacatcaataatagacctatatttgatgttcagctatgcttttactgactttcaaatggtttctgttttgcttaattggtttggatttgctctgtcaggttttttccccttatttccttagtgagaaagttgcagacctgctgttttatatgtctctgttttttt

SEQ ID NO: 9392 - DNA, 221 bp, Homo sapiens
  misc_feature 48: w=a or t
atgttcatttcaactgaaaataagtaaaaatcaaaaaatgtatttacwcacctctctctctgtccacgctcgtaattctgactgtgttgttgatgtttggactgtgtcctcggatgtcctcggatgtttcagaagcatctcaaacttaataattgctattcttctgttttttctctctgtaacactcttcctttagataatccccatgccttacccccaca

SEQ ID NO: 9393 - DNA, 351 bp, Homo sapiens
  misc_feature 337: k=g or t
atgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtktattgcatgtcagt

SEQ ID NO: 9394 - DNA, 132 bp, Homo sapiens
cccttgagtccaattcctcccctttcggaggaagccggtttctcctttctatgctactcccgggccatttctggacaacagctgctattttcacttgagccgaagttaatttctcagggagttctcaggcgc

SEQ ID NO: 9395 - DNA, 215 bp, Homo sapiens
cagtaatctcaaaagggcccgtttgcctcaactgaagaggctccagtctgaaccttggggcctgatagcgccctcggtgctggcagcctcgacgcgtcaggatgagacccatggtgccagcacagacaacgaggtcatcaagagcatcagtgatatatccttccctaaaagggggcccctctccagaaccaacagtatcgatagcaaagacctcc

SEQ ID NO: 9396 - DNA, 429 bp, Homo sapiens
  misc_feature 14: d=a or g or t
  misc_feature 15: w=a or t
  misc_feature 22: k=g or t
  misc_feature 245: r=a or g
aatcttttttcaadwtaattgkaaacatttcttctgagagggagtgactccatcaacgtatctcctttaataaaatccgagtggaaatgatgctgccaagaaatgccttggccctgcagccgctgatcttcagatgcatcgggcggcaactcatctgttactgcttcccagtttcagaacgcccagctccccaggccttaaaacaaattggaaagcaggggaataaaaaaacaaaaacaaaaacraaaaaaacaacaacaaccctcttcctgatttctggagagaaacaggcggcgggcagcagcctgggtgctgtgcgcaggagctccgcctgctggtgatgggtatcatcgcaggttgaggaaaataattcttcaaaaatcatgcaatcaaacagcctaatggaaaaaggaatttcttttacaaata

SEQ ID NO: 9397 - DNA, 442 bp, Homo sapiens
  misc_feature 111: r=a or g
  misc_feature 126: w=a or t
  misc_feature 374: k=g or t
cacttacagaaggcaagagtaaacacgaatatagggaaagcagaataattcaacaaaacagaatgcacaccggaaagtaatggaactatttgtgatcagttagtaactaarggggtgttttctgtwagatgccaggaggtttaagatgatgaggaatgtttcggaaaataagcaacaagtatttgagcatttactgtgccaagcatttcatgttggtgcgggggatgaagtagtgactaagacagagtccctgcttttgtggagctcgttttgtaatggagagagatacacagtaaacatctgaacaaatagagttggggaagatgcagtttttgctgggaagatcagggatagtctttccatgggagtgcttktttttctatttcatttggtttatttcaaatgagcaaatacatctgtggggtagtctggtttatagagc

SEQ ID NO: 9398 - DNA, 410 bp, Homo sapiens
  misc_feature 61: k=g or t
  misc_feature 82: w=a or t
  misc_feature 117: w=a or t
  misc_feature 153: d=a or g or t
  misc_feature 206: k=g or t
  misc_feature 350: w=a or t
  misc_feature 369: k=g or t
  misc_feature 375: y=c or t
aatatttttaaatattaagatttttttgttttttttttgaatttttacttcaatagctttkggggtacaagtggtttctgtwacacgatgaattatgtagtagtaaattctgagacwgtagtccacccatcagtgtatgttttagagtatgtdgcattcaatatgtagttttttggttttgttttttgtgacggtctcactctgtkgcccaggctggagtgcagtggcaagatctcgtctcactgcaacctctgtatcctgggttcgggtgcttctcctgcctcagcctccctagtaggtggaattgcaggcgcgtaccaccgtgcccggctaatttttgtatttttggwagagatgaggttttgccakgttggycaggctggtctcgaacttctgagctcaagcgatct

SEQ ID NO: 9399 - DNA, 165 bp, Homo sapiens
caagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccctc

SEQ ID NO: 9400 - DNA, 134 bp, Homo sapiens
tacatgattggtgtaggtacggtggtggatcttttttgcatgcctttgttgctattctgtcatctgggttggacttcttaagcctacttgcaccatttgaaacatttttcaacttactttctttcttttttttt

SEQ ID NO: 9401 - DNA, 288 bp, Homo sapiens
ctgtaatcccagcactttgggaggccaagatgggtggatcacctgagcccaggaatttgagaccagcctgggcaacgtggcgagacccaatctctgcaggaaatacaagaattagccgggcatggtggtgcttgtctgtggtcccagctactttggggactgaggtgggaggataacttgacccctggaggtcgaggctgcagtgagctgtgattgtgccactacaccacagcctaggtgacagagcaagaccctgtgtcaaagaaaaaaaagccatgtcagaccgtg

SEQ ID NO: 9402 - DNA, 298 bp, Homo sapiens
agttcagttcactcaagaaacaaaggggttcaatatggatggactgcagatctccagatggaagcggggcatggccaggccagcatcctatggctctactttgagacgggtacctgggtgtatcctgtgtttgccaaactcagcctcttgggtctagcagctttcttctctctcagctacgtcttcatcgccagcatctacctacttggagagaagctcaaccactggaaatggggtgacatgaggcagccacggaagaagaggaagtaattgcacaccattttccaagaaccaagaa

SEQ ID NO: 9403 - DNA, 288 bp, Homo sapiens
  misc_feature 153: k=g or t
  misc_feature 154: k=g or t
  misc_feature 190: k=g or t
  misc_feature 220: s=g or c
  misc_feature 262: r=a or g
  misc_feature 266: r=a or g
  misc_feature 267: w=a or t
ctgtaatcccagcactttgggaggccaagatgggtggatcacctgagcccaggaatttgagaccagcctgggcaacgtggcgagacccaatctctgcaggaaatacaagaattagccgggcatggtggtgcttgtctgtggtcccagctactkkggggactgaggtgggaggataacttgacccctggakgtcgaggctgcagtgagctgtgattgtgcsactacaccacagcctaggtgacagagcaagaccctgtgtcaragarwaaaaagccatgtcagaccgtg

SEQ ID NO: 9404 - DNA, 434 bp, Homo sapiens
  misc_feature 392: r=a or g
ctctttaaaggtaggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccacgtaagtrattatgccccgcagtaaaatagtaattaagaatccactcaca

SEQ ID NO: 9405 - DNA, 345 bp, Homo sapiens
  misc_feature 111: r=a or g
  misc_feature 297: k=g or t
tttttttagtggagatggggtttcaccttgttggccaggctggtctcgaactcctggccttaggtgatgcacccgcctcggcctcccagggtgctgggattacaggtgtgrgccaccatgcctggccctcttcctgggtgatttctttcctgtcagtctttaaggacatctcccttacgtacataaactcttctatccccttgagtatactcttctcattttcttatattatttaacagttaccactaatcagtccggtagagtagttcttaaccctgtcttctcttttcttctgtkcaacataattcagatttagataacatccttccccttttcagccaatca

SEQ ID NO: 9406 - DNA, 167 bp, Homo sapiens
caaaattagccaggcgtggtggctcatgcctgtaatctcagctactcaggaggctgaggcaggagaattgcttgaacctgggagcggaggttgtagtgagctgggatcgctccattgcactccagcctgggcaacaagagcgaaactccgtctcaaaaaaaaaaaaa

SEQ ID NO: 9407 - DNA, 388 bp, Homo sapiens
  misc_feature 29: s=g or c
  misc_feature 30: v=a or c or g
  misc_feature 47: k=g or t
  misc_feature 115: w=a or t
  misc_feature 154: b=c or g or t
  misc_feature 173: s=g or c
  misc_feature 373: s=g or c
cgccctttcaggaactgttactaggaggsvttatttcttcctctgtkacatattcatatctcttgtctgtactggattttttatgttgtgggtctcttcatatgcctttgctgtwtgttctgttgccaaggctagagtacggtggtggagtctbgacttgctgcagcttctgsctcctgggctcaagttattgtcccacctcagcctcctaagtagctgggactacagatgcacaccaccatgctgggctaatttttgtgtttttttgcagagacgaggctttgccttgttgcccagactggtctcgaactcctgagctcaagcgatcctcctgcgttgcactcccaaagtgcaggggttatagctgtgagcsaccacacccggctcc

SEQ ID NO: 9408 - DNA, 239 bp, Homo sapiens
  misc_feature 199: r=a or g
  misc_feature 207: v=a or c or g
aagtggccctggggccagctctgctccttgcatcccactccctgcttggacacaggctcacttgctgccttcttctgggaaaccagcttcttgccagccacagctgctactcccaccaccagccaccactcctgtcctgggaatcccttgtcccagacacccacctcattcagtggctcctctacaggaaaggtgagtragtgagtvgggctggcaggcccggcaaggttagggttcaa

SEQ ID NO: 9409 - DNA, 352 bp, Homo sapiens
  misc_feature 127: w=a or t
  misc_feature 139: v=a or c or g
  misc_feature 311: k=g or t
  misc_feature 326: k=g or t
  misc_feature 332: w=a or t
  misc_feature 335: k=g or t
  misc_feature 340: b=c or g or t
ctgtttgtggcatgatagctcattttcctttatcgctgaataacattctcttgtctggatgtactgcagcttgtctgtccattcacctattgaaaggcctcttggttgtttccagttttggcagttwaggaataaagcvgctctaaacattctcgtgtaggttcttatgtgcacataagttttcaccttgatttgtataaatgtcaaggaacccaattgctatgtcatatggtcacaatacgtttagttttgagaaattgccagatggtcctccatagtgcccatacctttttgtatttcttttttttttkaaattcataatcagkgttttwatkatttbcgatgatggctg

SEQ ID NO: 9410 - DNA, 299 bp, Homo sapiens
  misc_feature 24: w=a or t
  misc_feature 103: w=a or t
cctaatacccaatagatacttttwtttcttctctccctcctctcaccttccaccctcaagtaggccccagtgtctgttgttcccttctttgagttcatgagtwctatttacctccctcttataagtaagaacatgtggtatttggttttctgttcctgtgttagtttgctaaggataatggcctccagttccacccatgtttccacaaaagacatgaactcattcttttttatggctgcatagtattccattatgtatatatacaacattttccttatctagtctgtcaccgagaggcg

SEQ ID NO: 9411 - DNA, 250 bp, Homo sapiens
  misc_feature 8: k=g or t
  misc_feature 65: m=a or c
  misc_feature 66: v=a or c or g
  misc_feature 67: s=g or c
catttgtktttctcctagttgccctgatcagagctgggatggtggggaggggaagaaagggctamvsagagaaaggccaggcttttgaagacattgtatacagacttagtcagctggacacttctctgctgggctgctgtcaagtccttcctgtcctattcctctcacaaccatgtcctctctcctccccttccagtcctggggcgggtgctggaggtgacagatctccctgagggcatcacccgtacac

SEQ ID NO: 9412 - DNA, 148 bp, Homo sapiens
gttctcttgcctcagcctcccaagtagctgggactacaggcgcacaccgccacgcctggctaattttttgtattttagtagaaacggggtttcaccctgttgcccaggctgatctcgaactcctgagttcaggcactccacccgccgt

SEQ ID NO: 9413 - DNA, 354 bp, Homo sapiens
  misc_feature 30: s=g or c
catttttatattatattattagtatttttsttattgatttgtaactgctttttatatactaaagaaagcatgggctgggtgcggtggcttacgcctgtaatcccagcactttgggaggccttggcgggcggatcacgaggtcaggagaccaagaccatcctggttaacatggtgaaaccctgtctctactaaaaatacaaaaaattagccgggtgtggtggagggcgcctatagtcccagctactcgggaggctgaggcaggagaatggcgtgaacccgggaggtggagcttgcagtgagccgagattgcgccactgcattctggcctgggcaaaagagcgatactctgtctca

SEQ ID NO: 9414 - DNA, 476 bp, Homo sapiens
  misc_feature 42: k=g or t
  misc_feature 80: k=g or t
ttataccagtatgggctcatgaatatttactttatatttttkattataattcaatcatccaatatattatttcttttgtkgttcaaatttttccatctttggccattggcagccctttcacgttggcatctgtgtccgttggacaatcccccatccttttgtttttttgaaaatttccttactttttgatatcatgagatactccaggctcatcttgtcttctctctgatccaccctagaatcagccatggttcccctcattggagaatgatatttagaaacagaaacctgggtgctgggtgtgctcagtgggacgagggtgtcaccgcctccagccctgtcagtgaagagagctgcgtaatgtgcgtgcagataataccctatgtgtgaacacatacttcagattatctctggatctgtccatccttatatcgatgcaaagcttaaacatgagttcacactgatgtctctgattc

SEQ ID NO: 9415 - DNA, 347 bp, Homo sapiens
  misc_feature 101: r=a or g
  misc_feature 331: k=g or t
  misc_feature 345: n=a, g, c or t
  misc_feature 346: w=a or t
  misc_feature 347: y=c or t
ttgtatatttgaggcatttaaaaatctattttcgttacgagggcaaatgaagaatgaatattgatcttaaaaaaagaaaagaagacaaaaaaaatacccaragccatccgtgtctctgctgtatgtcattaacttttgccttcaatgtcaagtttatggggtggtaggtttgatgcccagccaagccctttcccaggggacctgttgggtgctctgcctgcctccctctggtggcttctgtttctccagttttccccctttgcctatctcagaaccataaatctttcaactgcggagggccttgaggtggggctgcctagccaagtccctkttgactgaggccanwy

SEQ ID NO: 9416 - DNA, 425 bp, Homo sapiens
  misc_feature 21: r=a or g
  misc_feature 111: w=a or t
  misc_feature 338: w=a or t
cgttaagaacacaaatctgarcattaagtttatcttcagtgaacactattgcatatggtaattataatttccagataaaaagttgactgtcatttgccccaaacttatgawacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgtwgaagtaccactgacacttagtaagcctagcctttaaccatctttgcagttagtcctaaaaattaccagatgcacattcagaagctct

SEQ ID NO: 9417 - DNA, 170 bp, Homo sapiens
  misc_feature 22: s=g or c
cagcttgaaagggtttgcgtascggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccat

SEQ ID NO: 9418 - DNA, 258 bp, Homo sapiens
  misc_feature 132: w=a or t
  misc_feature 137: w=a or t
cttgtagattctagatattagccctttgtcagatggatagattgcaaaaattttctttctgtaggttgcctgttcattctgatgatagtttcttttgctgtgcagaagctctttagtttaattagattccawtttgwcagttttggcttttgttgccattgcttttggtgttttagtcatgaagtctttgcccatgcctatgtcctgaatggtattgcctaggttttcttctaggctttttatggttttaggtcggcg

SEQ ID NO: 9419 - DNA, 158 bp, Homo sapiens
  misc_feature 7: b=c or g or t
  misc_feature 8: s=g or c
cccctcbstgtcttctctgcagtgggagcagctctcctgccacagctcctcaccccctgaaaatgttcgcctgctccaagtttgtctccactccctccttgagtttcgctcttgttgcccaggctgcaatggcgcgatccaccacaacctccgcctcc

SEQ ID NO: 9420 - DNA, 172 bp, Homo sapiens
  misc_feature 9: d=a or g or t
  misc_feature 10: w=a or t
  misc_feature 12: y=c or t
  misc_feature 35: r=a or g
gtctccacdwaycccaaacccacccatacctccarttcactaccaagagaaaggctcccactcattcagcctgacccctcatctcaccttgctcagcccctgccacctctcagagctctgaacttttttgtgcttggttgctgtcaaatacaggagtctggagaaccccaca

SEQ ID NO: 9421 - DNA, 163 bp, Homo sapiens
attaggaactgttgtgctgaaaatgtctgtctttagaaatgttagcttacaggtgtgtcactgtctgctgcccagacttgtagcaagcaagcagaggattcccttcctatttccttgttctaataagttggtacccatcggagagcaatgaaagatcagacga

SEQ ID NO: 9422 - DNA, 177 bp, Homo sapiens
  misc_feature 7: v=a or c or g
  misc_feature 8: s=g or c
cctcttvsccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccc

SEQ ID NO: 9423 - DNA, 190 bp, Homo sapiens
  misc_feature 29: k=g or t
  misc_feature 30: w=a or t
  misc_feature 80: r=a or g
  misc_feature 114: r=a or g
  misc_feature 125: r=a or g
  misc_feature 131: k=g or t
tgcaactaagtggtcaattttggaatackwgtggtgtggtgctgaaaagaatgtatattctgttgatttggggtagagarttctgtagatgtctattaggtctgcttggtgcaragctgagttcrgttcckggatatccttgttaactttctgtctcattgatctgtctaatgttgacagtggggtggct

SEQ ID NO: 9424 - DNA, 200 bp, Homo sapiens
  misc_feature 118: r=a or g
  misc_feature 119: m=a or c
  misc_feature 134: r=a or g
gttcctttttgtaaatatgtgacattcctgattgatttgggtttttttgttgttgttgttttgttttgttttgtttttttgggatggggtctcgctcttgtcgcccaggctggaagtrmagtggcgccgtctcrgctcgctgcaacctctgcctcctgggttcacgtgatcctcctgagtagctgggattacaggcgcct

SEQ ID NO: 9425 - DNA, 167 bp, Homo sapiens
  misc_feature 56: k=g or t
  misc_feature 57: r=a or g
  misc_feature 122: s=g or c
  misc_feature 123: r=a or g
  misc_feature 157: k=g or t
gctatccttccactctacataattcagataatgtttatttatttatttatttattkrtttcttagacagagtcccgctctgtcgccaggctggaatgcagtggcgccatcttggctcactgsracctccgcctcccgggttcgggcagttctcctgkctccgcgctc

SEQ ID NO: 9426 - DNA, 278 bp, Homo sapiens
tagctgggattacaggcatgcaccaccacacctggctaatttttgcatttttaatagatactgggttttgccatgttggccaagctggtcttgaactcctgaccttaagtgatccaccctcctcggcctcccaaagtgctggtagaggtgtgagtcactgtgcccagctctacttgcacatttgtgctcatctttgggcagccggtagtgtactttggttaagtggtcaccatataagtcccatctcccctctaccacctgctcccccttgaccccca

SEQ ID NO: 9427 - DNA, 169 bp, Homo sapiens
  misc_feature 8: v=a or c or g
  misc_feature 9: n=a, g, c or t
  misc_feature 10: y=c or t
actagccvnygtcagcctctcggcgggaggaggcggcggcggaggaggagcagggggagggctgtcaaattcgggagccagattttttcccttctcctggcaatcccttccgcttccccggctcccggcgtgacatctgcgggccggggacctgcatgtgtgtgcgcgc

SEQ ID NO: 9428 - DNA, 183 bp, Homo sapiens
  misc_feature 70: r=a or g
caaatatgtatttgctgttaaatttcgccttttatctattcctgtcctttgcctacattttctattggarttggtatttttcttattgatttctacactaaagacattactctcttgtctgccacattttgcagatattttccttaacacatcattttcttcttcagttttttcgcagcctgg

SEQ ID NO: 9429 - DNA, 176 bp, Homo sapiens
  misc_feature 128: r=a or g
  misc_feature 136: r=a or g
  misc_feature 149: w=a or t
caaaagtgccttttgtttttttaaacctgtctctctcttttcctctctttcccaaaatactgttttgcagtcagtctgtgaaaaccagtgtgagtcgcagaagcagcttctcgtgtgcagcctttccratctgtargcttggtctgtawtatgtgctgtatttttagaatgccgcc

SEQ ID NO: 9430 - DNA, 207 bp, Homo sapiens
  misc_feature 105: r=a or g
agacctttgttactcggtggttactgggtcctgtgcctgtccgttttggggcatgcagccctctatcatttttggctccgagaagagggcaaggggcccccgcargtacttctgtgcttgccctcgccctgccagcaggcagctgtgcccctggcctgcccttcccgggaccccttattccaactcagctcctctttgcactggaat

SEQ ID NO: 9431 - DNA, 239 bp, Homo sapiens
  misc_feature 7: s=g or c
  misc_feature 8: v=a or c or g
  misc_feature 15: r=a or g
  misc_feature 39: v=a or c or g
  misc_feature 73: b=c or g or t
  misc_feature 124: m=a or c
acactasvtttagcrtttcatggatgacttgtgtttgavcaagtgttactgtgatggttgccagatgattatbtttcttattctcttctttgttctacatggtgaaataaaaccaataaataamggtgaaggcaaagctcatgattctggtgctccaattccctgagattaggccagtggtagacatttcaagctgactttatgtctttttgatttgtccccgttactctgtcagcact

SEQ ID NO: 9432 - DNA, 436 bp, Homo sapiens
  misc_feature 288: r=a or g
ttatttcaagtggatgcttttgtgcccatatttaagctgccgttgcttacaagacctgtactgcccttccccacctgccttttccatcataccctatgctcacagacaaatctcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaratagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaaca

SEQ ID NO: 9433 - DNA, 181 bp, Homo sapiens
  misc_feature 139: y=c or t
aaaccctgagccgcaacaaacatgcctctgtgtgtcgggattgcctttgtctctgcttccatgtggcttttccttttgtagctatgcttagtgacataatcttccctcttctagccttctcctttcaagcctgtctgtyaattaaccatgtcagtattggcaagcatttatcttcccccac

SEQ ID NO: 9434 - DNA, 241 bp, Homo sapiens
catatttctggaggtgggatggagtgttctgcctttaactttgctgttctccactgcctctgaagtcctgtggcttgtgagcctctataaacacatctgctgtcattctttcccccatcgtggcatcttgctgcctctggctgtcctgtttgttgcaaggctcacaaggactttgctacctgggctttaagccacagagcacagggtcgtgggtacacctctaagaaggaaatgggaagaa

SEQ ID NO: 9435 - DNA, 224 bp, Homo sapiens
catatgttttgaccacagcacttgtaagaaatatgtttattctgaaacatatacatacataaatatgtgtaaattcatagctaaaagttttacgaaatacccttacagtgtgttacacatgctactttctattctagtccattctattctatttcaattttttaacagccagttgtgactgggtgcggaggctcaagcctgtaatcccggcactttgggaggcc

SEQ ID NO: 9436 - DNA, 322 bp, Homo sapiens
  misc_feature 247: r=a or g
  misc_feature 248: s=g or c
gtgtgttttgtttttttgtgtgtgtgtttttgtttttttttgagacggagctttgctctttcacccaggctggagtgccttggtgcaatctcagttcactgcaactacaacatcccaggttcgggagagtctcccgcctcagcctcacgagtagctgggatttcaggtgcctgccaccatgcctggctaattaagtcagtttcttaaagtcctacaactggtgagctgtgagctgtaaattgcggarstaatttttatactgccaatctgaggccttttctgacctcatcgctgccactgtaaaatgagttctagcccgctg

SEQ ID NO: 9437 - DNA, 185 bp, Homo sapiens
ttcttgtcttctgctagctttggagttagtttgctcttgtttctctagtccctctatatgtgatgttagtttgttatctgagatcggatttttatgtggacctttagagcttgtaaatttccctcttaacactgctttagctgtgtcccatagaatctagtatgttgtatctttagtcccatagt

SEQ ID NO: 9438 - DNA, 339 bp, Homo sapiens
  misc_feature 153: b=c or g or t
  misc_feature 155: r=a or g
ttttgttgatcttttcaaaaaaccagctcctggattcattgattttttgaaagtttttttgtgtctctatctccttcagttctgctctgatcttagttatttcttgccttctctagcttttgaatttgtttgctcttgcttctttagttcttbarattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtc

SEQ ID NO: 9439 - DNA, 222 bp, Homo sapiens
ttaactgtgtgacctcgggcaagtcacttcgcctttctgaacctcagtttccccatctgtaaaaggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacac

SEQ ID NO: 9440 - DNA, 307 bp, Homo sapiens
  misc_feature 301: r=a or g
  misc_feature 303: n=a, g, c or t
aaaaaatagaggagggctgcccttcggtcaagactttaggtaagtattcaaattcgcattcttttaatttttttcctggtatcatttcctctccctctttggaatctgccacgacagcccccttctagaatcaccaagagaggagccaaagaatcagcatggttagagttttagagtccagtccaatttctggtaggctgaatctgtaccaaaacgtagggactgcatttttctgttccacgcaatgcctaggacacactaaactgtcaaggaagattaacctgcccattaggtgaatatranttta

SEQ ID NO: 9441 - DNA, 163 bp, Homo sapiens
cttttctggtcgatactatattttcccagaccctgaggatgttgatttcagagacagggtttttgctctgttgcccaggctggagtgcagtggcatgatcatggctcactgcagtcttgaactcctgggctcaagcgatcctcccacctcagcctcccctttg

SEQ ID NO: 9442 - DNA, 469 bp, Homo sapiens
agtgctgtagctaagttcactttcagcccggcgcagaagttttccctgagatatggtgttagtttcttttctttctgtctcctctgccgttgccagcatgcaaggatctcgtggctcctgtccgtgaatcgtaaactgaaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttgggcgaagtttcttgggctatgccagttttaaagtgggagagctgctgaagtcaaaggagcaattgctggtcctgagcctgagatat

SEQ ID NO: 9443 - DNA, 275 bp, Homo sapiens
  misc_feature 134: y=c or t
  misc_feature 137: k=g or t
  misc_feature 145: m=a or c
atttgttttctttttctgataatattcagaaacctctgaatcttttctactttattttgcttggcaggttgttctctgacctctctttttctacctcacagttacaagaagtgaaacagtggatattaacattycakaattgcamcttaaaatcagcatatactactttgctgctgtaattttcatgatactatttatcagatttttatatatctttaattttactttctagctcagagattcttaacctgggatccacatagtttgcccaaaag

SEQ ID NO: 9444 - DNA, 356 bp, Homo sapiens
  misc_feature 11: s=g or c
  misc_feature 234: m=a or c
  misc_feature 244: m=a or c
  misc_feature 247: y=c or t
  misc_feature 258: h=a or c or t
  misc_feature 271: h=a or c or t
  misc_feature 273: w=a or t
  misc_feature 276: s=g or c
  misc_feature 285: y=c or t
  misc_feature 290: n=a, g, c or t
  misc_feature 291: n=a, g, c or t
  misc_feature 295: v=a or c or g
  misc_feature 299: b=c or g or t
  misc_feature 307: k=g or t
  misc_feature 324: k=g or t
  misc_feature 325: s=g or c
  misc_feature 337: s=g or c
aactgcttgtscaggccacgcatcctggcctttccggatgtggtcagccttgtgcagcactatgtggcctcctgcactgctgatacccgaagcgacagccccgatcctgctcccaccccggccctgcctatgcctaaggaggatgcgcctagtgacccagcactgcctgctcctccaccagccactgctgtacacctaaaactggtgcagccctttgtacgcagaagcagtgcmcgcagcctgmaayacctgtgccghcttgtcatcaachgwctsgtggccgaygtganncgcvtgcbactgccckggcgcatggccgactakstccgacagtacsccttccagctctgactgta

SEQ ID NO: 9445 - DNA, 269 bp, Homo sapiens
atttcagcgatgcgcttgtcaacgcactggaatcccttacttcactctcctgggggattgggcggcccacccatgcctgtccctggacttctgagttctgccagagaaagttacacagttgcctctctatgatcctgatctctgcctcaccagggcctcaacactgcctggaaatcagattttcctcatcaaccctcttcctctccataatgacttttccaacctcctccacacttcttaaatctctaggttcatactgagcccatccc

SEQ ID NO: 9446 - DNA, 284 bp, Homo sapiens
tattttgaatccatgatccattttcagttaatttttgtacaagatgtgcaacttaggtccgtgttttgtttttgtttgtttttgttttcctatcagtatccaattgtttcaataccatttgttgaaaaaaaagaaaacaacaacaaagaaaaaaaacagctattctttctgaattgaattacttctgcacatttgttaaaagtcagttgggtctatttgagtgggtctatttctaggttccctgttctgtttcattaatctatgtgtctctccttcagccaatg

SEQ ID NO: 9447 - DNA, 419 bp, Homo sapiens
  misc_feature 107: s=g or c
  misc_feature 392: r=a or g
tcagtagaagcagagtttcaccatattggccaggttggtctcgaactcctgacctcaagtgatctgcctgcctcagcctcccaaagtgctgggattacacgcgtgasccaccacacccagcctccatctttaaacttttaaatgtgaaatttctatcatgtaccgttagcctaacaagattttctttcctatttctgactggtgcctttcccctttttaggagcaacgaaagctactctcttagttatgttcttgtgatgtgacaaaatgtcaagaagataggagaagagacatattttatttcgttgatgcttttgttcccaagtgtgaccctaaacttaagctttgtaggagttgacattctttcatgtccttccctttactcatgccgraactatcaactgggacattttgtgctt

SEQ ID NO: 9448 - DNA, 183 bp, Homo sapiens
ccacccagttccagcttcccggctgctttgtttacctaatcaagcctgggcaatggcgggctcccctcccccagcctcgctgctgccttgcagtttgatctcagactgctgtgctagcaatcagcgagactccgtgggcgtaggaccctccgagccaggtgtgggatatagtctcgggtgcgc

SEQ ID NO: 9449 - DNA, 394 bp, Homo sapiens
actttttcaactgaaagaggagtaggtaaatgccagtaagctgcaggttttctgtccctgcatagaatgattagcagagagtgtgatggttccagagaaaacatacaaaagctaaattaggaggtgggagacagtcacagaaatgttccagatctcactagctctcgtggtctgtttccagtaatggtccaatatttcttgtcctttttgtttcctcatggcagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggtatgaaatcatccttatccattttccatccagggct

SEQ ID NO: 9450 - DNA, 163 bp, Homo sapiens
cgaaaaactaatatttgtgcatgctgtgaacagtgtatccagcttcattcttctgcatgtaacacccagttactctagcatatgtgttgaaaagactgtttatcccattgaattgtcttggcactcttgtcaaaaatcagttaaccataaatgtaaaggccgt

SEQ ID NO: 9451 - DNA, 311 bp, Homo sapiens
  misc_feature 151: k=g or t
  misc_feature 219: k=g or t
  misc_feature 277: s=g or c
  misc_feature 305: y=c or t
ctctgtttctcttcagccctctctgtctctctttgtctctgtctttctctgcctttctaactctctttctctgtctctctgtctctatctcagtctctcttcttatctctgtctctatctctctctgtctctcactctctgtatctgtctktctcttatctctattgctctgtctctatctctgtctctctcatctctatctctgtctctatctctctktctgtctctctgtatctctcaacctctgcctcctgggttcaagcgattctcgtgcctsagcctcccgagtagctggaattacaggyatgtgc

SEQ ID NO: 9452 - DNA, 333 bp, Homo sapiens
  misc_feature 32: b=c or g or t
  misc_feature 109: w=a or t
  misc_feature 117: k=g or t
  misc_feature 142: m=a or c
  misc_feature 310: y=c or t
tgtgtgtgtgtgtgtgtgtgtgtgtgtgtgtbcctcatccctacttaaatccagtggtcaaaggaaaccttcatcttctcttctccaggctgaacaaccccatttcttwcagttttkcatcaaaagtccttaagagagtgamaatgccagtgagtctgcagaagactcactgttactttatactaatcatgggaagaaccagggcccaggtggggtggtttgtgttctctaagggtccttagcaagaatggaggacatgtttgagctgcaggcaaaacggaatcagtgagtgctacagctgagcacaggyatggttttaataaatatgcgctg

SEQ ID NO: 9453 - DNA, 324 bp, Homo sapiens
gaaaattttcacaggtctcaatttttctaagttcatgtaattaccacagacacatttcccagtcctttattcctgtccaccaaggatgtgactttattggagagagagggaagacatgcaaatgctgtatctgttctgtcggccgtgctcctcccattagcctaagcacagccatgcattttggcccgttcccactgctcacataccctgcatttctaacttgtcagttctgccacaccatctggggtaggcagttccttctccttcttcactactaccagtgcgcacgcacacacgcacgcatgcacacacacacacacaccc

SEQ ID NO: 9454 - DNA, 314 bp, Homo sapiens
attatgaaacatacaacccccccttaccattgttctcttttttgttgttttcttttgtttcgtcttgacccaccagttagtagctgtcagaagcaggacgcaacccagagctgccccgacttgcacagtgtccctgcatcacactagctcttgcctgtacaatctctgccgctactcccagtagctcctagtaactcctggcacacatttctgaaatgtcatttaggggctcaggaattttcagccactaagagaggaaagctagctaacattgataggaatcaaaacttgcatgttttaactaagggaaccca

SEQ ID NO: 9455 - DNA, 423 bp, Homo sapiens
  misc_feature 180: k=g or t
  misc_feature 181: h=a or c or t
  misc_feature 298: n=a, g, c or t
  misc_feature 299: k=g or t
  misc_feature 355: r=a or g
  misc_feature 356: n=a, g, c or t
  misc_feature 357: k=g or t
ttctttcaatggtaacatcttgcttaactatagtacaatatcatcacaggatattgacattgatatagtcaagctacagaacatttctgttaccacaggatatctcatgttgtccttttatagccacgtgtactttacccccacccatccctcctcattattattattattattattttkhgagacgcaccattgcactcgctcccaggctggagtgcaatggtgcgaccttggctcactgcacgctctgcctcccgggttcacaccattctcctgcctcagcctcccaagtagctgnkactacaggcgcctggaccacgcccggctaatattttgtatttttagtagagacagrnktttcaccgtgttagccaggatggtcttgatctcctgaccttgtgatccacccgcctcggcctcccg

SEQ ID NO: 9456 - DNA, 221 bp, Homo sapiens
atgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgaccccc

SEQ ID NO: 9457 - DNA, 297 bp, Homo sapiens
catgcttgttgtaacgtgtcaaacaatacagaggtgtagggaaaatacctagtgccaccctccactccaaaaccccatgtcgccagagataaccatttattcagacagtgagtatctattaagtatctattgctaggctttggagatagcataatgaacaaaatggatgtgctctctgcccttgtgatttggacagatgcttcagttatctttttctgtgtttatattgattatgtttgtatgtatgtgcgtgtgtgtgtgtgtgtgtgtgtatcgactgttttcttcctcctcccc

SEQ ID NO: 9458 - DNA, 221 bp, Homo sapiens
  misc_feature 97: k=g or t
  misc_feature 98: r=a or g
  misc_feature 113: k=g or t
aagacttttttccccttattaaaaacgattgggtaggggatatgtgggtcatgggcttgcttcttctatctcagtttgcagtgagtgttcattccakrgtgccttctgtgttkgttgatgccagcgatacagtggcagacaaagtcatggagcttacattctagccaagaggaacagtcagtaaacaaaatagtaaatacacaaattaaattcaggcaaat

SEQ ID NO: 9459 - DNA, 232 bp, Homo sapiens
acctttactccagttctcaataagttcctcatctccatctgagaccaccttagcctggacttcattgtccatatcactatcagcattttggtcacaacaatttaacaagtctctaggaggttccaaatctttcctcatcttcgtgtcttcttctgagccctccaaaacaatttaacaagtctctaggaagctctaaacctttccttatcttcctgtcttcttctgagcccta

SEQ ID NO: 9460 - DNA, 440 bp, Homo sapiens
  misc_feature 120: b=c or g or t
tttaaactttttatatttttaggatttaggatagcaactctgctatatactgcaaatatacatatacacacaaatatatatacacatgtatacatacacacacaaacacacacgtatgtbtgggtttttttaaatgttttttgagacacggtcttgctctatcacccaggatagagggcagtggtgcagtcatggttcactgaggcctctacttcctgggctgaagtgattatcccgcctcagcctcctgtgtaactgggattacaggcgttccccaccatgcctggcaattttttgtggagatggggttttaccatgttgcccagaatggtttcaaactcctgggctcaagcaatttacctgccttggcctccctaagtgctgggattacaggtatgagccactgggcctggcatgcaaatatttttcctggctcttca

SEQ ID NO: 9461 - DNA, 213 bp, Homo sapiens
  misc_feature 7: k=g or t
  misc_feature 10: w=a or t
tgctagktawacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcccttag

SEQ ID NO: 9462 - DNA, 414 bp, Homo sapiens
  misc_feature 387: y=c or t
  misc_feature 412: n=a, g, c or t
cagatataaatccccaccatgccccacaatatcctcaagatctgatccctgcccccacttgtcaactaccactctctcccatggtgctgctctgctgctccacattccaccaggtagatcttctttctgcttagtgaacagtcagctcatcctcacctcagggcctttgcacttgctcctcttctgcttcagacatcttcccagatctacatgtaactggtttctttctggcattcaggtcttagggcccaaagctcacttgtttagcaatgtcttccctgccttatcattttgcttcctccagtcattctttttctcattaacctgttttgtttttatattgccttttatcagtaaattaaagtactattattgtttacttatttytttactttcctactaaaacctcggncc

SEQ ID NO: 9463 - DNA, 144 bp, Homo sapiens
aagaagctgatgtggtttgcaggcagctgggatgtggatctgcactcaaaacatcttatcaagtgtactccaaaatccaggcaacaaacacatggctgtttctaagtagctgtaacggaaatgaaacttctctttgggactgca

SEQ ID NO: 9464 - DNA, 300 bp, Homo sapiens
  misc_feature 12: y=c or t
  misc_feature 19: w=a or t
  misc_feature 25: v=a or c or g
  misc_feature 26: y=c or t
  misc_feature 39: r=a or g
  misc_feature 162: k=g or t
  misc_feature 217: y=c or t
  misc_feature 218: y=c or t
atatatgtataygtctgtwccccavyccccacctttcarattctgctcttggcactcagctgtgggctgcacgtggagctgtcccgtgcggtagtagctgtgtctgtgtcccctcgtgaaatagtgtgcagtggaggtctcttgtggtgctagatgtgtgtktagagctaaaccagcccccacccccaccctccacctgcccctcttgcctctggcyyctctgaccctggcccagggacccctcacggggccaggggaggcatagcagaaagactggccccttcctagggttatgagctg

SEQ ID NO: 9465 - DNA, 307 bp, Homo sapiens
tgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatccgga

SEQ ID NO: 9466 - DNA, 370 bp, Homo sapiens
  misc_feature 87: k=g or t
  misc_feature 88: s=g or c
  misc_feature 333: m=a or c
  misc_feature 335: y=c or t
atcccttctctcttccttggtgcttctttttcctgctcggtgagtttgtttgtttgtttgtttttgagacagagtctcactttgctksccaggctggagtgcagtggtgcgatctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgacmaycgcgcccggcctgagtgagtcttaatccgtgggcc

SEQ ID NO: 9467 - DNA, 167 bp, Homo sapiens
  misc_feature 19: k=g or t
  misc_feature 20: k=g or t
  misc_feature 64: s=g or c
  misc_feature 166: b=c or g or t
  misc_feature 167: s=g or c
tccttgtctcttttttttkkctttttttgagacagagtcttgctctgtcacccaggctggagtscagtggccctatctcggctcactgcaagctccgcctcccgggttcacaccattctcctgcctcagcctccctagtagctgggactacaggcgcccgccccgbs

SEQ ID NO: 9468 - DNA, 379 bp, Homo sapiens
  misc_feature 121: y=c or t
  misc_feature 148: w=a or t
cttgtggtatttttgttaagactcttttcagtgttctttgaacgtaataaatcttgaatgagttcagagatctgttcaagttgcatattgactgtacttactatattagaatgcttgagtyttgagactctggctgtttctagttgtwtcttgaagtggtgttttccactatctttttttgatcccggcctgtactttccttaagcaggtggcatagactactttggtggtttataacttgaagtgccaaggaccagatcaagttagcactcatttgtaacacaggcactggaaatgtctttcaggctgtcactagtgagacgagtatccattatccagcctctgcatgtggtaggtggtgaaggtgagcgatggtaga

SEQ ID NO: 9469 - DNA, 374 bp, Homo sapiens
ttatggctgcatagtattccatggtgtatatgtgccacattttcttaatccagtctatcattgttggacatttgggttggttccaagtctttgctatcgtgaataatgccgcaataaacatacgtgtgcatgtgttacataataaattaattctaacagccccatctttaggatccttctgatcctttcttcaatactatacatcaagaaagtcctagcatctctacctcatttactgaaggccatcatcctgtataagcttaaagaatccatccaaacagattttcagaatcatcttgagatatttccaaagcattgaaatccaagtgatgaatgagctctcccttgctgaaaatgctccctacgcagcacag

SEQ ID NO: 9470 - DNA, 304 bp, Homo sapiens
  misc_feature 59: s=g or c
atctagaagtcaggttttctcttcttttggttcttctttttatatgctacctttttgcstctctgatttatggggaggctcttttagtaaacattatacaagatagtacaaggcaaaagaaaacaaggaccaagaagcagtgctttgagtaacttaggaaagcagcagtaggagctgccagactgaaaaggaaattccaacagagtgacatgtgctaaacgaggggcaaacaaaatttaagagcacacaggaggagcctaatccagtcactggagtttcagcacatgagaacaaaagtacgccg

SEQ ID NO: 9471 - DNA, 216 bp, Homo sapiens
tgattgaccacatctctccttatcctggtcaccttccctatctctcatccctcttcaaatatggtgttcagattcaaacatggggctccaggatggatgaatggggtgccagagtcacctataggctgaagaaatggtctgggctgggtggtttgagaagctttctggcacttcctgtctgtacttctctccagtgagtttttttttttttttttt

SEQ ID NO: 9472 - DNA, 237 bp, Homo sapiens
  misc_feature 116: s=g or c
aaaacgacccggtgggtctacagcggaagggagggagcgaaggtaggaggcagggcttgcctcactggccaccctcccaaccccaagagcccagccccatggtccccgccgccggsgcgctgctgtgggtcctgctgctgaatctgggtccccgggcggcgggggcccaaggcctgacccagactccgaccgaaatgcagcgggtcagtttacgctttgggggccccatgacccgca

SEQ ID NO: 9473 - DNA, 252 bp, Homo sapiens
  misc_feature 67: w=a or t
  misc_feature 77: w=a or t
cattattttaacagtgatatgttccagtcaatcattgccaagggattcgtggaaacatattgctgtwtttgttttgwtccctggtcatctggaccttcttagcttgcttgatatcaaggtgagaattgtcaaggttgtttgctgtctttggactttccatcctgtcactcctctgctatcatcagccctcgcctttcaaggtcagctgacatcccaaggctggtcagatcataatgtgtacatcccccgcgt

SEQ ID NO: 9474 - DNA, 471 bp, Homo sapiens
atagttgtgacagactcctggaacagcagctcttctcaaggctagttgtgacatccaaagtgacaagagcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagta

SEQ ID NO: 9475 - DNA, 158 bp, Homo sapiens
ttttccaaacattgtgatgcacctttatagctgttcgtgtatgcgccttttaaacgtggcatgctgcatacccttttcgagcagcctgtttccgcacattcttttcaagtcattaaactattccttgacgtcctttctcaaggctgtgcgtggccggt

SEQ ID NO: 9476 - DNA, 185 bp, Homo sapiens
aaaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacaggc

SEQ ID NO: 9477 - DNA, 258 bp, Homo sapiens
  misc_feature 19: y=c or t
aggaggggatacaggagtyggggggaacttcagagatgagagggagtgtgtcctgggacccctggggctggctttggggcagaggctaaggccaaggccctccccattaggcctctggagccagcacagttactgcatccccaaacagtgagcctcagctttgcctcttggaagttctgggataggacatccgggagtacccttcagcctggagctcggcagtgcctccctgactctatgcaagacccccgggacgac

SEQ ID NO: 9478 - DNA, 147 bp, Homo sapiens
  misc_feature 92: w=a or t
aacagcagtgcctggtcaaacccagcaacccttggccagaacttactcacccatcccactgacaccatgaagcctgtgctgcctctccagtwcctggtggtgttctgcctagcactgcagctggtgcctgggagtcccaagcagcta

SEQ ID NO: 9479 - DNA, 252 bp, Homo sapiens
  misc_feature 118: s=g or c
cacacaagggtcagggatggtggggtaaaagctctccccctgggaggcttctggaggctgtccccatgtgcttgcctagttccccactctgccctcctcctcttctctcagtctgctscctggaacacctgcctcagtttccatgctctctccagtgccctccccggtgaagcagggaaaagagcatgacatttggcatcagaaggctggatgtggaatcccatcctctcccaccactgcacactgggccac

SEQ ID NO: 9480 - DNA, 231 bp, Homo sapiens
cttactagtaataaaaataataattccaacaataataatatgctaccatttattacactcttgctgtgttccaggcctttaaaatgcattatctcatctgacttatgctacaactataagaaggaattatcacatcaaattccatagtaaaagcagctgaggtgagaaaataggatggttttcaataacaaagcaatgggcgccagggggtgttgagtaattggatgaaag

SEQ ID NO: 9481 - DNA, 339 bp, Homo sapiens
  misc_feature 12: r=a or g
  misc_feature 18: r=a or g
agttctagaggrcgggarttcacgatcaaggtgccagcagagttggtttcttgttaggcctttcctcctggctggtagatggccatcttctcactgtaccctcacaggacctttcctctttgtatgcacagggagagagaaagagagagagagagagagagactgatttggtttctcatcctcttcttataaggacatcagtcttattggattggtgccctactcttatgacctatttaattttaatcatctcctgtaaacatcctgactccaaatacagtcatattgtgggttagggcttcaagatatgaatttctgagcacgggagcaggcgacccg

SEQ ID NO: 9482 - DNA, 299 bp, Homo sapiens
atttctgtttgtttgttttttaacacacacatatgtgaacaaagagtatgcgtttgtactggcagaagaagcgtctggtaagacaaccagcaagttaacaatggtcacctccagaaatgggctgggtaaaccaaagaatttttttgtttttgttttttttgagtcagggtctagctctgtcacccaggctggaacgcactggtgtgatcacggctcactgcagccttgacctccctggctcaagcaatcctcccagctcagcctcctgagtcgttgggactacaggcacgtgccaccaa

SEQ ID NO: 9483 - DNA, 150 bp, Homo sapiens
tcgaaatggagtttcactcttgtcacccaggctggagtgcagtgatgcgatctcggctcactgcaagctccacctcctgggttcactccattctcctgcctcagcctcccaagtggctgggactgcaggcgcccaccaccatgcccggca

SEQ ID NO: 9484 - DNA, 394 bp, Homo sapiens
  misc_feature 20: y=c or t
  misc_feature 330: d=a or g or t
  misc_feature 331: n=a, g, c or t
  misc_feature 372: k=g or t
  misc_feature 373: r=a or g
  misc_feature 374: h=a or c or t
gatcggagtctgacgatggycagcaggtggcactctcgttttaggattccagctcctaagtcatcttcacaacaagatacagattctattatcctgctgataggctgtgggaaaactgctggtagagaggaagaagctggcaatgggcgtgccagctgatgatgagtggaacaaagtccacgaggagtgggaggtggaagctcggacggagcaggtggcaaggagaactcatccactgagacattaggaaagaagacatgcagtgctggaggtgaagcagccacatggtgaccaggaggcaacaagcatgaagacaaaagccacatgctdncaaagactgaatgaagagaaagagcctgttgggagcattckrhgtatacttgttagccctgtc

SEQ ID NO: 9485 - DNA, 346 bp, Homo sapiens
  misc_feature 10: r=a or g
  misc_feature 34: r=a or g
  misc_feature 43: d=a or g or t
  misc_feature 45: w=a or t
  misc_feature 120: w=a or t
  misc_feature 127: k=g or t
  misc_feature 338: m=a or c
ccttgacttraaaatctaaataaagaataacgarataaagcadawaaagtacacgaaaggaaatgctcatgagaagaagagtctattatatctacccctctgtgtatctactttgctgtwttatatktcttccctacattctaggattccttcttgcatttcctttttgtttccagaactttttaaattttaagttccagggtacatgtgcaggatatgcatgtttgttacacaggtaaacgtgtgccatggtggtttgctgcacctatcaaccctttacctaggtattaagcccagcattcattagctatttttcctgatgctctcccttgccctamcctcccct

SEQ ID NO: 9486 - DNA, 470 bp, Homo sapiens
  misc_feature 102: k=g or t
  misc_feature 110: d=a or g or t
  misc_feature 116: r=a or g
  misc_feature 262: n=a, g, c or t
  misc_feature 279: n=a, g, c or t
  misc_feature 280: k=g or t
  misc_feature 305: n=a, g, c or t
  misc_feature 306: d=a or g or t
  misc_feature 307: b=c or g or t
  misc_feature 407: m=a or c
  misc_feature 410: m=a or c
  misc_feature 412: v=a or c or g
  misc_feature 413: n=a, g, c or t
tctcattggcaaaaatgtgttgattgtaatggttcctgttttgattaatagaatatgttttagcgtagttacaatgatttaaaattcgcagtctggaaattkaatttttdcatcarcctaatatttctatggtaaatccttgcaaacatggaaacaatgcatttggcccagtgctttgtggttgtgtactctttttctttgtttttttaatagatggcattggccgggcatggtggctcatgcctgtaatcccagcattttnggagggtgaggtgggtnkatcacctgaggtcaggagttcaagndbagcctgactaacatggtaaaaccccatctctactaaaaatacaaaaaaattagctaggcggggtggcgggcatctaattccagctacttcatgaggctgmgamavnagaatcatttgaactcgggaggcagaggttgcagtgagccgagatcacaccattgca

SEQ ID NO: 9487 - DNA, 225 bp, Homo sapiens
caattgcgaatgaaagtgctacaggttgcaaacagttacatacaggttttttatgaatgcttgttttcatttctcttggagaaatgcctagggataaggattgctgggtcatatggtaagtgtatatttacttttgtaagaaactgccaaactgtttccaaagtgcctgtatcatttcgcgctcccaacagcaatgtctaagagttccagtagctacacaccctc

SEQ ID NO: 9488 - DNA, 304 bp, Homo sapiens
  misc_feature 198: b=c or g or t
aaacaagagtcttgggagcaagcgggggctgctggagggctggagccttttgtctatgcaaaagacagggagatggaggcgggagatcaaggactgcctgggttaggggagaatcacacctaaatccctgaagggggagaaaaaccatgtttccagggaagagagacggggtttctccatgttggtcaggctggtctbgaactcgctacctcaggtgatccgcctgcctgggcctcccaaagtgctgggattacaggccaccgcgcccggcctccaggctcctgaatcttttgttttcctgttt

SEQ ID NO: 9489 - DNA, 181 bp, Homo sapiens
ctacgaatgcagatgtggaaacaacttctgtgcatctcatcgttatgcagaaactcatggctgtacctatgattacaagagcgcagggaggagatacttgcacgaggcaaatcctgtggttaatgcaccaaagcttccaaaaatctaactcttcctctacatcttactgttctgcccaggg

SEQ ID NO: 9490 - DNA, 333 bp, Homo sapiens
  misc_feature 136: r=a or g
  misc_feature 137: s=g or c
  misc_feature 138: d=a or g or t
  misc_feature 139: h=a or c or t
  misc_feature 156: h=a or c or t
  misc_feature 157: m=a or c
  misc_feature 173: h=a or c or t
  misc_feature 215: w=a or t
  misc_feature 287: w=a or t
cattcttttctaatgaaagcattgatgggaatacattctctgagtattgcttttactacattttatgattttgaaatgtagcgttttcattattttttcattcttgggtttaaaaatatttataattttttccttrsdhtcatatgttatttagthmtacggttttaagttthgaaatgtatgacaattttatgtctttttcttattggctttgwtttcattgcattgtgatcagggaatgtagtctttctggtagtaattgttccattttctctaccatgtctttwaacctttctttcatattttgcatttctttgtgactataggctgcca

SEQ ID NO: 9491 - DNA, 459 bp, Homo sapiens
  misc_feature 330: b=c or g or t
  misc_feature 333: n=a, g, c or t
  misc_feature 334: k=g or t
  misc_feature 397: m=a or c
caaacaatagtgaaggcatagttatcttcatttttttcctatagataattatgcaggtgatgctttcttcctctttattatgatgtcttttctagcactgttgtccaaaattagattcagtatcttccctctcctcctgaaaattttctttctgtcactttatgtctggctatcaccactttctactgggtgttttgaaaaccagtggctggtgaaccatctgcaacaaaatcacctgaggcgctttgctaactagaatgtagattctgaggtcccatttcaggccaactgatttgcagtcacaggtacctgaattgctgccctcttgtbtankgtgcacatccagtcggccaccaaatcctgttgattctactcttgaaatgcctcttgaatccamtcatctttatttcccctgctctagttcaagccctcatcttttacctagaatacagcattagt

SEQ ID NO: 9492 - DNA, 199 bp, Homo sapiens
agtctttgttcattttttttatttttttttatttttctttgatggattgggttaattcgaaagccttgtcttcaagctctgaaattctttcttgtgcttgtttgattctattgtcaagactttccagtggcatttttgcatttttttaagtgtccttgattttcagaagttgtgattgtttttcatttatgctacctca

SEQ ID NO: 9493 - DNA, 367 bp, Homo sapiens
cacaaggccaccaccaatagagccaggatggggttccaggtggcttgacttggcagccagcgcctgtgcccatggcaccccctcaccccagctgtctgggttattttgggcttcctcccgtgccagctgtctgctggcatccctgcccgggactgtctggttggaagtactggcgtggtgctgttggctcctcctgtgagggccagggctgggtcttcaatccccgatgagccgtgctgggtccagctcctttgctgggagggaagagtgttcctgcccagactccccgctgcccaagtacagcaagagggcgaaagcacctgataaaaattgaggttcacattgttaatatcccaaaagcctccaa

SEQ ID NO: 9494 - DNA, 430 bp, Homo sapiens
  misc_feature 137: r=a or g
  misc_feature 138: m=a or c
  misc_feature 139: n=a, g, c or t
  misc_feature 159: s=g or c
  misc_feature 160: d=a or g or t
  misc_feature 188: w=a or t
  misc_feature 298: m=a or c
gttggaaaacagttttggctctgaggacccagcagttgacaaacaggaggcctgggacaagagcagtatgagaagtcagatcgcctcttttaatgtcactagtcagtacaggcctcgccagacaagtctctcctcarmntcacttggaagaacaggccsdctcttcatgatcctgggtttcctagacwtatttccaggactgttatggggattagggccaactgtaaaagtggctgaggagactaggtaaagagtgttgtctcactttagaacaatgctgaaggtgtttagagcctgmcatcctaaaatatgccactttggcatactgattcttctgagccagaggcaatggagcaaaaacagatgcagggaaggctgtctgaccaccctctttctgtttgaagcggaacataaaagttcccttgtgaaa

SEQ ID NO: 9495 - DNA, 185 bp, Homo sapiens
  misc_feature 21: r=a or g
  misc_feature 54: h=a or c or t
  misc_feature 55: w=a or t
  misc_feature 56: s=g or c
  misc_feature 80: h=a or c or t
  misc_feature 108: r=a or g
attttttagcatatttgatcrctttgattctctgttcttttctctccgcggtghwstgtgtgcgtgcgcgcgtgtgtgthttcttcttctcctcctcctctccccgarttgcctcctttctccgggtgccgtactgccttttttcccctctttcattctttctctccgtctttttctccccccaa

SEQ ID NO: 9496 - DNA, 250 bp, Homo sapiens
  misc_feature 121: k=g or t
  misc_feature 129: w=a or t
  misc_feature 151: w=a or t
cctggaaaatgtcccatgtgtacttgggaaggatgtgtattctgttgttgttaggtacagtgttctgtgtgcctgttaaatcaagttggcttattgtgcccttcaagtgctttattttctktctttctwtttctttttttgagatggagtwttgctcttgttgcccaggctggagtgcagtggcgtgatctcggctcgccacaacctccacctcccaggttcaagcaatttctcctgcctcagccccccg

SEQ ID NO: 9497 - DNA, 476 bp, Homo sapiens
  misc_feature 28: k=g or t
  misc_feature 362: w=a or t
  misc_feature 363: k=g or t
  misc_feature 405: y=c or t
  misc_feature 406: w=a or t
atcactaggcgccgaggaggggagcggkaagcgcagtgccagcgccacagcccttcaatcattttggttgctatccagcttctccacatcaagtccaacttcagaaaccccaagcctgtagagaaaagttgacctgtgctgactctggtgatggtgactgtctctcactaatttctttgaagtcttcaaggataagcagagttgatccatctgagaaagggatcatgaactagacagaatgaacagccttagaggcacagactcttgaacgggacggtggtggtatgactagtgcagagtgtttagagatcactcagtttttaagactggcctttatcgtgtctcagtgcagccgaggcagwkcctttgaaggatgcgatgttgtcattcttactaatctagtcywgccgctgaggtgactttcaacggcagaccgtctcctgagcgccccaggtagaatttcaaagtgatgctgt

SEQ ID NO: 9498 - DNA, 383 bp, Homo sapiens
  misc_feature 16: k=g or t
  misc_feature 45: w=a or t
  misc_feature 46: w=a or t
gtagtaatgaaacaakagagaaggagagcgggatgtgggaagatwwatgaaggggtctagatgtaaatgtcagtggaaaggagagctaccatcactaaggtggagtctcgctctgtcgcccaggctggagtgcagtggcgcaatctcggctcactgcaagctccgccttctgggttcatgccattctcctgcctcagcctacccagtagctttgactacaggcgcccgccaccatgcccagctaattttttattttttattttttagtagagacggggtttcaccctgttagccaggatggcttcgatctcctgacctcgtgatctgcccgccttggcctcccaaagtgctgggattacagggatgagccaccatgcccggcc

SEQ ID NO: 9499 - DNA, 243 bp, Homo sapiens
  misc_feature 148: r=a or g
  misc_feature 182: d=a or g or t
tgtgctgaaacttaatcagcaatgtgatggtaataggtggggcctttaaaggtgattaagtcatgtgagtgacctttataaaaaaggcttcatgcgttgttcagctctctttccccttctatctcttttgtcatgcaaagagaggatrtggtgtttgtccacattggaggatgcagcgacadggcgtcaccttggaagtagagagcagccctcaggggatgctgagcctgtggaagtatggat

SEQ ID NO: 9500 - DNA, 222 bp, Homo sapiens
cattatagttattatcaacatgattatttgctctaagaggaactcaggcatctgcagggtgtggggaaccctgagctgggtctcccctgttgggtgttgtgtccccatcatacccttaggacaacccaggttaggtcagggggatgtgcccttctcttccagccataggctgctctgagcccccagggtcttcagtccatatgagatattcccagcaggcca

SEQ ID NO: 9501 - DNA, 273 bp, Homo sapiens
  misc_feature 44: y=c or t
  misc_feature 137: y=c or t
  misc_feature 142: y=c or t
ttctagcaaccagactggagtgcagtggcacaatctcggctcaytgcagccttgaactcctgagctcaaaccatcctcccgccttagcctcccgagtagctgagactacagttgcgcatcgccacacccgttttgtyttgtytttcccatttttttttggagcagtctcactgtgttgctgaggcatgtcttaaactgctggcctcaagggatcctcctgccttggcctcccaaagtgctggcaatataggtgtgagccaccactcctggccc

SEQ ID NO: 9502 - DNA, 236 bp, Homo sapiens
tctccccgtctcttccttccctgcttgcctttgctttttgctgctttcccgcctccctcctttttctccctctttccgtctctgccttcgtttccctccctccctttttctttcatttctctctccctttctccttcctttcttgctacgtttcttccctctttttcatttttctcccttcctttttctgcttttctccctccgcccttcctctgttttttctttgctcccaatcc

SEQ ID NO: 9503 - DNA, 484 bp, Homo sapiens
  misc_feature 289: s=g or c
  misc_feature 290: s=g or c
  misc_feature 346: s=g or c
  misc_feature 348: v=a or c or g
gttagttgggcagggctgaagtgtatgtggtgaggaaaagaggctcctactgtagacagccttgttctacagatcctcccagaaatctctgggccaggtggaacccagggtcagagagggatgggagagaggtttaattttccatgataaataaaaatctataaaataataaacaagagaaaagagattggaaacagccaggttggagcagtgagtgagtaaggaaacctggctgccctctccagattccccaggctctcagagaagatcagcagaaagtctgcaagassctaagaaccatcagccctcagctgcacctcctcccctccaaggatgacaaaggcgsgvctcatctatttggtcagcagctttcttgccctaaatcaggccagcctcatcagtcgctgtgacttggcccaggtgctgcagctggaggacttggatgggtttgagggttactccctgagtgactggctgtgctggc

SEQ ID NO: 9504 - DNA, 196 bp, Homo sapiens
agggaagtctgtgactgcctggccagacttagggctcacgctctggtcagagttatggcaccccagactctgctgcctgtcctggttctctgtgtgctgctgctgcaggcccagggaggataccgtgacaagatgaggatgcagagaatcaaggtctgtgagaagcgacccagcatagatctatgcatccaccaca

SEQ ID NO: 9505 - DNA, 239 bp, Homo sapiens
  misc_feature 137: r=a or g
  misc_feature 143: w=a or t
  misc_feature 144: r=a or g
agtagctgggactacaggcgcgtgcaaccacgcctggctaatttttgtatttttagtagagacagcatttcaccatgttggccaggctggtctcgaactcctgacctcaggtgatccacccgcctcggcctcccaaragtgcwrggattacaggcattagccaccgcgcccagccctgtgtactctagatttgattcccttgttggatatgtcatctgcaaatactttctcccactcgt

SEQ ID NO: 9506 - DNA, 297 bp, Homo sapiens
  misc_feature 174: s=g or c
gaagttcttcctagggtgtcacctccagacacactgctgcggcgggaggatgcgtttctaatgtccctgggaaatgacaggacacccagatctgctgggagcagagttctcatagggtcccagctgagccctggaactccccagaccccctctgccactccatctctgcgtcasccagcacctgtgccctatccggctttggccaccatctccaccctggggagggggagcataaccccctccagcctgaggttggcgccaaggtttaggagccagcacagaagcctctgagagccg

SEQ ID NO: 9507 - DNA, 140 bp, Homo sapiens
aattgtgtaagggcagccagcagatttagtcacctaatcgcctctcttatcagtgttctctcccagcgggcagacaacaacacgagattgttcagcaagtaccacaagtccagcaggagagggctcagatcccgccgcta

SEQ ID NO: 9508 - DNA, 204 bp, Homo sapiens
  misc_feature 11: y=c or t
  misc_feature 104: r=a or g
  misc_feature 111: d=a or g or t
aactgccatcygcaactgaactttggcagtaaacacagcttagttgtctcagaggattcacaatgggaaatgtttgtagttgctgcctcagagcaagatatcarcagttgdctttaattttagttcatttcccagcatattctgttgaagatcaaagagtggatcctggggtgccaggggaatccaccgtctgccaccacaatc

SEQ ID NO: 9509 - DNA, 362 bp, Homo sapiens
  misc_feature 110: w=a or t
  misc_feature 321: y=c or t
cggttcgcctgttgatggacacttagattgcttccaattcttgactattgtgaatagtgccacagtaaccatgagagcgcagatacctcttcaatatactgattcccttwctttagtgggattgctggatcatgtggtagctctatttttagttttttgaggaacctccaaacttttctccatagtggttttattaatttacattgccaccagcagtgtacaagggttcccttttctccatatcctcaccaatatttgttacgcatgtcttttggataaaagccattttaactggagaaaaattataatttcattgtagtyttgatttacacttctctgatgatcagtgatgttgagctaag

SEQ ID NO: 9510 - DNA, 153 bp, Homo sapiens
tcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctca

SEQ ID NO: 9511 - DNA, 328 bp, Homo sapiens
  misc_feature 27: k=g or t
  misc_feature 110: k=g or t
  misc_feature 276: w=a or t
  misc_feature 284: k=g or t
  misc_feature 286: k=g or t
gaccaagcccggtctgtgcacgggttkcctcgtttctggccttcccttgccttgtacctcgacttcgcgcgtggcttgtttttgctgagtggaggcctgcgttttctgtkatgtctcttccggtgccccacaactcctgagctacccttcttttatgcgttctctcccagcgctgtgattaccgggttgcttaccgggccctccttcctcagattgcacccctttccttgtgtctcttcttgtctttgtgtcggttgtgattttcctaatctctgwttttcctktkctctcggacgctctccctcttcggacccattttctcccgtgc

SEQ ID NO: 9512 - DNA, 374 bp, Homo sapiens
  misc_feature 332: s=g or c
  misc_feature 366: r=a or g
taaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacasactcatgaggttcctgtctctactcatactaacraattgcat

SEQ ID NO: 9513 - DNA, 286 bp, Homo sapiens
aaacatgtttcggcgtccttccacactgtcgcggcttatgttgttttgctgtttgggtttgcactgtctttttgagctgtaacacagcaaaggtttgcagtttcgctcctgaaatcatcgagaccacaaacccaccgggaagaacgaacaactccagacgcaccgctttaagagctgtaatactcgttaggaaggtgtgcagcttgactcctgagtcagcgagaccatgaacccatcagaaggaaaaaactccgaacatcagaaggaacaagtttcagacacgcgc

SEQ ID NO: 9514 - DNA, 163 bp, Homo sapiens
accagacttctgaccccttgggcaacagccagatggagactggtcgccttttgagcctcagctctcttcctcttgttctcctagggtgggagtacagcagccaaacgctgaacttagtcccatccacttccatcttatcctttgtgcccttcatcccccgagt

SEQ ID NO: 9515 - DNA, 170 bp, Homo sapiens
  misc_feature 21: s=g or c
  misc_feature 146: w=a or t
agaactgcccttgcctaccgscctactgcgggcgctcccctgtctggggggtgcttggctgggtgtggagaaggatcaatcacagctgactcctcagaggtgacagcccctgcccccttaaaaaccaagaaaagacctagcagtgwgaagccaaactgcacccccagccg

SEQ ID NO: 9516 - DNA, 335 bp, Homo sapiens
  misc_feature 22: r=a or g
  misc_feature 67: k=g or t
  misc_feature 174: s=g or c
tcttccttaaaaaggaaatacrgtgatttgagctagatgaatccagctacattttactttttttttkgagaccgagtctcattctgttgcccagggtggaatgcagtggtgcaatctcggcttactgcaatctccacctcctggggtcaagtgattcttgtgcctcccaggtasctggggactataggcaccaccacacccggctaatttttggtgttttttgtttgtttgttttgtatttttagtagagacggggtttcaccatgttggccgggctggctgcaaactcctgacctcaggtgatcagcccgcctcagcctcccaaagtgcatggg

SEQ ID NO: 9517 - DNA, 373 bp, Homo sapiens
  misc_feature 370: v=a or c or g
  misc_feature 371: n=a, g, c or t
atctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccagvntt

SEQ ID NO: 9518 - DNA, 251 bp, Homo sapiens
acacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccacgac

SEQ ID NO: 9519 - DNA, 235 bp, Homo sapiens
  misc_feature 105: w=a or t
  misc_feature 127: r=a or g
  misc_feature 198: b=c or g or t
  misc_feature 233: r=a or g
  misc_feature 234: m=a or c
aggttcttctgtgtctgctcaccgagctgctccgagcccggcttagaggaccaggacagactggaggctgtagcctgctgcaccgtggctggcctccctgcagtwggtggcgacagacactgtagtrtggctggaaaggtaggaaggggaaaatagtttcgggatagatggaagggtaaagagggtggttagtgccabaaggaaaaaaggatggtgagccggagaaggcagtrma

SEQ ID NO: 9520 - DNA, 328 bp, Homo sapiens
  misc_feature 179: b=c or g or t
  misc_feature 180: w=a or t
  misc_feature 283: d=a or g or t
  misc_feature 312: w=a or t
cccaaattcttctcatcttggaaaactgaaactctatacgtattaaacttcccattcccccagcccctgacaatcaccattctaccttctagctctgtgaatgtcacaagtacattcattatgtgggatcatacagtatttttttgtgactggcttattatacttagcatgatctacgbwgtagcaggtgtcagaatttcgttcctttgaaaggctgaataatattccactgggtttagatacaccacgttttgttgacccattcacccatcaagggacccadgttgcttccacattttagctacagtgaawaatgctactagaaaca

SEQ ID NO: 9521 - DNA, 141 bp, Homo sapiens
  misc_feature 104: m=a or c
  misc_feature 116: k=g or t
  misc_feature 119: s=g or c
  misc_feature 122: d=a or g or t
  misc_feature 123: w=a or t
gagtcgggacggtggtggcagcctgtagcggtgggtctcgtccttccagggcctgcgggctctggaacgggaagtctccccagcgggcagcacttgctgtggamtggctgcccatkggscgdwttgtgggcagccgaatat

SEQ ID NO: 9522 - DNA, 293 bp, Homo sapiens
  misc_feature 139: n=a, g, c or t
  misc_feature 140: n=a, g, c or t
  misc_feature 183: r=a or g
  misc_feature 227: r=a or g
  misc_feature 240: m=a or c
  misc_feature 258: m=a or c
  misc_feature 259: m=a or c
  misc_feature 263: r=a or g
agacctggggccgcggcgaccccgggtggaggcgacgttggggttgtttgggctcctatctttgcctctggagctcacggtcggcgcttgtcataacccagcactaaggactgagcgggcggacgttcgtctttctagnnaggcctaggcgaggcctaggacgagggcggcggagaacgcggrgagaagcccacccgtgaggagccagctgccgcgacggtgcggaragattccgggaamcaagccctctgcgcgatmmtcgrgcgcgggccgccgcctctcaccccgctcgc

SEQ ID NO: 9523 - DNA, 146 bp, Homo sapiens
actttcttcacacccaggacgcagggtgccgctgccggccacagaaaccccaagaatgtttttctttggctattcagaggacatctattgtgtgtcaggccctgtgctgagctgttgttgcctgacagcaggaagagcgcggctct

SEQ ID NO: 9524 - DNA, 308 bp, Homo sapiens
aaacattctggaacttcaaaaacagtggacagccaagccctgatggacttgagagtacctacctttatgtacatacttatatattcaaaacaaatgcatggaatggaaactacaagaaaggacttggatttgcctgctccttctgcctcctattgtcatgcttctgaggtaaatagcatctctggagtccagccaggaccttggattttgctcatgctagaaatgcccagggtggtgcttggtccacagaaggtggatttgttcaagctgtacttctgaagacacatgtgggataattaacaaggcat

SEQ ID NO: 9525 - DNA, 143 bp, Homo sapiens
aatgtaccccctaggcaggggagagcagggccctgctgcacccaagtcctggttgctcctccccaccacactggccctccatggaagccttgatgcagtgagccaggcccaaggacgccccggccaccctgacgcacccccca

SEQ ID NO: 9526 - DNA, 319 bp, Homo sapiens
  misc_feature 22: k=g or t
  misc_feature 23: d=a or g or t
  misc_feature 310: n=a, g, c or t
  misc_feature 311: h=a or c or t
aaatgtgacgtaagaaacactkdaagccagtaaaggccctggaatgctgaagcagatgcaggacttaaagggagatggtgaggtttttcttctccctccagcaggtttgagccagccagtttcatgtttcatctgaagtgtgagttttataagaatttcctaatggaaggtctctctagggccttgtgtttcctctgttgcagtagttctgtagctctgctttcccagatcatgaaggagacaagtatattaatttaaaatagaattattatcctattctttgtatattagtcaaaatagaatttaggcnhccccccct

SEQ ID NO: 9527 - DNA, 158 bp, Homo sapiens
agttggatttgtctagtatgctgtagtttgccaacacctgggctagaatattgtaaggagatcaacattttagacataaaagataatgttggagatttgttttctctgaaattgacttgcagtgtaaggaaaacaaattgcttgcttttttttttttt

SEQ ID NO: 9528 - DNA, 251 bp, Homo sapiens
ggaccgagacttgtggcgctctcagccaccgacagcgccggcctcagtgccgcctctgtcccagcccgcgccggctctgccactttggcagcgttaagtgtggaatcggggcctgtgtccgcgggcttggtgagttcttcatatattaaggattcattcattcatagactcatttattgaaggctgtctgtgtaacaggcacaatcctaggtgcttgggatatagcagtgaacaagagacaaacccccgtt

SEQ ID NO: 9529 - DNA, 457 bp, Homo sapiens
  misc_feature 175: k=g or t
  misc_feature 176: d=a or g or t
  misc_feature 321: n=a, g, c or t
  misc_feature 322: n=a, g, c or t
  misc_feature 410: n=a, g, c or t
ataaaaactaagcattgctaaagtttcagtgtaaggcattagaaacttttaaaattccacatgtatttattgtgtgtttgtaattttttattgtgtaatctgcgtagaatgttgacttcagattcatgtgtacaggaatttaaattcagtgtcttccacttaatacttgctatakdccttgtaaaaggtgcaggttctatgggcttttgttttcacatctataagatgaaaataatgtcaatttaatcagatgattaggggaattaaaatgacaaattgtatgttaaacacctagcatagtgcctggcacataacaagtanncagtaattactaagttttattagtattttgagaatacatacacgaagtatgagtgacgttctgtgactgatagtttagtgtgttaganttgttattcccttcagttgtgacctcaagaggttattcatttatccc

SEQ ID NO: 9530 - DNA, 196 bp, Homo sapiens
  misc_feature 70: m=a or c
tttctttctttcaggagacagggtcttgctctgtcacccagactggagtacagtgtcttgatactagctmctgcaaagtcaaattcctgggctcaagggatcctcctgcctcagccacctgaggagctggaactgcaggcctgcgacactgcacccagctaatttttttttcataaatattatgcttttgtaccca

SEQ ID NO: 9531 - DNA, 207 bp, Homo sapiens
cctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctac

SEQ ID NO: 9532 - DNA, 383 bp, Homo sapiens
  misc_feature 168: y=c or t
  misc_feature 169: b=c or g or t
atcctccagctaataagtgtccaagctgggactcaaacttgggccttttaactgtgctgctattctacctctcccttgctctttccagaccaggcttgggacataacactaacacccttttcctttcatttcatctcttgtccttcagtcattcctaaacattgacaybcattgagttccttggctctggccatagtcctttctccctttcccctctggggcatcaaatagtgattacagtatccacagggatggcatatgccatttcaccatttcacagttcctggaatccacttttcacttctcataaagcttcagcaagccattctcatcttgggttgcttgtttgcctatttgctgttacatccattctctgctcctca

SEQ ID NO: 9533 - DNA, 303 bp, Homo sapiens
atttccacttgggtgcttcataggcatttcaaacctgatgtgtttaaaacacttgattaggctccggttttcctttggcttctgcttttcagtgaatggcatgactgcctatgtgggtggcaagccacccaggtgccgaggaaagagactgagggcacgagctgttccagtataataaaatatataaaataagaagagttatactagatctagatcatagacatgattatatgtgagtatcattaatcattagtttatagcaattactctttattccaatattataataatcctcactctacc

SEQ ID NO: 9534 - DNA, 407 bp, Homo sapiens
  misc_feature 57: k=g or t
  misc_feature 248: b=c or g or t
  misc_feature 310: k=g or t
agaaagggatcgcgagggctgcagtgcgcacgggtcggatttgaaatcggtggcctkaagcagagaccagctccagtcctgtctgctgggtccttccagcctgtcgtgtcctgttgtgtcctgagctcctgctggctgtcaggcacgcttgctggtgcttcctggtgcgcgcagagccccgggattgtcatcactgattcctgcattgatctgtctgcaccccctcttcataagttcaagggtacttbgagaacatccccaagggtctagaccaggaaggctggactcgaggtggcatccagccccagakgccaggaggctacgccctcagccagccggtcagctgcatggaggccacccccaaccccatggagagcctgcgcacctgcatccccacgtgggaagaa

SEQ ID NO: 9535 - DNA, 328 bp, Homo sapiens
  misc_feature 161: v=a or c or g
  misc_feature 165: v=a or c or g
  misc_feature 166: d=a or g or t
  misc_feature 246: s=g or c
tgtttgtgatcagtatccaaaggcaaaatgattttgtttgaccatttacattgttcagcatcaggagtgactttctggttgctttgcaggatctgtacgtttggttttcatggtttttctaaatacacagtttcacgtggaacacagcagggggcaggaavgtgvdgtggattacaccagaactgggaacagtggagggggcttgttgggaagtctagttctgccgcagttgttttctgccttacstttgacttggttaccagctttcaattagcaagtgcaattgaaagtacacatttccatgctgggcgcgatggctcacacctgt

SEQ ID NO: 9536 - DNA, 180 bp, Homo sapiens
tggcagttactccagctcccaaatatagatattccatgaggttgttgtttttgttgttgtttgtttgtttttcgagacagggtctcgctttgtctctcaggctggaatgcagtggtatgatcatggcttactgcagcatcagcctcccaggctcaagcagtcctctcacctcagcctcca

SEQ ID NO: 9537 - DNA, 157 bp, Homo sapiens
  misc_feature 156: n=a, g, c or t
ctctgcctgccctgatctcccaaattgctgggactacaggtgtgagccactgtgcctggccacagctaatttttaaaatttgtagaggtgtggtctcactatgttgcccaggctgttctcaaactcctgggtgcaaatgatcctcccaccttggcnt

SEQ ID NO: 9538 - DNA, 141 bp, Homo sapiens
  misc_feature 125: m=a or c
atggagtctcactctgtcactcagactggcagtgcagtggcatgatctcggctcactgcaacttctgcctcctgggttcatgcaattctcctgcctcagtctctcgagtagctgggattacaggmacccactaccacaccc

SEQ ID NO: 9539 - DNA, 250 bp, Homo sapiens
  misc_feature 16: m=a or c
  misc_feature 72: w=a or t
  misc_feature 155: y=c or t
  misc_feature 160: k=g or t
  misc_feature 199: r=a or g
  misc_feature 220: s=g or c
  misc_feature 235: w=a or t
tttatgacccttgggmaacagctactggctctgagccttagttgcttcttggttatgttgtctgactatctwtactgttccaaaacagttgtaatttcccccatttctatttattgctctggaaacacatgtcgtttatctacacttttgctgtyttgtkctgtggtgtgtgagcgcatgtttcccctgccagcctggracccctgagggcatggatgcsatcttatttgttttwatctccccagcgcct

SEQ ID NO: 9540 - DNA, 240 bp, Homo sapiens
  misc_feature 211: k=g or t
  misc_feature 212: k=g or t
ctctctctcgcttcctctgtttttgtgtgatctctgcacatgagtagaagcatcctgaatccctcaccagatgcccagtgatccagccagcagaattgatttgttacttgatctccatgtgtatatgcaaatatttgcctgtatttattgtcatcatcatactttgggcactggccatgctacctctgtgaggaaagaagggaaaggaaakkaaaaataagaaaagaagaaaacatccat

SEQ ID NO: 9541 - DNA, 167 bp, Homo sapiens
tgtagacacagatttttaattttggaaaaacctccagttactagtgacgaggatagaaagggaagtgcttctctttggctttttcttggttacactgcagtttcaggattgggtgagacagagacaaatgaacccccctctaaagtcatttaactaatagccagcac

SEQ ID NO: 9542 - DNA, 173 bp, Homo sapiens
cacctgtcttgatcaagggccacattccaagccttggtctccagagaacttcaacacgaccaacagtttgtctggtgcagtgacccttcactatactcactctcgtcacctgcacgtactctcaaagagtgtacatcttctcatcagctctccctagtttgttcacgggccgc

SEQ ID NO: 9543 - DNA, 436 bp, Homo sapiens
  misc_feature 3: h=a or c or t
  misc_feature 44: y=c or t
  misc_feature 96: w=a or t
  misc_feature 172: d=a or g or t
  misc_feature 202: m=a or c
  misc_feature 203: w=a or t
  misc_feature 336: w=a or t
  misc_feature 344: n=a, g, c or t
  misc_feature 345: w=a or t
  misc_feature 354: h=a or c or t
  misc_feature 355: m=a or c
  misc_feature 361: h=a or c or t
  misc_feature 395: m=a or c
  misc_feature 407: m=a or c
tahaaatacactttgtaaagtaaccacatatacagcactgtcayaatttcatgttttggggtttggccccactgctgcacgtgaaagctacaaggwctttccccgaaattcaggcccatgtttccaagcaagagtgttgactctttttaaagaagagagtttcctcatcctdtacacaaatgcatattctttccctgcttamwgtcttcccagctcttccacccaccccacctaaacacaggaaaatgcctccgtggcgtcaggaacagtcaggtagactttcagtctgtgcattttcaggaacgtgtttccaagttagcaatttgaaatcttcawgtgctttnwgtgaaacahmtcttghttctatttgtcccctttctttgagaaagaaggamggtgatgttggmcttccgtgctgaagatagagaagaatcct

SEQ ID NO: 9544 - DNA, 451 bp, Homo sapiens
  misc_feature 310: n=a, g, c or t
  misc_feature 311: n=a, g, c or t
  misc_feature 394: n=a, g, c or t
gtcacaaaaggagcactaagagcctgctttactttcttcctcagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctaataagagcctggccaaccagnnacgcaaatggaagcctatcttaatgacagcttgctcacaccttcagacagccctgattttgagtcagtgcaggcagggcctgnagccagacccacctttaggctatacctctcccttcctgtcagccaggctggcccagc

SEQ ID NO: 9545 - DNA, 137 bp, Homo sapiens
catagatgcccagatcagtattcagccaaagattctaagtgagccgcctatagataccttttttggggtactctgcctttacgttgtagctgctttaacctctggcctctggattcttcataactctcaccatgcac

SEQ ID NO: 9546 - DNA, 379 bp, Homo sapiens
  misc_feature 64: m=a or c
  misc_feature 151: r=a or g
  misc_feature 152: k=g or t
  misc_feature 309: k=g or t
  misc_feature 312: b=c or g or t
  misc_feature 316: k=g or t
gaaatttactttcttaccattctggaggctgaaagtccaagttcaaggcacttgatctggtgamagtcttgctgcatcatcacataatggaaggcagaagggcagaagagggcttgtcctttgacctcaagcccttttataatggcattarkccatttcatgagggcttttgggtcttgtttcctcttttcttagtctggtcaaaggtttgtcaattttatttatcttttcaataaactagctttcatttccttgatcttttgtattgttttcttagtttcaatttcatttatttgttccctgattttkatbattkcttttcttctagtaattttaggtttcgtttgctcttgcttttgtagttctttaagatgcatct

SEQ ID NO: 9547 - DNA, 142 bp, Homo sapiens
  misc_feature 45: w=a or t
  misc_feature 46: n=a, g, c or t
  misc_feature 47: s=g or c
  misc_feature 112: m=a or c
  misc_feature 124: m=a or c
  misc_feature 125: w=a or t
aaattacaagcacctgccactgcacccagctgatttttgtatttwnsgtagagatggggtttcaccatcttggtcaggctgatcttgaactcctgacctcaagtgatccacmcgcctcggcctmwcaaagtgctgagattac

SEQ ID NO: 9548 - DNA, 155 bp, Homo sapiens
  misc_feature 30: s=g or c
  misc_feature 31: m=a or c
aacccgctggggtccgcttctgtgctgtgsmgtgtttcttcttttgctcttggcaataaatcttgctgctgctcactcttggggtccacaccacctttaagagctgtaacattcactgcgagggtctgcagcttcactccttaagccacggaacc

SEQ ID NO: 9549 - DNA, 233 bp, Homo sapiens
tctgcttcagcctcccgagtaaaaggcatgcatcaccacacctggttaattttgtagttttagtagagatggggtctcaccatgttggccagactggtctcgaactcctgacctcgggtgatccgcctgtctcagcctctccaagtgctgggattacaggcgtcagccactatgcccggctgggatcatatgttccacacatgtttgttcaataagcatggactgcaaccacc

SEQ ID NO: 9550 - DNA, 274 bp, Homo sapiens
  misc_feature 123: d=a or g or t
  misc_feature 124: r=a or g
  misc_feature 126: s=g or c
  misc_feature 130: y=c or t
  misc_feature 136: y=c or t
  misc_feature 149: m=a or c
  misc_feature 150: m=a or c
  misc_feature 165: r=a or g
  misc_feature 271: m=a or c
ggcaacccgctcgggtccccttccgcaatgtggaagctttgttctttcgctctttgcaataaatcttgctactgctcactctttgggtccactctgcttttaggagctgtaacgctcaccgcdrasaatytgcagyttcactcctgagmmcagcgagaccgtgarcccaccgggaggaacgaacaactccagacccgctgccttaagagctgtaacactcactgcgaaggtctgcagcttcactcctgagccagcgagaccacgaacccamcat

SEQ ID NO: 9551 - DNA, 173 bp, Homo sapiens
ctattaacgttttgcgccagataattctttttttatggggagatgccctgtatattataggctatttatcagcaatccgtggcctctacccactagatgccattagtaccttcctcctagttgtgacaaccaaagaatgtttccaggcattaccaaatgtaacccgccctgat

SEQ ID NO: 9552 - DNA, 164 bp, Homo sapiens
  misc_feature 79: w=a or t
  misc_feature 122: k=g or t
  misc_feature 128: n=a, g, c or t
actcttgctccaagattttactacaattgggtaggattatgtgcgaaattgccttgttcagactgtgggatttcaaagwgaacagaagaaatcctgctcacacacagaaagatcctgaccakgcaaangagcgcgtggtctttttatttaaaggagaggagagt

SEQ ID NO: 9553 - DNA, 150 bp, Homo sapiens
  misc_feature 89: s=g or c
  misc_feature 91: r=a or g
  misc_feature 92: m=a or c
  misc_feature 138: s=g or c
gacagggtctcactgtcagccaggccggagtgcagtggcgccatctccgttccccgcaacctccgcctcctgggttcaaggggtccgcscrmctcagccttctgagtagctgggacctcaggaacgcacaaccacgcscagctaattttt

SEQ ID NO: 9554 - DNA, 305 bp, Homo sapiens
  misc_feature 1: r=a or g
  misc_feature 49: k=g or t
rtactgcctccatgcaagcccagaataacctggatgtgtgactcacagkggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccgctggggtatggccgtcaatgtgtactccacatctgtgaccagtgaaaatctgagtcgccatgatatgcttgcat

SEQ ID NO: 9555 - DNA, 342 bp, Homo sapiens
  misc_feature 245: w=a or t
  misc_feature 278: s=g or c
  misc_feature 298: m=a or c
gttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagwtcacccgggagaagctggaccaagtggcgacasagtgtaccagatgatggatmagctgtaccaggggaagatgtacttccccgggtatttccccaac

SEQ ID NO: 9556 - DNA, 294 bp, Homo sapiens
  misc_feature 148: y=c or t
  misc_feature 258: k=g or t
ggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggycgagcgcggggaactcgacttgaccggcgccaaacagaacacaggagtgtggctagtcaaggttcctaaatatttgtcacagcaatgggctaaagcctctggaagaggtkaagttgggaaactgcggattgccaagactcaaggaa

SEQ ID NO: 9557 - DNA, 194 bp, Homo sapiens
  misc_feature 156: b=c or g or t
caactcccacaaaactcagtgaatattttttgttgctgctgctgttgttttgaggtggagtcttgctctgtcgccaggctggagtgtagtggcacgaactcagctcactgcaacctccgcttcctgggttcaagcgattttcctgcctcagcctcbcaagtagctgggattacaggcacgcgccaccacgcccc

SEQ ID NO: 9558 - DNA, 407 bp, Homo sapiens
  misc_feature 369: m=a or c
  misc_feature 370: w=a or t
  misc_feature 372: h=a or c or t
caggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcmwghccaacactgtatggtttttctctagcacggcaaac

SEQ ID NO: 9559 - DNA, 277 bp, Homo sapiens
  misc_feature 217: s=g or c
  misc_feature 219: y=c or t
  misc_feature 220: y=c or t
  misc_feature 222: m=a or c
tcggctcactgcaagctccgcctcccgggttcatgccgttctcctgcctcagcctcccgagtagctgggactacaggcgcccgccaccgcgcccggctcattttttgtatttttagtggagacggggtttcaccgtgttggccaggatggtctcgatctcctgacctcgtgatccgcccgcctcggtctctcaaagtgctgggattgcaggcgtgasayygmgcccagcctttaatttcacattttctaatagtcacatttaaaaagtaaagacaca

SEQ ID NO: 9560 - DNA, 145 bp, Homo sapiens
taacagaaatcattgttgtgggttgtggtaaccctcaccacacacacacaccccccacaccccacacccccaccaggctcaagccatcctcccacctcagcctcctgagcagctgggactgcgggcatgcgccaccacacctggc

SEQ ID NO: 9561 - DNA, 434 bp, Homo sapiens
  misc_feature 182: w=a or t
  misc_feature 188: h=a or c or t
  misc_feature 190: k=g or t
  misc_feature 217: k=g or t
  misc_feature 218: s=g or c
  misc_feature 316: n=a, g, c or t
  misc_feature 317: n=a, g, c or t
  misc_feature 323: y=c or t
  misc_feature 367: m=a or c
  misc_feature 378: w=a or t
  misc_feature 379: n=a, g, c or t
  misc_feature 380: d=a or g or t
  misc_feature 416: d=a or g or t
ccatataatcatcaaaaactatttgttaaatcaatccagagaagtaattagcacttacttctcagggttgttcggtcaatctataaactgtaggctgttatttggtctactgttgatcccagcttctctatctttgaacagtgcccattaactcaagaatataactgcttcctttgttctcwccttchtkgcccttctcaatcatcccctaaaagcksccttctctgagagggtaaccttgagcttctgggttttgtagatgtctatacctgagatccgacaatgtggtagaaggcaactgtgctgatgaattaanncaaaaytcccatcgcgtcgtggaggagtactttgtggcccccccaggtamcgtgctgcccwndaatggtttaacagatagtctcacagtaaccttaggdatgaagcaggaagcatga

SEQ ID NO: 9562 - DNA, 136 bp, Homo sapiens
  misc_feature 15: k=g or t
agtttattctctgckataattatgtactgtgccttattcaatttgtattcctggtagcacctagcggaattccttgcacagtgggtttacttagtatttgcccacatgaatatttttattttttaaaatgggcttc

SEQ ID NO: 9563 - DNA, 431 bp, Homo sapiens
  misc_feature 194: y=c or t
  misc_feature 305: m=a or c
  misc_feature 306: n=a, g, c or t
  misc_feature 307: n=a, g, c or t
  misc_feature 308: r=a or g
ccatgatctagattttgttgtttgtctgccatggtgtagtacaacttgttgctttatcctctgtatttcctgtaagttggtagttggatctagaggtttggttaaattcacattcaattttgttgttttggcaattacttcatgagtggtactgttgtctttcatcacagtgacagaatgtctgcttggtctcyctcttttcgtgatatcagcagttattaatgctcaataactaggtgcttgattcatagggattatagtagggttgcatttgaattctgtcattctttctttgtttcttagcmnnratacctataaagaaaaacttctcttctcctggttagttactgagtggtatggttcatataagaaaagtaggataagatgctgaagtcttttccgttatttccaggtttaaaaaaaaaatgcca

SEQ ID NO: 9564 - DNA, 400 bp, Homo sapiens
  misc_feature 89: w=a or t
  misc_feature 90: r=a or g
  misc_feature 162: w=a or t
  misc_feature 304: b=c or g or t
  misc_feature 306: v=a or c or g
  misc_feature 358: k=g or t
  misc_feature 364: n=a, g, c or t
gagccacaggggaaaatgaaaacttacagatgaagtttaaagttctgctttggctttggagtatgtaagaagatgacttttggggtttwrtggtgttttaccttaaaaaggcgttttaggcctaaaaattatgttatttggcattcttatctctaggagaawataagtgtatgaatttcttatgaatcttgggttttagtcatatggttactcttttagtttacaaactacattgtatctttgcattagaaggggtaataattatcttaatagttgaagatgatttcctttcacttaaaattcbavgcataactttttcagatgttgcacttgtaagatctaagagttgaaagttgaktgattnaagggtgaaaaatgtctgttgcagagggaggctggt

SEQ ID NO: 9565 - DNA, 204 bp, Homo sapiens
  misc_feature 45: r=a or g
  misc_feature 46: w=a or t
  misc_feature 65: s=g or c
  misc_feature 66: k=g or t
  misc_feature 69: s=g or c
  misc_feature 71: s=g or c
  misc_feature 86: r=a or g
  misc_feature 102: r=a or g
  misc_feature 161: r=a or g
  misc_feature 162: w=a or t
  misc_feature 197: m=a or c
atttttcccctaagcccagctctccccaggtttcttctcggccarwattccctccaacctatttskccsgsccccatttttacccrtttcccccctcatcgrccttcgcatggctccattttcacctgcccctcccctcgatttcgcttcagcccctttgrwcccccttacacccacacaaccaacttcagcctcamcctccct

SEQ ID NO: 9566 - DNA, 337 bp, Homo sapiens
agagggttgagagagaggagaggtgagagaacatcatgttgaagtgaagttcagaccacatgaagaagccacacataggtgttccatccaacagccaacatcagctggtgtacatgttggtgagtgagcttctgatgagtccagtatccagcctcaaatcttccagctctggccaaagacactgtggcgctcagaaatgccatccctgccattctttacctaagtttctgattcagagaacccctaagcaaattcagttgttgttacctcatgccagcaacttgtggggtaatttttaatctagcactagtaatttgaatttctatcttgcagcccc

SEQ ID NO: 9567 - DNA, 271 bp, Homo sapiens
  misc_feature 16: k=g or t
  misc_feature 100: r=a or g
  misc_feature 105: y=c or t
  misc_feature 111: w=a or t
  misc_feature 127: w=a or t
  misc_feature 168: m=a or c
attaactcggagccckgcgcagtggaaagcgggccaagaagcagaggtccaggttccaactcttgattctatcacaaaacactgcacccgaggcagccargcagyttccgwagacctcgttttcgtwcttgttgcccaggctggagtgcaatggcacagtcttggctmactgcaacctccatctcccagattctcctaaacacatccattcctgtttctggcagaacttttgcaaacccatcccagttggatgcagcaacatcagaggggt

SEQ ID NO: 9568 - DNA, 306 bp, Homo sapiens
  misc_feature 220: w=a or t
attccctccgacttgcgtctgcttctcgccagcagccccagcattatgcagagacttgtgctgctattagccatttctcttctactctatcaagatcttccagtgagaagcgaatttgaattggacagaatatgtggttatgggactgcccgttgccggaagaaatgtcgcagccaagaatacagaattggaagatgtcccaacacctatgcatgctgtwtgagaaaatgggatgagagcttactgaatcgtacaaaaccctgaaacgcagtagtgctggtccctagagtcgctggaagtaggacc

SEQ ID NO: 9569 - DNA, 336 bp, Homo sapiens
  misc_feature 167: r=a or g
attacacaacaaagattagattgcaggggccccagccttctaatgcccctcctgctctctgaagctccctccacagactcctccaccccagaaccttccgacagagatgagttctccctgtgttgcccaagctggtctggaactcctgggctcaagcaatcctcccrcctcccagtgttgagattataggtatgtctagaggtcagtttggacagggacaggaacctctagacatgtttttctgggtgaacgagataagcggagaaatcacctaccccccgcagaaggcagatgcacctgctgtttctcctgagagcccacaaaagaagcccccat

SEQ ID NO: 9570 - DNA, 156 bp, Homo sapiens
  misc_feature 77: w=a or t
  misc_feature 78: y=c or t
  misc_feature 123: w=a or t
aacaatcatagctcattgtaaccttgacctcctgagctcaaatgatcctcaagcctcagcctcccaagtagctgggwycacaggtctcataaaacagcagcgtgcatcctgtgaaacagagawgcaaaataacatcccggtcagacctggagatgc

SEQ ID NO: 9571 - DNA, 281 bp, Homo sapiens
  misc_feature 147: m=a or c
  misc_feature 170: w=a or t
aatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggmagtgccacgtctttggagctgcwgcgagggacggatggcggaaccctccagtccccttcagaggcgactgcaactcgcccggccgtgcctggactccctacagtggtccctactctcgtgactccctcggccca

SEQ ID NO: 9572 - DNA, 386 bp, Homo sapiens
  misc_feature 49: n=a, g, c or t
  misc_feature 126: s=g or c
  misc_feature 355: b=c or g or t
  misc_feature 356: h=a or c or t
taaacaaacctgtttaattttgtttcacccaacatttttccaaacttanttgtttccagaacattttccacgtaagatgtggaatccacaattacttttcatagttttttcctcctttgttagatstttaacctttgtgctttctgttatgtatatgccattccttaatttgctgtaagctttgaatgaatgtgtgtaagaataaatagtcaaaagactagagacaagcctctgaataaactatttcagctttaaaactcaaattttgtgtacattttatagtatagaaattagaattataaaatgtattcacatatgcacatcattgagcttcaacagttatcgacttagggcbhatcttatttcatctatatttcactcgctac

SEQ ID NO: 9573 - DNA, 380 bp, Homo sapiens
  misc_feature 317: h=a or c or t
  misc_feature 318: y=c or t
aacctgcgggggtccgtttccacggtgtaggaactgttctttttctcttcacagaaaatcttgttgctcttcacgttttgggtctataccaactttatgagctgtaacactcacggcgaaggtctgcagcttcactcctgaagccagcgagaccacgaacccaccagaaggaagaaactccaaacacatctgaatgtcagaaggaaccaactcccgacacaccatcttaagaactgtaacactcactgcaagggtccgtggcttcattcttgaagtcatcgagaccgaaaacccaccaattccggacacactgggahytagagaagtgaccaggatttcttcagaccacctgaggccattggcaatggacacctagccac

SEQ ID NO: 9574 - DNA, 233 bp, Homo sapiens
agaggaaagagaaaaacatgtaacatgtaacaaattgttttcctaaatgacaactcagaacaatagaaggcattagaagagaccttccatatgcgcccatcacattcttcagcctacctatgtctgcacctttgtgctttcagtactgaaggttggatgaaccgtctgtcctcttctctaaggctggctcctctacctttgtaccctttttgcctacccagcaattcacccca

SEQ ID NO: 9575 - DNA, 178 bp, Homo sapiens
gtctcccggaccccaccagctctcccatccccagcactccctgtctccagcctcctccttcctcatcccctttcctcccaaccctgctcaggattgatccatgggcagcagcctcttttgctcacatggcttaaccagaccctgagccactcccaagccccacctctgtcacccacac

SEQ ID NO: 9576 - DNA, 194 bp, Homo sapiens
  misc_feature 157: s=g or c
  misc_feature 158: r=a or g
caactcccacaaaactcagtgaatattttttgttgctgctgctgttgttttgaggtggagtcttgctctgtcgccaggctggagtgtagtggcacgaactcagctcactgcaacctccgcttcctgggttcaagcgattttcctgcctcagcctccsragtagctgggattacaggcacgcgccaccacgcccc

SEQ ID NO: 9577 - DNA, 443 bp, Homo sapiens
  misc_feature 387: d=a or g or t
  misc_feature 388: r=a or g
  misc_feature 389: n=a, g, c or t
  misc_feature 400: r=a or g
  misc_feature 401: n=a, g, c or t
cattggaatggttggagaagcaaaaagtggataagtttccaaaaccttgatatatgcaagaagctgcagttattcctagtgctagaagagtgaaatagaaaatgaggttacccagaacccatgattattgtgctgttgaggcttctcctgttggacgtgagctttctcaacagcaactcaggagccttcacttgtctgttgcaacaactctgttggaattgccatcagaagccagaaaaaaacacaaacatattttccccctctcacctccagtgtcctaccaataatttctattggtagaacctaggaaatgagctggcaagagaacctgcagcagggattataattaacatcttcatttgtaacaatccagttagaatttacctdrncttagtttcarnttacatacaacaacttttctcatatatctctgttccctccat

SEQ ID NO: 9578 - DNA, 158 bp, Homo sapiens
  misc_feature 143: k=g or t
acggcccggagaggcgtcagtgctgggctgcgcctgcggaggtcctcgcaattgctggactcaaccgcgcgcgccccctaccggtcctgcgaaggagccgcagccgccgcgggaggccacaggtgaagcgaagggtgtgtctkacttcagcagcccat

SEQ ID NO: 9579 - DNA, 382 bp, Homo sapiens
  misc_feature 15: r=a or g
  misc_feature 16: k=g or t
  misc_feature 331: m=a or c
tttatttctttccarkccatatgtcttcatttttcttgctttattgcaatggctggaacttcctgtactatgttcaataaaagtggtgagagtggacatccttgccttcttcttcttcttctttttttttgagatggagtcttgctttgttgcccaggatagtgtgcagtggcacgatcttggctccctgcaacctctgcctcccggattcaagcaattctgctgtctcagcctcttgagtagctgggacacaggtgcatgccaccactcctggccaattttgtgtttttagtaggggatttcacaattattggtcaggctggtctcgaamtcctgacctcaggtgatacaccggcctcggcctcccaaagagctgggatta

SEQ ID NO: 9580 - DNA, 133 bp, Homo sapiens
cttctgtgtccaggctggagtgcagtaacgcaatctcagctcactgcaacgtctgcctcccgggttcaagcagttctcctgcctcagcctcccaagtagctgcgactagaggcgcacaccaccacacccaggc

SEQ ID NO: 9581 - DNA, 354 bp, Homo sapiens
  misc_feature 157: w=a or t
  misc_feature 158: h=a or c or t
  misc_feature 164: m=a or c
  misc_feature 301: y=c or t
  misc_feature 302: y=c or t
  misc_feature 325: w=a or t
  misc_feature 326: y=c or t
  misc_feature 328: m=a or c
  misc_feature 350: m=a or c
agtttcttatagagcacagaagccgtggtggtgtcatggaatattgtcaatttcggttacatttcatcatggtcaagtcaactccaggaggcagcatcatggacgatttggcttatgttctgcttttgtcttctacagaaccttgtgtctcactgtwhgtctcmttcctggctggggttatcacatggcatatccaactgattccatggaaagcttgtgtttaccctcaatagttagagacgtacaaggatggagagggaacagagccatcttcccagaaccaacttctgccagaggagtyycatgataatcccagccaaaagawygmaaacatgagtaatggctgtgamataa

SEQ ID NO: 9582 - DNA, 411 bp, Homo sapiens
  misc_feature 391: v=a or c or g
  misc_feature 398: w=a or t
tgaaaacaaacatctactaatgttgtcagatggttaggaagcaagattctgcaactatagagggtaagtgtttctttggttctgtgggtcctctctaaaactctaagatcttgaggggtgcatttcagaaagtgcagcgtgacccgcagtttgtgggaagccatggagctcggcactgccatcctaatacttcctaaagcacaaaaccccagagacaatctggggtcaggagagtggaaggggcttgtctgccacactggtgatgagtgccctgaaagacttcagagaatttctgaactggtggggaaacctctcttttcatcttcaggaagctcatggaagtgaaattgcagaaatgggagctggtattctagaggaaaaaaattatggvcaacaawatcactgtaacta

SEQ ID NO: 9583 - DNA, 446 bp, Homo sapiens
  misc_feature 415: m=a or c
tattgcttctttcttcttcttctttctgctttcttcttcttccttcttcctcctcctcttcttcttttgtttcttcttccttttttctttcttcttccttctttttcttctttcttcttctttttttgctagctctattacttctatttagcacaatgtttcctctggggtatttgttaaaagtcaggttcctggactctaccctgaccctttaatgttaaaaaagcttcccaggaaatgtgagcattttctctggagcctgtctttagccttctctcctcacttgactgcatttacaattagagctgcatttttctgacgtgtccatcatctctacttccattctcagactagcctgtcgagagttctggacagacattctgactgtaggacttctccatctacatgcatcaamttatgtctaaaactttcttcaattaactagt

SEQ ID NO: 9584 - DNA, 301 bp, Homo sapiens
  misc_feature 107: s=g or c
  misc_feature 249: w=a or t
aaaatgctttctagccgggcgcggtggcttacgcctgtaatcctagcactttgggaggccgaggcgggtggatcacctgaggtcagaagattgagaccagctccagscaacatgggtggcaaccctgtttttactaaaaatacaaaaatcagctgggtgtggtggtggacgcctgtaatcccagctacttgggaaggctgaggcaagagaatcacttgaacccgggaggcggaggttgcagtgagccgwgattgcaccattgcactccagcctgggcaaaagagggaaactccatctcaaa

SEQ ID NO: 9585 - DNA, 174 bp, Homo sapiens
actctgctgagctcctctgcacctgcccaggaccatgacgcctgctctgcgctgcgcattcgctctggccatagcgggcctcgtgtcgctgctgatgcagcccgagggcgccctcggcgaggaggctgcaagtgccgcagcccagggccgccagttggctgaacttaggctcca

SEQ ID NO: 9586 - DNA, 299 bp, Homo sapiens
  misc_feature 6: k=g or t
  misc_feature 166: s=g or c
  misc_feature 167: n=a, g, c or t
  misc_feature 259: v=a or c or g
attgtktctccacagctcgctgcccaactaggggcacctctccatcttcattccctaggaccccctctttcgagaagctgcaccttcagcttgttggttcttccaagttcatgcctacttaaagggcgggctgttaagtgtgttgtttcctgtgccccaaactctsntcgtgggccatcaaacagctgcctgccgccctcataacctccctcaacctccagcttgaaccacactccactgcagcccccgccccgctctvctgagtgtccatagtacctcactttttctggtagcccgca

SEQ ID NO: 9587 - DNA, 275 bp, Homo sapiens
  misc_feature 16: w=a or t
  misc_feature 17: w=a or t
  misc_feature 144: r=a or g
aaaattctagaactgwwgatgggttaagccacagacactgcttctcatctccatacctccgagctcctgacaggctgcagctggtaacgcctccccctcctggcccagcttgcctagctgccctcaccttgacaaccacagaaragccaaagactgcacacatgtgcaccacactatttatcctcctgcctgtgtttgctacagtagccccacaaaaaacataacaaggccacaacagagatgcgacacgtgccatgtaccaactccccacacaa

SEQ ID NO: 9588 - DNA, 198 bp, Homo sapiens
ctttttttttcagttcgtccatcttctagaaacgagtccccgagaccccgggctgccttcttggggctgctccgcctcctgaccagccctcgtcagccactcgaagtccctgaggagacgtggagaggaggagggacacggcatggggggagtccgggaagggagacgagcgtctgaagacgtcctcccgagggcaga

SEQ ID NO: 9589 - DNA, 263 bp, Homo sapiens
  misc_feature 147: d=a or g or t
  misc_feature 148: k=g or t
  misc_feature 263: w=a or t
cactctgttgcccaagctggagtatagtggctaagtcatagctcactgcagcttcgaactcctgggctcaggccattctcctgcctcagcctcttgagtatctaggattataggccatgctccaccacacctggttaacttcatttdkattttttgtagagatgaggtctcactatggtgcccaggctggtcttgaactcctagaccaagtgatcctcctcctttggcctcccagactgctgggatcactgcaccggccaccw

SEQ ID NO: 9590 - DNA, 253 bp, Homo sapiens
  misc_feature 163: b=c or g or t
aaatggttttagtgctctctttctttccagaatttctgctttcacttattttttttattgtggtgaatgaaacatatataacatcaaaattatttttaagtgaacaattcagtggcattaaatacattcacattgttgcatgaccatcaccaccatccatctbcagaacttctcatcttacaaaactggaactgtgtacccattaaacagaaactccctattaccccctactcaccaacccctaatccctggc

SEQ ID NO: 9591 - DNA, 218 bp, Homo sapiens
tcgtatttttttggtagagatggagtttcaccatgttggccaggcttgtctcgggctcctgacctcaggtgatccgcccgcctcggcctcccaaagtgctgggattgcaggcatgagccactgcacccggccagtggtaaatttttttagggccttttatgtggtctgttctggaaagacctgaggagcgagttgtgagaatgttcaggggaagagca

SEQ ID NO: 9592 - DNA, 311 bp, Homo sapiens
  misc_feature 182: k=g or t
  misc_feature 199: s=g or c
  misc_feature 200: n=a, g, c or t
  misc_feature 278: s=g or c
tcgttcctgtttgttgttctgggtgttttgaacagagacagaagcagtgtgcttctgagtgcagttgtgcagattttgaggtcctgggcattcgtcagcccggtgtctgctctcgcccctctgcgtgatgagcggcaatcctcagccagctcctgctgtgaggagtaagacaggtgctgtgkcttggcctgcatgatgsnccccccagcccgtcctttcagccggacatgatgctcccctcaccccatcctttcagctgggcatggtgctcccccacsccatcctttcagccgggcatggtgctcgccccc

SEQ ID NO: 9593 - DNA, 202 bp, Homo sapiens
gaagccactgtctctaggattgagaagatagaattactcctcacctcatctcttttttttggggtgggggatggagttttgctccccctgcccaggctggagtgcagtggtgcgatctcagctcactgcaacctccacctcccaggttcaagcgattctcctgcctcagcctcctgagtagctgggactacaggcacccgtg

SEQ ID NO: 9594 - DNA, 138 bp, Homo sapiens
actatttctttctttctttctttcttttttgagatggagtcctctgtcgcctaggctggagtgtagaggtgcaatctctgctcactgcaacctctgctccccggattcaggcgattctcctgcctcattctcccgaga

SEQ ID NO: 9595 - DNA, 311 bp, Homo sapiens
tagggtgagagatggggatctagttttattcttctgcatatggatatccagttttcccagtaacatttattgaagagactggcctttccccaatgagtgttcttggcacctttgtcaaaagtcagttggccgtagatatgtggattaatttctgtgttccctgttttgttccattggcctatgtgtctgtttttatgacagtaccaggttgttttggttactacagctttgtagtttactttgaggtctgttagtgtgatgcctctagctttgttctttttgctcagtgttgctttggctattcagggtca

SEQ ID NO: 9596 - DNA, 187 bp, Homo sapiens
tgcgatctctgctcactgcaagctctgcctcccgtgttcacaccattcttctgcctcagcctccagaatagctgggattacaggcgcccgccaccacgcccggctaaatgtttgtatttttagtagagacggggtttcaccgtgttaactaggatggtctcaatctcctgacctcgtgatccgccca

SEQ ID NO: 9597 - DNA, 243 bp, Homo sapiens
  misc_feature 44: k=g or t
  misc_feature 45: k=g or t
atgtgaaatctttagtgttgtgagcccttaaaagggacagaaakkgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcac

SEQ ID NO: 9598 - DNA, 214 bp, Homo sapiens
  misc_feature 129: w=a or t
  misc_feature 132: k=g or t
  misc_feature 176: s=g or c
acaaaggtttgtttcttggaaatgaaactatggagatgtcattggctcaagtctgtatttcctggctctagttatcttcagctgtggccttctagagcacagagctatacgtctgcattgctttttgcwctktcaacagcaaggaatgaatggtctcagtgtcattcactgggacsttgataaggttttgtttacataatttttatagcaatat

SEQ ID NO: 9599 - DNA, 178 bp, Homo sapiens
acttttccacagtggctgcaggattttacatttccagcagcagtgtatgggagccagggtaggttcagaagacattgtgttagaaactttaactttattggagcaaagtttgcttctaatcatttccatctcttttaaatttccatctttttaaatgtggttttagggtgtgaggcgc

SEQ ID NO: 9600 - DNA, 151 bp, Homo sapiens
ataatattttggatatattaaatatattactgcaattaatttcacccgtttctttaaaaaaaattttttttaatgtggctgttagaagaatcttttgtgtgtggctcagactcagatttcagattatatttcttatttttttttttttttt

SEQ ID NO: 9601 - DNA, 283 bp, Homo sapiens
aaagaggacggctttctggtatggcgcggcctttgtctcttgctgccgctggagctccagatctcttgttcactgctctgtgttctctgctcatagaggcccagcctctgaggccctttgacctgcaggtattgggagatccacagccaagagccaggaccccctagaagtctagaaatggtaagagtaccggtccaacatccccagagaggggagggactggttgatgggaagtggcagtggcgggactcagggctccccgcagtcagctccacaacctgcc

SEQ ID NO: 9602 - DNA, 315 bp, Homo sapiens
  misc_feature 149: y=c or t
  misc_feature 150: y=c or t
agtctctgaaccttcacagctggtcacattcagctcggtcacttcctgtaagattccaggcactgcatgcactgacatgggtgcgtgtgggcccactgggtcctgcctgggagccttccctgaatgttcattttttgcaggtctgtgtyygtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccaca

SEQ ID NO: 9603 - DNA, 137 bp, Homo sapiens
cgagatatagtttccatgccataagattgaacattttaaagggtgtaattccgtggcctttagtacatttgcagcattctataacattaccattgtctagttccagaacattttcatcgcgctctaaaaccctcaca

SEQ ID NO: 9604 - DNA, 230 bp, Homo sapiens
gacagggtcttgctccgttgcccacactggagtgcagaggcacaatcttggctcactgcaacctctgcataccagcttcaaatgatcctcttgccttagcctcccaagtagctgcgactacaggcatgtaccaccaagcctggctaatttttgtactttttgtagagacagggttttgccatgttgcccaggctcatctcaaactcctggatttgagtgatccacccgcc

SEQ ID NO: 9605 - DNA, 188 bp, Homo sapiens
cactgtgcttcaccttgcatgtttgtttgtttgttttttgagacagagtcttgctgtgttgcccaggctggagtgcagtggcgagatctcggctcactggcaagctccacctcccgggttcacgccattctcctgcctcagcctcccaagtagctgggaccacaggcacctgtcaccacacctggccg

SEQ ID NO: 9606 - DNA, 132 bp, Homo sapiens
tattatctttcgtcctcccagaatttgtcctttacctaaaaagttttagaaaagcctttaaggcaacattccttctaagcattcattctctttcagcagctctgtttcccctgaatatttattgcacccttc

SEQ ID NO: 9607 - DNA, 190 bp, Homo sapiens
  misc_feature 27: y=c or t
  misc_feature 71: s=g or c
  misc_feature 78: s=g or c
  misc_feature 85: r=a or g
  misc_feature 110: s=g or c
  misc_feature 154: m=a or c
  misc_feature 186: m=a or c
  misc_feature 190: r=a or g
cactgtgcttcaccttgcatgtttgtytgtttgttttttgagacagagtcttgctgtgttgcccaggctgsagtgcastggcgaratctcggctcactggcaagctccasctcccgggttcacgccattctcctgcctcagcctcccaagtagmtgggaccacaggcacctgtcaccacacctggmcggr

SEQ ID NO: 9608 - DNA, 288 bp, Homo sapiens
  misc_feature 99: w=a or t
  misc_feature 101: w=a or t
  misc_feature 102: r=a or g
  misc_feature 111: r=a or g
ccctaatatcaaaagctatgactttgttctagatcgatggctctcctgcgtctctgtggattcttccctccttgtacagatagctgtatgtgttttccwtwrtggggtcarccctttctggagactggaagacccatgagactgatcttgtattcttggcctatctcaaacacaataacttctcttcttgagactctctggtgttttttttgttttgtttagttttgtttttgacctagtctcactctgtcgcccaggctggagtgcagtggcgttatctctgctcac

SEQ ID NO: 9609 - DNA, 287 bp, Homo sapiens
  misc_feature 90: k=g or t
  misc_feature 140: k=g or t
ttctcctaatgctatccctccactagttccccaccaccctgacaggccccggtgtgtgatgttcccctttctgtgtccatgtgttttcaktgttcaactcctacttatgtgtgagaacgtgcagtgtttggtttttctgktcttgtgttctacttgcttttaaaagtgatacatgatcactgagaaagttttgaaaatatagcaaagaataaagaagaacataaacaggtacataaaatctcaacactcaaaacgattgtcaaaattttggtgcttttcttgattat

SEQ ID NO: 9610 - DNA, 332 bp, Homo sapiens
tgtatcaaaactttgtcactggctacttgtttctgatgagtaaaactaaaaccctctcagtgatccacaagacgccacacagcctgggggccccttcctccctttgtcctcccgctgacctcatctgctgtatttgtccatcttgttcgcttcactccaggcagaatggcttcattcctcaggtacgtgaggcgccctccacctcaggacgtctacactggctgattcctctacctaggatgctgttccagcagatgtccacgtggcttccttcagtttcccattatcagttaggccttcctggccaccatatctaaaattgtaacaccgcc

SEQ ID NO: 9611 - DNA, 309 bp, Homo sapiens
  misc_feature 88: r=a or g
  misc_feature 89: k=g or t
  misc_feature 253: v=a or c or g
atttttagtagaggtgggtttcaccatgttggtcaggctaatcttgaacttctgagttcaagtggtttgcccacctcggcctcccgarktgctgggattacaggtgtgaaccactgcacctggccccattcttatcagatttaaccttcagtgagatttctctcgttcactctgtctgaagttgctcttcctctgattcctctccccttaatgtgtttttagttcatggcacataacacaatctgaattttcvttatcatttactattgttttttccttcttggaatgtaagctcattaagcccggacg

SEQ ID NO: 9612 - DNA, 235 bp, Homo sapiens
taaagaaatcaagagctgttgattgttagggagcttttcaaagaactctatttcaacactgtcctctcccccgacatctctttttgttgttgttgttgttgttatggagttgctgtcgtgcaggctggagtgcagtggcgagatctcggctcgctgcgggctctgcctcccagtttcaagagattctcgtgcctcccgagtggctgggaccacaggtgcccgccatcccaggcct

SEQ ID NO: 9613 - DNA, 356 bp, Homo sapiens
  misc_feature 100: r=a or g
  misc_feature 104: s=g or c
  misc_feature 306: s=g or c
atgttctcctgccctctgttcatgctaatcttccccgacctttttttctttctttcttttttattttaagatgggttctcactctgtcatccaggctggragtscagtgttgtgatctcggctcactgcaacctctggctcctggattcaggcaattctcctgccttagcctcccgagtagctgggattacaggcacgcgccaccacgcctggctaattttgtatgtgtttttttaattagagatgggggtttcactgtgttggccaggctggtctcgaactcctggcctcaggtgatctgcccasctcagtctcccaaagtgttgggattacaggcgtgaccaccaggcccagcc

SEQ ID NO: 9614 - DNA, 398 bp, Homo sapiens
  misc_feature 95: y=c or t
  misc_feature 101: m=a or c
  misc_feature 104: s=g or c
  misc_feature 108: r=a or g
ctatccatcaacacatcacccaacttctaaatttcctctatggccagggatatcaggttttacctacaaaggctcaagtagcccaaacccaagtyactaamccstggractcaccctaacccctaattcttgagccatgccagcccgatggaaggagctaatacaggatgtgccccttccccacaccaagaaggacccttcctttttgggccttgttgggtacttccagctgtggatcattaactttggcctgttgaccaaaccactctgcacggcatcacgtgggtccatcctagaacatttggacccagcttgcccattaactcccacttctaaaaactgaaagatgcccttttaatgtcccagcactaggactacccaattccattaaacccact

SEQ ID NO: 9615 - DNA, 188 bp, Homo sapiens
  misc_feature 99: r=a or g
  misc_feature 100: w=a or t
ttattcttttgtgttttatgttccctaaaacattgactgcattcatgataagtgcttggttgatgctgatctgggagaaggtgatcttcatctggaggrwcctcctgatgcagatgagtgcagggagctttggggattctaggtaatgaaaaggatcttctgagaatcactagacaagattggaacca

SEQ ID NO: 9616 - DNA, 315 bp, Homo sapiens
  misc_feature 15: s=g or c
  misc_feature 95: r=a or g
  misc_feature 302: y=c or t
  misc_feature 311: y=c or t
gattacaggcgtgascaccgtgcttggccattaggatttcttataaacataaatgtctactgaaaaaattattattattattattattactgagrcagagtttcactcttgttgcccaggccggagtgcagtggcgagatcttggctcactgcaacctctgcctcctgggttcaagcagttctcctgctcagccttccgagtagctgggattacggcatgtgccaccatgcctagctaatttttgtatcattagtagagatggggtttcaccagtcagccaggctggtctcgaactcctaaytcacccgcytcgt

SEQ ID NO: 9617 - DNA, 402 bp, Homo sapiens
  misc_feature 398: k=g or t
aataataaatgttttaggttttgcaggtcaggtggcctctgttgcaactactcagttttactgttgtagtgtgaaatcactgtagaaaatatgtaaacacattgataccactatgttccatgaaacttcttctacaaaaccaggctatggcaggataaagcccatgggctctatgtagtttatcgactcttggtctatgagaagatatttcacattcagactttgtctagttagggtgactgttatattttcattgggcaaaatttgccatagagcagcagtcctcaacctttttggcaccagggacccgttttgtggaagacagttttccacagaccggcattaggggatggtttcaggatgattcaagtgcatcacatttattgtacactttattkctat

SEQ ID NO: 9618 - DNA, 245 bp, Homo sapiens
  misc_feature 223: d=a or g or t
tttgagatggaatcttgctctgttgcccaggctggagtgcattggcacaatcctggctcactgcaaccttgaactcctgggctcaaatagtcctctcaccttggcctctcagagtgttggcattagaggcgtgagccactgtgcttggccccgtaagtctttttaaatttttgtcaatgtaatttgtgaaaaatgatatcacattattttattttacacttcdttggtagtgaaatgcagcaacc

SEQ ID NO: 9619 - DNA, 376 bp, Homo sapiens
  misc_feature 96: m=a or c
acggcgtgctccctcccctcgctgctcaccttggttcccaagagccgggcggccgcaagacggggtcttgccatgttgcccaggctggtctcgaamctcctgtgctcaagtgatctgcctgccttggcctccaagagtgctgggattacagctccgactcagattttgaacggatgtttgcatgtataccacagtgctacattaaaaaccagtcatgtggatgtggagaagggtgctgatcaggactccctgtttgctaacaaattctacagcagaaacaaagtattaaggtttgcagccaggaagcaagtgcatggggaataagcctgcagcttcttccaaatgagacagagccaaatcttttttctgagtctgt

SEQ ID NO: 9620 - DNA, 219 bp, Homo sapiens
  misc_feature 88: m=a or c
  misc_feature 90: s=g or c
cactaataaatatatattgactgaatgaaagaacaaacatgttatctttctgaaagaatatattttttggccaggcttggtggctcamgscttgtaatcccagcactttgggaggccgaggcgggtggatcacgaggtcaggagatcgagaccatcctggctagcatggtgaagccccatctctactaaaaacacacacaaaaaaaattagccgggcct

SEQ ID NO: 9621 - DNA, 442 bp, Homo sapiens
  misc_feature 94: m=a or c
  misc_feature 98: m=a or c
  misc_feature 101: y=c or t
  misc_feature 102: k=g or t
  misc_feature 217: k=g or t
  misc_feature 218: k=g or t
  misc_feature 243: k=g or t
  misc_feature 244: k=g or t
  misc_feature 354: r=a or g
  misc_feature 361: w=a or t
  misc_feature 362: k=g or t
  misc_feature 363: s=g or c
  misc_feature 395: m=a or c
tatattcacattcctactcattctccatatccccaatacagctcattgtcactgctgccattgctcttgattagtgtgatcacggccaccaaamctamcaykgctgcagatgagacggtgtggtgtgcaaatcactgtgtgctctaaaatactagaagtaggaataacctatttaagaatatcatgtaggtttgtgcaattctttcctcccttcttkkcttctttcttcctttctttttcttkkttgttaggaaaccccttgtgattagttttgatcagaatcatgcaacagcaaagaaagcacaccccagagattcctcatagagtttttgcctgcagctcctaggctgcagrttttacwksctttctgggaggaaatgagctaggtgtgatgmgatgactaagacagtaactggcaaacatctcagatgcagtgatcaga

SEQ ID NO: 9622 - DNA, 257 bp, Homo sapiens
aaggatttttgtttgcttctggatttaattatttctttgattcctaacccagggcaacatttggaatcttttaagtttcataaatactttttaaactggtaccctgggattatcttgtcactatatatatgtgtatatatatttttgttttttgagacaaagtcttgttctgtggcccattctggagtgcagtggcacaatcatggctcactgcaaccttgaactcctgggctcaggcagttcttccaccccaccga

SEQ ID NO: 9623 - DNA, 319 bp, Homo sapiens
  misc_feature 165: y=c or t
  misc_feature 174: k=g or t
  misc_feature 179: k=g or t
  misc_feature 213: k=g or t
  misc_feature 249: y=c or t
  misc_feature 251: k=g or t
  misc_feature 268: y=c or t
catgcaaacattgattaacttttgatagtttaattatggccattcttgcaagactaaggtggcatcccactgtggttttaatttgcatttccccggtaattagtgatgttgaacatttttcatatgttttttgggcatttgtttatcttcttttgggaattatcyaatcaaggkccctkgcccactttttgatagattttttttttgtgtttkgtttttttgctgatttgtttgggttccttgtagatyckgaatattagtcctttgycagatcatagtttgcaaatattttctcccactctgagaggtgtctgtttac

SEQ ID NO: 9624 - DNA, 249 bp, Homo sapiens
ctggagtgcagtggcgtgatctcggctcactgcaagctctgcctcccgggttcatgccattctcctgcctcagcctcccgagtagctgggaatacagacgcccgccaccatgcccggctacttttttgtatttttagtagagatggggtttccccgtgttagccagtgtggtcttgatctcctaacctcgtgatccgcctgcctcggcctcccaaagtgctgggattacaggtatgagccaccgcgccc

SEQ ID NO: 9625 - DNA, 245 bp, Homo sapiens
  misc_feature 165: s=g or c
  misc_feature 237: n=a, g, c or t
gtggcttccacccttgttaatgatgctcctgcctctgcctcccagcccctcacccagcacagctctgcctggacttggagagatgggaggcagacccccaccaccatacatgctgtctgtggcccctcagacattctgtttcatctcccattcatctccctcctsccaccgtgtcagtttttctgcctttccctgctctgttcttccccctccttaggccccagcctgggcccaaanccatccgt

SEQ ID NO: 9626 - DNA, 154 bp, Homo sapiens
tattttttttgagacggagtctctgttacccaggctggagtgctgtagggctatctcagctcactgcaacctcggcctcccgggttctcaagcgattcttctgctgcagcctcccgagtagctggcattacaggtgcccgccaccacgcccagc

SEQ ID NO: 9627 - DNA, 340 bp, Homo sapiens
atgttctcctgccctctgttcatgctaatcttccccgacctttttttctttctttcttttttattttaagatgggttctcactctgtcatccaggctggagtgcagtgttgtgatctcggctcactgcaacctctggctcctggattcaggcaattctcctgccttagcctcccgagtagctgggattacaggcacgcgccaccacgcctggctaattttgtatgtgtttttttaattagagatgggggtttcactgtgttggccaggctggtctcgaactcctggcctcaggtgatctgcccacctcagtctcccaaagtgttgggattacaggcgtga

SEQ ID NO: 9628 - DNA, 311 bp, Homo sapiens
catatggatctacctcattcattttctttctttttttttgagacacagtcttgctctgttgcccaggctggagtgtagtggtgcaatcttggcttactgcctccaccttcccggctcaagcgattctcctgcctcagcctccagagtagctgggattacaggtgggtgccaccaagcccggctaattttttgtatttttagtagagatggggtttcgccatgttggccaggatggtctcaaactcttggcctcaagcgatccacccacctctgcctctccaaattacaggcttgagccactgcgccctccc

SEQ ID NO: 9629 - DNA, 320 bp, Homo sapiens
  misc_feature 311: k=g or t
ccaagtagctgggaccacagatgcctgccaccacgcctggctcatttttgtatatttagtagagacggggtttcaccatttgttggccaggctggtctcgaactcctgacctcaagtgatccaccctcctcggcctcccacagtgtgggattacaggtgtgagccaccgcacccggcctgtcttaagtgattatttattttctccacattattatcagtgcagccatcattacagctctggaaagtacacttttttcttcttggatcttcatattctttaaggaacaaaatcatttgttgatgcaaatgtkttaaataat

SEQ ID NO: 9630 - DNA, 408 bp, Homo sapiens
  misc_feature 107: m=a or c
  misc_feature 297: d=a or g or t
tatagtttgtttttaaattgtcttttatatttatttgtatttggtaagaatcggttgttacacaagctgttctttcccagttacaaaatcctgtgttcggttgtaamctggaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacdtgtttagctccatagaggaaagaatattaaactttgtattttaaaacatgattctctgaggttaaacttggttttcaaatgttatttttacttgtattttgctttaggtac

SEQ ID NO: 9631 - DNA, 441 bp, Homo sapiens
agggaccatgatgtgtcaatcattcccctttcctgtcagttcctttcccaaagtcaacaaaagatgtcaactttctgcaccttagtctagttaacctctccctgttgccttcccatccccatacaaatttctcaacccatactcattgtttctatgttgttgccaaccactcacctccaaactttctgtattctggttcctaccttcaccactataattgttctcatcctgatgctaaatccgatggaaactcccaggttcttctcttatcttctctggcatctggccctccttgcagaacctgccctcctttgtcttctgtgccaccattatcttcctattctactctgacctacctgcagtgtttcttcttcctctgcctaccctgctggtttctttgggatttcatctgagtgtttaagggtattttgtccttgatcc

SEQ ID NO: 9632 - DNA, 327 bp, Homo sapiens
  misc_feature 33: s=g or c
  misc_feature 84: s=g or c
  misc_feature 87: y=c or t
  misc_feature 88: m=a or c
  misc_feature 106: m=a or c
  misc_feature 109: k=g or t
  misc_feature 111: n=a, g, c or t
  misc_feature 112: n=a, g, c or t
  misc_feature 189: n=a, g, c or t
  misc_feature 265: r=a or g
  misc_feature 290: r=a or g
  misc_feature 299: m=a or c
  misc_feature 309: b=c or g or t
tacttcttgtgtggatcttcagttacttcaggscatctggatgtatacgtgcaagtcacaggggatgcaatggcttggcttagsgcymagaggcctgacagtgtgmtcktnnctcactgcaaactctgcctcctgggttcaagcaatttttgtgcctcagcttcccgagtagctgggattacaggtgcncgccaccatgcccagctaatttttgtatttttagtagagacatagagtttcaccagattggccaggctggtctcgractcctgtctcacgtgtctgtgtgragagaccamcaaacatgcbttgtgtgagcaacatggc

SEQ ID NO: 9633 - DNA, 335 bp, Homo sapiens
  misc_feature 93: s=g or c
  misc_feature 107: r=a or g
  misc_feature 138: n=a, g, c or t
  misc_feature 139: s=g or c
  misc_feature 155: k=g or t
tacacgcagctaatttttgtatttttagtagagatggggtttcaccatgttgtccaggatggtctcaatctcttgtcctcgtgatccacatgsctcggcctcccaartgctgggattacaggcgtgagccactgtgcnsagccaaaataattttktattttttatttatttttttgagacagagtcttgctctgtggcccaggctggagagtagtggtgtgatctctgctccctgcaacctctgcctcccaggttcaagtgattctcctgcctcagcctcctgattagctgggattacaggtgggcaccaccacacctggctaatgtttgtttgt

SEQ ID NO: 9634 - DNA, 153 bp, Homo sapiens
  misc_feature 99: m=a or c
tagatggggaggaaagtctttgaagaggaacctctgctttacttcttacaagtgtgcttactgattctctgtcagcttgtcctctcagtgattgagaamcagggtattaaaatcattactgagtttgtggttttgtgtatctgtctgtgtagc

SEQ ID NO: 9635 - DNA, 385 bp, Homo sapiens
tgcatttttaaaaatagctagaagaaaagaactttaatattcccaaaacaaataaaatataaatgtttgaggtgagggatatcccaattaccctgatttggttattattcattgtatacagttttcaaaatatcacatgtacccccaaaatatgtaaaactgttatatacaaataaataacaaaactaaaaataacagctgtgcaaacatttttaaaaggcttgctttaaatgggtttcacatgaaagtaggaaaggactctctggagtctttaccatctttatgtgagaaacacattggtcccagtggtctctttacctttcttagtccatcctttcactctgtacatctttctgaactcaatgaattatacactattgctgcc

SEQ ID NO: 9636 - DNA, 355 bp, Homo sapiens
  misc_feature 242: v=a or c or g
aagtgctatttctttacagcgtcagggaacaagcatttcaaacataggcatgcaccaacacacccagctaatttttagtggagacgtgctctcactgtgttgcccaggctggtctcaaactcctggcttcagaatcatcctgccttggcctcccaaagtgctgggttacaggtgtgagccacctcacctgactaatcaaagcattattttgtttttgagatggagtttttgctcttgttgcvtaggctggagtgcagcggtgcgatcttggctcactgcaacctctgcctcccaggttcaagcgattcttcggcctcagcctcccgagtacctgggactataggcgcacaccaca

SEQ ID NO: 9637 - DNA, 330 bp, Homo sapiens
  misc_feature 34: r=a or g
  misc_feature 72: v=a or c or g
  misc_feature 86: m=a or c
  misc_feature 87: r=a or g
  misc_feature 98: v=a or c or g
  misc_feature 99: w=a or t
  misc_feature 107: s=g or c
  misc_feature 111: w=a or t
  misc_feature 112: v=a or c or g
  misc_feature 159: s=g or c
  misc_feature 160: k=g or t
  misc_feature 305: r=a or g
taaatataatgaatataatgtgtatagaaaaggraggcggtggacaggtgtggtggctcatgcctgtaatcvcggcaactttgggmrggccgagggtvwagtggatsactwvagtccaggagtttgagaccagcctgtgcaacatggcaaaaccccatskctacaaaaaaatacaaaaattaactggatgtggtggcttgttcctgtagttccagctacatgacaggctgaggcgggaggattgacagagctcggggggcgaaggttgcagtgagccaagatcacacaactgcattccagcctgrgtgatggagtgagaacccttctcaa

SEQ ID NO: 9638 - DNA, 367 bp, Homo sapiens
  misc_feature 68: r=a or g
  misc_feature 328: n=a, g, c or t
  misc_feature 329: s=g or c
cacgaaactagaaaactttttttttcctcttgctggccgtggtggactagatagatggacgtcggcarctcccggcccagcctccatactgcggtctttttactcgttctatctgatgagaactcacactagcttgtttacaagatgacgacagtccaagggcagccttgggcacctgccatgtccctcctttccccagctatccccgctctgaccttgattttcattcttatgtttttctcttttcccttcagagctcacacagtggtcaccattgtggcaagcggctttctgggtctcagccctctctgcggttgagggcccagansacagagagatggacatgcgtcccctccctcccaccgcc

SEQ ID NO: 9639 - DNA, 135 bp, Homo sapiens
  misc_feature 49: r=a or g
  misc_feature 50: k=g or t
  misc_feature 117: w=a or t
gctgttctccttttcccattcgtcttctgtcacttccttcctggacgcrktttctggacgagtctggttacttttaatccgaccggccgctgagagccactttctcctcctcctccwcctcctccttctcgtccg

SEQ ID NO: 9640 - DNA, 476 bp, Homo sapiens
  misc_feature 390: w=a or t
  misc_feature 470: w=a or t
  misc_feature 471: w=a or t
gttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagtttttgattttgtagaaattagcttttgtctaggcaactagtggttatactcwgcaaatattgtaatgaatttttacttttttgatttttgtaataaaaattggtgcagataaaatgtcaaatgaacaaaccwwtgttc

SEQ ID NO: 9641 - DNA, 368 bp, Homo sapiens
  misc_feature 330: n=a, g, c or t
  misc_feature 332: n=a, g, c or t
gagcttccgggtttatggattcgtgggctgcttccacctgctaggagggtggtgtactctaactcagggacagaagcccctgtctgtgctcaggactcttgcagacctctttacctggctgttcatcttccataatcaactggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtngntgatggatgaggtggtgctgacaatcgagcaaggaa

SEQ ID NO: 9642 - DNA, 298 bp, Homo sapiens
  misc_feature 31: w=a or t
  misc_feature 277: n=a, g, c or t
  misc_feature 278: d=a or g or t
  misc_feature 279: v=a or c or g
ttatatcccacatcttatctaccttggcagwcttggctttattttcaaaatatatgcagaacacttcctaccacctccattgttagcaccctgattcaagccaccatcatcttttgccttgattattgcagtagcttcgtaacagcacttccagctttgacccttgcgtcctataatctgttttccacagagcaacaagaacaattcttttttttcttttttttgagatggagtttcgctgttgttgcccaggctggagtgcaatggcacaatcttndvtcaccgcaaactctgcttc

SEQ ID NO: 9643 - DNA, 215 bp, Homo sapiens
  misc_feature 99: m=a or c
caccacgcctggctaatttttgtatttttaggagagatggggtttcaccatgttggccaggctggtctcgaactcctgtcctcaagtgatccgcctgcmtcagcctcccaaagtgctgggattacaggtgtgagcccccatgcccggcctctgttcttttgtatactatggaaatggtcataagttgtcaaggagataatatttttgtggccaat

SEQ ID NO: 9644 - DNA, 213 bp, Homo sapiens
aatattgcgtagtcgcacgtggaagtcccgactgaagttggacacttttcgttcgcagtggtgccaattctcagggttgtgtgattttctgcaccgatgcaggagtgagcaagacgccgtcgacagtctcccaagaacaattcccaggagctcggattccaagagccgcccgcgccctcgtttaccttcgctagtcgccctgcaaccccgcca

SEQ ID NO: 9645 - DNA, 187 bp, Homo sapiens
gagtttttctggagtcaccttgattctaggaataagatgatcccaatcccaaaatacagctttctttggtctctactgaatgcccaaaatgtagtgaggtgtttctcctctgagtggtcagaattcaaatatcccccagtgctatgtgagctctggcatctccattgagcttactgttcccctgcat

SEQ ID NO: 9646 - DNA, 342 bp, Homo sapiens
  misc_feature 128: n=a, g, c or t
  misc_feature 129: d=a or g or t
  misc_feature 130: h=a or c or t
  misc_feature 260: d=a or g or t
  misc_feature 261: n=a, g, c or t
tactttgtgtagtatttttgacgtttatccatgttttagcatgtggtggttcttccttttcttggcttagtaatattccattgtgtggatacatcatcttttgtttatccgtttgcgcagtttgtagndhcctgggttgtttccacctttgggctgttgtgaacaatgctgctgtgaacctccgtgcacaaggattttcttggggacctgtttcttcctctcattcttgcctcctaccactctacccattaccatatttdnccaaaccagacatcagcacactggctacgtgtgtgtttaggaaagcatctgtggagggaaacagcttgcctcatgctgccc

SEQ ID NO: 9647 - DNA, 326 bp, Homo sapiens
  misc_feature 119: n=a, g, c or t
  misc_feature 120: n=a, g, c or t
cacattcacaaagcaaacatctagtacatgtctttcacttcactttatgatagtgtattggatgatttgggcattacgatcacctcttaccacagcacagaacatacattcttcaacannattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccaccccccctccacacttcacgtcagctaca

SEQ ID NO: 9648 - DNA, 392 bp, Homo sapiens
  misc_feature 7: y=c or t
  misc_feature 129: w=a or t
  misc_feature 312: n=a, g, c or t
  misc_feature 313: d=a or g or t
tttagcycatttacatttaaggttaatattgttatgtgtgaacttgatcctgtcattatgatgttagctggttattttgctcattagttgatgcagtttcttcctagcattgatggtctttacaatttwggcatgtttttgcagtggctggtaccagtcgttcctttccatgtttactgcttctttcaggagctcttgtagagcaggcctggtggtgacaaaatctctcagcatttgcttgtctgtaaaggattttatttctccttcacttatgaagcttaatttggctggatatgaaattctgggttgaandtcgtttaagaatgttgaatattggcccccactctcttctggcttgtagagtttctgctgagattcgccgttagtctgat

SEQ ID NO: 9649 - DNA, 316 bp, Homo sapiens
  misc_feature 114: m=a or c
  misc_feature 123: d=a or g or t
  misc_feature 137: d=a or g or t
  misc_feature 138: n=a, g, c or t
  misc_feature 139: w=a or t
tagctaaaagcttgggattgtttcttgaagaacagtttacaaagctggtcaacagccttgtaagttgccttatctgttttctcttagtgtgggccctcattctaagcccataamtcagtgtadcaccaagctaggtdnwtggggtatattacttggcttaataatgcattcatttattcaggcagaaacttatacttatcaaggactatgtgtcaggcccaggactgtaggcaggggttttgagggctgtcctcctcgactctgtcttcagcctctccttttccaatccaacctatgcccttaacaaaactggagt

SEQ ID NO: 9650 - DNA, 308 bp, Homo sapiens
  misc_feature 22: r=a or g
  misc_feature 107: k=g or t
  misc_feature 109: k=g or t
  misc_feature 148: r=a or g
  misc_feature 149: r=a or g
attagctgttctgaagcccagraaattccatggacaccccctggaactgctctgcagttttactccaacctacacaatgctgaaacctcttcttgggtgaatttggkaktgtggtgtgtggtcttggtgctccaggtcgtgcagtggrrgtctgaagccaccccataccggcctctggagaggggtgaccctgagtggagctctgagacagatgctctcgttgggtcacgcctttcccattcctgaagaataagcggagtgcttcctgcagccgaagactccatgcccaagtggctgtaatccccccc

SEQ ID NO: 9651 - DNA, 189 bp, Homo sapiens
  misc_feature 30: s=g or c
  misc_feature 31: k=g or t
tcactcctgccctcctcttcctcctcctcskcctcctcctctgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgac

SEQ ID NO: 9652 - DNA, 234 bp, Homo sapiens
  misc_feature 92: r=a or g
  misc_feature 96: r=a or g
  misc_feature 98: r=a or g
  misc_feature 195: h=a or c or t
taccaccatgtattttccttcttttaagaatcacagacttacggtgtctgtggtgcattgcctccaaacagttgctttagtttgtacacacrcaarcrtgcagacatatatatgtttacatgtagatagctgtttatacagaagggtaagtccaatttctgttatttaaaaatggccaggtgtggtggctcacahctgtaatcccagcaccttgggaggcttaggtgggcagtg

SEQ ID NO: 9653 - DNA, 351 bp, Homo sapiens
  misc_feature 309: r=a or g
caaagagggagtggcttgtccccaccctacagagcagggctggagcctggtggggtccaggggcacagcaaggaggaggtcactgagctggggtgccagcctggggtctggcgtcggaggccgtgttctctcctctgtgctgttcctgctgccaggaatcccatgggaagaagatcggtgtaggctggggagagcttgagatgggtgtcaggtctcagaaccaccccagtaggcagaagctttggggaagttgagtttggctccaagaaataagaagcctttgcttccacgtcttatctctggtccctrcagaatgtcactgagaaagaaccattttgcactttttttttt

SEQ ID NO: 9654 - DNA, 155 bp, Homo sapiens
cttccttttcttctttcttgcagtgtcttctccacatctgtgtcctagaaacctttactgtctgcctgtggttttctctggtacctttatcttgacccttgtctgcccattctgccctgctttagggttatttctagctgtgttaccaccaacta

SEQ ID NO: 9655 - DNA, 174 bp, Homo sapiens
  misc_feature 95: m=a or c
  misc_feature 108: v=a or c or g
  misc_feature 149: v=a or c or g
  misc_feature 150: s=g or c
aattttgtatttttattggagacggggttttgccatgttggccaggcaggtctcgagctcctgacctcaggtgatccacccaccttggcctcccmaaagtgctgggavtacaggcttgagccactgtgcccagaccaccctacctgccvsccaccaccaatttttttttttttt

SEQ ID NO: 9656 - DNA, 248 bp, Homo sapiens
  misc_feature 95: k=g or t
catgtatccatttttgcttttgttgcctgtgctttcacattcatattcaaaaaatcgttgcccagaacagtgtcatggagctttttccctaatgkttttctgctagtggttttacagttccaggtgttatgtttaagtctttaatccagtttgagttgatttttgtatatggtgtgagatgaaagtctgatttcattgttctgcatgtagacatgcagttttcctagcaccatgtattgaagagacgt

SEQ ID NO: 9657 - DNA, 324 bp, Homo sapiens
tttttagtatttggtagatactaatatagccataccacccttttggctttcaactaatctgtctttatacttaaaagtatgctttttatagacgtgatagaactgggtctttcttgctttttaatccaatctgacaatctttgcctttttgttttgtttcactttttttgttttgttgtgttttcagatgggatcttgttccattgcccaggctggagtgcagtgatacgttcacggctcactataccttcaatgccctgggctcaagtgatcctcctacctcagcttcccaaggagctaggactacagatatgcatcacctaa

SEQ ID NO: 9658 - DNA, 140 bp, Homo sapiens
aaaccggcacaagtcttccatcccccctcagccattccttactgctctgggcaaccgccaggttaagcccatttgcactgggaaattggcgctgtttgggagaagagaaacagatcgattgcccttgtgactccccgccc

SEQ ID NO: 9659 - DNA, 328 bp, Homo sapiens
  misc_feature 121: r=a or g
atctttgcctatggagacttataatctggcctgattttgtactttccagccagagctaatccaacagggcttccattcgagagcttttgggatggtagaatgtactggtggatcctgtcargctgggtccttagaacacctgttcagatcagcacacacccacatgtcaaatggcagctttgtggatctttcattaatacaaagccttttatggggtagatggatgattagatagatagatagatagatagatagatagatagatagatagacagacagacagacagacagacagacagacagacagacacacacacacacacacaca

SEQ ID NO: 9660 - DNA, 237 bp, Homo sapiens
  misc_feature 112: w=a or t
  misc_feature 115: w=a or t
  misc_feature 117: w=a or t
  misc_feature 120: k=g or t
aggtgaatataaagggagaatggtgaaatgaattttctgaaattaattgctgtgtttatagtttttagccatgcatcggaatcacctcaggactccactcccaatcaattawtawawtckgggggaggaccaaggcgttggtatttttcagaagctccactggtgattctgacagcacagctaggattaagaaactgatcaatggtaacagcatgcctgttgcagaggagcttccct

SEQ ID NO: 9661 - DNA, 279 bp, Homo sapiens
  misc_feature 269: w=a or t
tttatggaaagctgtttttgttcctgttcctgttgccagttttcacatccttatatattattaaagatacagaatgggcttttaatagatcctacaggccaggcacagtggctcatgcctctaatcccagccctttgagaggctgaggcgggtggatcccatgaggtcaggagtttgagaccagcctggccaacatgacgaatccccgtctctgctaggaatacaaaaattagctgggcgtggtggcaggtgcctgtagtttcagctgwacgggaggct

SEQ ID NO: 9662 - DNA, 163 bp, Homo sapiens
  misc_feature 24: s=g or c
  misc_feature 149: n=a, g, c or t
ctgcctgttcttcgcggggaccgsctgctgatcggcatctttgtgctgctgtggtgtctttaccgccgggcagctagacagcggcccttcgcacatcaccggcttccggacgacggagatgaaccggttctgcatttggacgccccganagacccctacgacg

SEQ ID NO: 9663 - DNA, 235 bp, Homo sapiens
aaaaataaaggagcatacctggagagatcaaaagaggggctgtctgacctcagagactcatttcttgatgcctcttgactgcataattaaagttgtgactctctctcgtctgatctgtgtttgttcttccctggctcctgcccactaggttatcgggctgtatccagggatcaggcatgcttgggcaaccaaagaaggagtggccccccaaggtgctccccatctagcctgtcat

SEQ ID NO: 9664 - DNA, 274 bp, Homo sapiens
gtttcccgtcaagatggcggatactctcccttcggagtttgatgtgatcgtaatagggacgggtatgtgtagcctggtgcttcctggacaaagtttaggaagactgtcttgtttctgttttttctgtcagtggcgagttttgggacaaacatcgtgggtcgagagtgggagggagaactgaaaggaagtgaggtagtccggagtcagcgcgggagttggcagttacagggaggggctgggacccgcagtgcttatcgccatttgagtaggggtt

SEQ ID NO: 9665 - DNA, 162 bp, Homo sapiens
  misc_feature 17: r=a or g
  misc_feature 18: b=c or g or t
ttccattgtacatcgarbagatatatatgcacatatagtatctatattcatacatattatactcttgtgtgtagtgcacgtgctattggtggtttgtcttctttgttaggctgtgtctccctaagcccttgccccacccagagtttcccgtccccttcactg

SEQ ID NO: 9666 - DNA, 200 bp, Homo sapiens
  misc_feature 2: r=a or g
  misc_feature 3: r=a or g
  misc_feature 90: n=a, g, c or t
trrtttgtgcataccttcttctattagcaaaatgtcttctattaccagctttagaaataacggtgctgctattttccttggaggggtctngggttgacagacctgcgaaaggtctggatgtgttcagagaaataagcgatttttccaaggcccaggcctttgtactgctctaattctatccagaatgcttcggacggggt

SEQ ID NO: 9667 - DNA, 218 bp, Homo sapiens
  misc_feature 29: y=c or t
ccggctttgtcttctgggactcgcgagayaggctgggtagggttttgtctggcgcttttgcgcgggttccctggcaataagcgtcattttgttcgtttgttttgtattcaccttctattattgtctggattaccccgacaactggtgcgttacgacttaggagaaggaacaccagttcaaaccgcttataataaaagcaaaggggttgtgttaagtgt

SEQ ID NO: 9668 - DNA, 336 bp, Homo sapiens
aacaggctggagtgcagtggcatgatcgcggctcattgcagcctcgaactcctaggctccagcgatcctcccgcctctgcctctcgagtgggtgggaactgcaggcacgtatcaccatgcccagcaattttatcttattttttgtagagacggggactccctatgttgcccaggctggtcttaaactcctggactcaacaaatcctccagcatcagcttcccaaagtgttgggattataggtgtgagccaacaggccctgcctaacttttttttcttaaccagttgagaaaaggcatgtgagtgaaagaaacgtaatagagtcacccatcttctga

SEQ ID NO: 9669 - DNA, 317 bp, Homo sapiens
  misc_feature 303: r=a or g
gcaggcgctgaactgaccggacggagcgggcggctgtggcctcgccagctggtgagaagcgggcgagggtccgagaaaccaggtctccttatgttgcccaggctggtcttggaactcctaggctcaagtgatcctcccgcctcagcctttggagtggttacaggtttaaaaatatccttttttgctgaaggaacacatttgctggtatagtttcagaatgtcaagtactgtgtcctactggatcttaaattctacaaggaacagcattgccacattgcaagggggtagacgcttatactccargtatgtctcaaata

SEQ ID NO: 9670 - DNA, 268 bp, Homo sapiens
  misc_feature 95: d=a or g or t
  misc_feature 96: b=c or g or t
  misc_feature 97: v=a or c or g
  misc_feature 109: k=g or t
  misc_feature 250: m=a or c
cttcttttccccgttgcccacgcagatggctgttgatcttttctgcaacaaatccaggagtttctcctttttgttttataattgctccaatagadbvctttagggattkaactctctgctttttaaagcagaatcgccatcccaggtgtgcaaccacgaaaaaattagacatccgtgagagacaatgccctccatggcccagtttccaggcagagagaagcagctctgggctgaccgccaaggctccggmccgagagggtctttaagt

SEQ ID NO: 9671 - DNA, 384 bp, Homo sapiens
gttaatcatctgtatcatacccaagttcttttttttcttttttagaattttatttattttatttattttattttttgagacactgccttgctctgttgggctggagtgtctgtcgccaggctggagtgcagtggcatgatcttggctcactgcgacctccacttcctgggttcgggcgattctcctgcctcagcctcctgagtagctgggactacaggcatgtgccacaccacgacaggctaatttttgtatttttattagagatggggtttcaccgtgttggccaggatggtctcgatctcttgacctcgtgatctgcccacctcggcctcccaaggtgctgggattacaggtgtgagcactgcatccagcctatacccaagt

SEQ ID NO: 9672 - DNA, 271 bp, Homo sapiens
  misc_feature 81: v=a or c or g
caacagtgtcctgtgtgtgaaaactttatttttattttactactctcttatgtgtttacttgtcaaagaagtatgcttgcvatatatggattacttactcctgctgtggagttgatactggtaccatatctaatgccccctataaactgtttctttctttctcagtccctctgacttcactaatatagctgagaaataggaaataggaagtaaatatgagaacttttatggttccatgtattttacttaggggagaacctctcaggccggc

SEQ ID NO: 9673 - DNA, 389 bp, Homo sapiens
  misc_feature 301: w=a or t
  misc_feature 322: s=g or c
  misc_feature 324: k=g or t
cccctatcaatttgtgagtttgtataatgtatggaaattaactcagccctttgttgttctagttgtggttattttccccagtattctgttggtccttcaattttgtgtattatggtttggccatataacaaagaatgaatgtttatgtagtcaaaattatccaattattcgtattttctttatggccttccccactctgagatttaaaaagacaacattcctgtgttttcttttagtactttttggccttattttttgtgttaaatctttgacccacctacaatttattttgctttaagawgtgtaataaggatccagcttsckattttttttcaggtagctagccatttgttccaacaccattagtcaataatccatctcccgctccc

SEQ ID NO: 9674 - DNA, 164 bp, Homo sapiens
  misc_feature 14: k=g or t
  misc_feature 15: r=a or g
tactatttattcakracaattgatttgatgctaataataattttctttaaactctaccattcattatgtggtaactgtattgaacttactttatttggattttattttaatgtgactagatgtcaccacttcaaaaaatcaatttgttcttagaacctggttga

SEQ ID NO: 9675 - DNA, 373 bp, Homo sapiens
  misc_feature 154: r=a or g
  misc_feature 155: s=g or c
aattttacggaagacactggagcttaagtctgcagattagttttttgtctacaagcggaggcgactggaaaatcgagccaaataagcgttggataactctaaacagccaaagaagcttcaatgggatagggtccaggttcaccaaaggaggcarsaccagcaactgacgaaaccatagcgacggctgaccgaccatgactcgaggtacaagacgtcaaacctaaggctactaatcaacgtgcgtaagaagcggccccaaccgacccgggcgatgccaaccgcgcaaccactggtcgccgcgccaccccaggcccaggaatagcccagtccgcaacagggagacctcaaccagggagaggaggagcggggctgt

SEQ ID NO: 9676 - DNA, 453 bp, Homo sapiens
  misc_feature 117: w=a or t
  misc_feature 335: b=c or g or t
  misc_feature 337: s=g or c
  misc_feature 348: w=a or t
  misc_feature 453: y=c or t
catttgaattggtttcttttatggtcagtttactttcttccctctcccctccctttcctgcacatccccatccttgctatgcctttctgtcctcttttataatggatatatcttttwcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgcbasagagttttgcwaaatactctcttatttgctctagtgtactagtccagtagtgtttgcatgtggatgtctgtggatgacagttattgtagcactttggcagtgcactaaaattttgy

SEQ ID NO: 9677 - DNA, 180 bp, Homo sapiens
cttcttcaacctgtggctgtttattttcactttcaagcttttcctgttcttcctctgatgtcacttgtacttcttgttctgctttggatgtttgttcgttcttcctttctattgctttcttcacaacagaatctttcatttccatggtaggctttagggaaggatgtttttcaggagccc

SEQ ID NO: 9678 - DNA, 187 bp, Homo sapiens
  misc_feature 95: m=a or c
  misc_feature 122: m=a or c
  misc_feature 123: y=c or t
  misc_feature 127: s=g or c
  misc_feature 130: y=c or t
  misc_feature 161: m=a or c
  misc_feature 183: w=a or t
gatatttatcatagcaaaaagttgcaagtactggggattgacaaaattatcacaatggttatattattattattattattattattatttaatcmatcagtgtcttgctttgttgcccagamytggsttycaaatccctggcctcacgtgatcctcccgcmtcagcttcccaaattgctgggwccca

SEQ ID NO: 9679 - DNA, 239 bp, Homo sapiens
  misc_feature 127: m=a or c
  misc_feature 143: w=a or t
cattctcacccccgcccacctccttactccctccacccctccacctgcctccagccagaattgcacagccagctacttccagaatcgctggtccaaagaaatcacgacaggcgctaagtttggggcmaatccattttaatgcwactaagttgtgggatggtttgtttgagcagccccagataacaaacattccttgaggtcacatgctaaccaagctgtgattcgaacaccgccccccc

SEQ ID NO: 9680 - DNA, 147 bp, Homo sapiens
  misc_feature 133: s=g or c
taggcaaacttttctcttttttttgagacagagtttcgctcttatcacccaggctggagggcaatggcacgatcttggctcaccgcaacctgcgcctcccaggttcaagcaattctcctgcctcagccctccsaagtagctaggatg

SEQ ID NO: 9681 - DNA, 161 bp, Homo sapiens
gcttttctcgcggcacgggtggtggggctgcttcttgacttccgcgcctagtgcgcggggccccattctccagtcccgcccacgcgcctttggaggctgcggtgggatttccttttgccttcggttggggctgctgtttctcttcgccgacgtggatcctc

SEQ ID NO: 9682 - DNA, 281 bp, Homo sapiens
  misc_feature 148: y=c or t
ttcagacgctggctggcactccacgccagtgcacggctccatggaatgcctgctgttggacacttgcagagctctgccaccaagcaacctcctgcattggaaatcgggggactactccaggatcttatgcgtgcttgctgtttgaagytgcagaaaagtgaataatcaattaagtattgatttcttgtaagatttggtaaatttcaaaggcaagacaaagaggatggcttaaggaaacactgcagggacttggcgtaaattagacaactaacggaagcgca

SEQ ID NO: 9683 - DNA, 282 bp, Homo sapiens
  misc_feature 239: m=a or c
ttcattgccaaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagamcattttagccattgatgttcacacgtggcatcaagcccaatgc

SEQ ID NO: 9684 - DNA, 349 bp, Homo sapiens
  misc_feature 307: b=c or g or t
  misc_feature 317: m=a or c
  misc_feature 318: n=a, g, c or t
  misc_feature 319: w=a or t
tccatctatcagtaacaaaatctccaaggaacatgagccccaaagagcaaacccttccagcatcctgctggtttgcagatagtggcttcctacgcctatttgttgacctcctggcatctccattcctcagctttgcagattgggaaaaagagctttgtttttgaaatgataagtccacaggacaaagaaaccactcagaatcccggtcatctgggcaaccagccagagggatctgatcctgactgtgcagggcagatttttttttaagtcaggacttaaatgagaagaaggagataactaatataabtcttgaaatmnwaactggtttgggaaacttatcccccctgca

SEQ ID NO: 9685 - DNA, 170 bp, Homo sapiens
  misc_feature 120: y=c or t
  misc_feature 160: m=a or c
tttagccacttcctttctttttaatcctgctatcagagttgtcttccctaagtacatcattttctttttagacggagtctccgcaacctccgcctcctgggttcaagcaattctcctgcytcaggctcccaagttgctgtgactgcaggcgcgcgccacmacgcccgaca

SEQ ID NO: 9686 - DNA, 135 bp, Homo sapiens
agggtcttgctatgttgcccaggcgtgtcttgaactcctggcctcaagcagtcctcctgccttcctagtgctgggattgcaggcacgagccaccgggcccagcctccaggattccttttacctagcacctcccct

SEQ ID NO: 9687 - DNA, 158 bp, Homo sapiens
  misc_feature 143: m=a or c
  misc_feature 149: m=a or c
tttaagatttgttggattgctggatttgttgaagggagaactggaagaagctatcagaagtttacagggcatcggagggagacactccctttggccactttctccgccaaaactatcctggttttagcccaacagtttcccamgcccgmcccccaaac

SEQ ID NO: 9688 - DNA, 435 bp, Homo sapiens
attccttaaacttcgctcattatgaaatgttttaaaattatgacaaaaattactctgtctaaccacttgccttgtctgctaccagtttgttaaaaattattccccccaaccagtaattccaccagtactacttgatttgtgttatatttcctatgtacatgtacagcctttgttttgcttgcttgtctatttttactttcccttttttgggtcaaatttttcttttgctttgtttgaagaaggaatatacagaagtaaaatcttgtcttctctgctgattctttaattaatatgagccggatactttccactgtcttcttggcactttcaggatttcttaatgctgatatatggactcttagaatggaatttttgaagaaaaatctcaaagcctgtatcgttcttgaaggtcacatgtacctattgtgaaaatgt

SEQ ID NO: 9689 - DNA, 311 bp, Homo sapiens
tttgttttgtgtcgttttgttttgtttttgagacagagtctcactctgttgcccaggctggagtgcagtggtgcaatttcagctcactgcaacctccatccttgggattcgagtgattgtcctgcctcagactcccgagtagctgggattacaggcgcatgccaccacacctggctaatttttgtatttttagtagagatggggttttgccatgttggccaggcaggtctcaaactcctgacctcaggcagtccacccccctcagcctcccaaagtactgggattacaggcatgagccaccacacctgaca

SEQ ID NO: 9690 - DNA, 169 bp, Homo sapiens
  misc_feature 32: y=c or t
  misc_feature 100: d=a or g or t
  misc_feature 118: r=a or g
tcccaggtcccaggtctggtgcggtttcccgyagaggagcggagtggggtttgtcttctgtgtgcctgtgtcctcatctgattcacctgccatttgctgdgcctctgctgtgtaccargcgtggtgctcagccctagaggcagttgacttaccccctgcagccctccct

SEQ ID NO: 9691 - DNA, 138 bp, Homo sapiens
  misc_feature 2: b=c or g or t
  misc_feature 3: b=c or g or t
  misc_feature 126: m=a or c
tbbtggtacattcagtgtgtgaaagatctaaggttcattatggatttggaagtgatccagacttatatgtagtcttaacctttgtattgttaattctgatcagttccacatgtgatcagttcaaamgtacagccgccg

SEQ ID NO: 9692 - DNA, 434 bp, Homo sapiens
  misc_feature 16: y=c or t
  misc_feature 17: m=a or c
  misc_feature 402: m=a or c
  misc_feature 430: r=a or g
  misc_feature 434: w=a or t
agagacggggtttttymacgttggccgggctggtcttgaactcttggcctcaagtgacccacccactaggcctcccaaagtgctgggattacaggcttgagccattgtgcctagctgtaaatgttaaatctagtattcaaacctagcaaacctaggtgttctgatttctttttctgtttttggttttgttttccctgggatatagattttcaggtgttctgatttcagaacctgcattcctacccactgctgctgctcccctcactaatttgaaattctgtgtgtgaactaactttacttaaaaccgggcgcgggggcggaagcacttaagagtcagaatccatattagacatggggaaatgattggtgtgtaagcagtgaatttatatatagacataaagmctaaaatgtgggctgggcgtggaggggratcw

SEQ ID NO: 9693 - DNA, 274 bp, Homo sapiens
  misc_feature 144: w=a or t
  misc_feature 146: w=a or t
  misc_feature 148: w=a or t
  misc_feature 245: d=a or g or t
  misc_feature 246: s=g or c
tttcttggagacagtcttgctctgtccctcaggctggagtgcagtggcgcgatctcggctcactgctacaagctccacctcccatattcaagcgattcttatgtctcagcttctgagaagctgggattacaggtacctatttgwawtwttagtagagacagggttttgccatgttggccaggatggtcttgaactactgacctcaggtgatcctcacgcctttatctcccaaagtgctgcgattdsaggcatgaggcaccactcctggccacat

SEQ ID NO: 9694 - DNA, 287 bp, Homo sapiens
agaaagaaaagaaatatgaggtgctgggtgtggtggctcacacctgtaatctcagcactttgggaggccgaggcaggtggatttcttgagcccaggagtttgagaccaacctggacaacatggcaaaaccccatctctaccaaaaaatataaaaattagccaggcatggtgatggtgcacctatagtctcaactgcttgggaggctgaggtgggaggattgcttgagcccaggaggcagaggtttccgtgagccaagatcgcgccactgcactccagcctgggtgga

SEQ ID NO: 9695 - DNA, 318 bp, Homo sapiens
  misc_feature 220: b=c or g or t
  misc_feature 221: h=a or c or t
agctctgtttccctttcgctgtcgctgttctgctttttttctccttccttcactctttagagggaagactgaaatgcatttctcccacactgaaccatgaaaaattcatcatatatattcttgcacgacaaaagccacgactgggtcctgcacgctacactttctaggacagaaacgttccgtaaccctgtttgacagactgcagagacagaaacctgtbhgctcgctggggctccagctctccctctgcctccctcactcgcccccaacgatcctcagtggtgcccccttcttgtgcaccctaccctgccctccccc

SEQ ID NO: 9696 - DNA, 156 bp, Homo sapiens
ttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaaatgcttctcagtcc

SEQ ID NO: 9697 - DNA, 447 bp, Homo sapiens
  misc_feature 137: d=a or g or t
taaaatggtttcatgtatatcattttgttcaattcttaaacaagtcattgatctaaagacaattatcctcattttgcaagggaagtgatgagagtggccaagtgatttacccaaaaggatgttgggtagatgtggcdaagttcaccagtgcctgatgctattcccactatacccccgacggctttctgtttattcatgtttcctctaataatgataaaggcatggagcatattctttcctcaatggccttctaatttcaaattttcaccacaaaaaatgttttcgtagggcattttacaaataagaaaattgagatatcaaaattctaaagaagatgagttccctcagctgatttgtaacagagctagaagcagaagccaggcttcatgacaattatctccaaactatttttatagcagatgttctcctttgggtcttttttgtttt

SEQ ID NO: 9698 - DNA, 144 bp, Homo sapiens
ttcttttattttatttatttatttttgagatggagtttcactcttgtcacccaggctggagtacagtgctgcgatcttggctcactgcaacctctgcctcccaggttcaagtgattctcgtgcctcaccctcctgagtagcatc

SEQ ID NO: 9699 - DNA, 245 bp, Homo sapiens
  misc_feature 131: k=g or t
attttcatttaacaacctatcctgaatatcagttcatagagattttcctcattcttcttggtagtttcctagtgttctactgtggatttactgtaattcagtcactctcctatgtctgggcatttagggtkgttgcctaacttttgcatttacaaacaatgttgcaatgaatcatctgatacatttatattttcctattggaagtttagtaatcctggctcactttgggaatttctacaccaaca

SEQ ID NO: 9700 - DNA, 166 bp, Homo sapiens
  misc_feature 130: b=c or g or t
  misc_feature 155: d=a or g or t
caatcaaagcgtgctttttctttcatgtgaaaaaagaattttatctgtgaagctctgctgtgtttccttgccctacttagtttttgttgttgtttctgcttttttgtggcaggacacaggcagttcatgbataaggcttccctcttaaacccagdtacccgtacca

SEQ ID NO: 9701 - DNA, 261 bp, Homo sapiens
  misc_feature 15: k=g or t
  misc_feature 16: k=g or t
  misc_feature 212: w=a or t
acatctttagctcakkctacaattccccaccttttcccttgagtctatggctcctttactacatttataaaaagtcagcaattaaagacagcacaatggtggtccacttgactgtatatttaatatacatgctattaagctacttattgacagagacggtgattttttttttctgaacagccatctctgtagccaccaactccttgctttgwacttaacagacaccccataatttgttgaatgactgtaataccctcgccg

SEQ ID NO: 9702 - DNA, 448 bp, Homo sapiens
  misc_feature 210: d=a or g or t
  misc_feature 211: w=a or t
  misc_feature 339: n=a, g, c or t
cctctccatttgtctttgagccaaccctgaactggccctggtacctgagtaagagccatgcagggccatcagcagaacatggccttgtggttctcacccagttgtgtaccttacaaccacaacttctttttctttgtcccttttcccctttttggttttggttttgtatgtgggctctatgtaactcccatagtcagctgaactctcaadwggagaccctctttctctggcatcctagcacacaggcaattttttaagcctatatttatgctacattttcccccatcttaagaaaatttgctttgatttccattctcctactagcagcagctgatatancctgtagacctatgagcattttatctattctatcattgaagttactgataaagatttttgttgttgttgttgttgttgggagaaatggatttcccacaactaatccctc

SEQ ID NO: 9703 - DNA, 172 bp, Homo sapiens
ttaaattttctcctacttattttcttatattcaacttggtcacaatgcattttcaaaacaaagcgttcattttttgaccacaaaaaacagttcgttaatgaaccgtctcaacagaatacttttattttgctcaatgtctttcctttgaaactgttttttttttttttttttt

SEQ ID NO: 9704 - DNA, 226 bp, Homo sapiens
  misc_feature 106: s=g or c
  misc_feature 108: m=a or c
  misc_feature 109: y=c or t
  misc_feature 112: s=g or c
  misc_feature 119: k=g or t
  misc_feature 120: n=a, g, c or t
  misc_feature 122: v=a or c or g
  misc_feature 163: s=g or c
  misc_feature 168: v=a or c or g
  misc_feature 195: m=a or c
  misc_feature 217: m=a or c
cccgtttgcatcatctccagccggcggctgctccagggaggctgggcgcgatcctctccgcccgcggctccaacccgcactctgcgcctctcctcgcctttctcgsamytgsttcctgkncvaggccggagacccccggggcggcttcccagaacctgcggasacaavtggccgaccgacccattcattgggaamcccgtcttttgccagagcccamgtcccctgc

SEQ ID NO: 9705 - DNA, 191 bp, Homo sapiens
actgagcgtgcgcagaaccgacccctgcagccctttaggctgcggtgccaaagagtcggtcccgaagcggaagtgcttgttggggccaggctttgtaacggtctcctgagcagcgagcagaaaatctgttatcgagagagagtgaggttgagggggcaagtgctaggggtcgtgggctgagtgatggggct

SEQ ID NO: 9706 - DNA, 152 bp, Homo sapiens
agaggttttgtgtttgtttgcttgaatacaaatgtttgataagtctttttctgccccagtggcctgtttgcctgcctgaggagttacagttttgtcattgtgggagaaggggtggggggagggggagcctgcgaatttgaacggggtgagtt

SEQ ID NO: 9707 - DNA, 136 bp, Homo sapiens
  misc_feature 102: r=a or g
  misc_feature 103: s=g or c
agggtcttgctatgttgcccaggcgtgtcttgaactcctggcctcaagcagtcctcctgccttcctagtgctgggattgcaggcacgagccaccgggcccarscctccaggattccttttacctagcacctcccct

SEQ ID NO: 9708 - DNA, 345 bp, Homo sapiens
catggtcatttggcatttgcaacaggagctgaatttattaatagtactaatacctcatccttggacatccttgggttgtccgatatttttaaggggcatttacatcctttgtttttcatatggaaaacttttccgtaagggctggtatcatcttggccttccattgcaggaacagcacagggaggttcggtggctaggccacagttacccacgcagctaggtagcagcagaggccccacctggcaccccctggcttcctaagcacatcgcactgtgcagcctccctgaggaagcctcgagtggataggaactctggttctttaagataaacctgagttggatctc

SEQ ID NO: 9709 - DNA, 190 bp, Homo sapiens
ttaatttttctaagctttgttttttgtttttgttttctttcgagacggagtcttgctctgtcacccaggctggagtgcagtggtgcaatctcagctcactgcaacctgcctctcccgagttcaagcaattctcctgcctcagcctcctgagtagctgggattacaggtgcccgccaccacacccacgctg

SEQ ID NO: 9710 - DNA, 249 bp, Homo sapiens
ccttctccttctccttctccttctccttctccttctctctttcttcttcctcttcttgttcttcttcttcttcttcttcttcatttatttatttatttttattttactttaagttctggggtacatgtgcagaatgtgcagttttgttacataggtatacatgtgccatggtggtttgctgcacccatcaacctgtcacctgcattaggtatttctcctaatgctgtccctccccttgcctatgacccc

SEQ ID NO: 9711 - DNA, 212 bp, Homo sapiens
  misc_feature 26: s=g or c
  misc_feature 50: v=a or c or g
cacacacgcaccaaatacacacagasaccctggccctcactcacgcacavtctctcacactcgtggacacacccccagatgcatctttacactcatgtatgctggctcactctcacactggcacactcacacagcttgacccacacgcacacactcacacccagtcacacacgtacacactcacatacgtgtgcttgcctacacgcacacaa

SEQ ID NO: 9712 - DNA, 249 bp, Homo sapiens
  misc_feature 103: b=c or g or t
  misc_feature 245: d=a or g or t
ccttctccttctccttctccttctccttctccttctctctttcttcttcctcttcttgttcttcttcttcttcttcttcttcatttatttatttatttttatbttactttaagttctggggtacatgtgcagaatgtgcagttttgttacataggtatacatgtgccatggtggtttgctgcacccatcaacctgtcacctgcattaggtatttctcctaatgctgtccctccccttgcctatgdcccc

SEQ ID NO: 9713 - DNA, 320 bp, Homo sapiens
  misc_feature 100: m=a or c
  misc_feature 275: n=a, g, c or t
  misc_feature 279: m=a or c
  misc_feature 282: k=g or t
  misc_feature 295: v=a or c or g
tgttgttttttgttttgttttgttttgttttgttttttgttacagtctcgttctgtcacccggggtggagtgcagtgatgcaatcttggctcactgcaamctctgcctcccgcattcaagcgattcttgtgcctcagcctccctaatagctgggattacaggtgcccgccaccacacttagcgaatttttttttttgagacggagtctcgctctgttgcccaggctggagtgcagtggcgccatctctgctcactgcaagctccgcctcccgggntcamgckgttctcgtgcctvagcttcccaagtggctgggactaca

SEQ ID NO: 9714 - DNA, 151 bp, Homo sapiens
acaacatatttctctgcccgagctttgtgtgtttctttgcgtctcggggctcgttctgtgcaatgggaatggagaatattcagaatttgaggacaagcccggcgagccgactgcattcatagctaaaattaaaggaataagtgagcgcgca

SEQ ID NO: 9715 - DNA, 216 bp, Homo sapiens
tctttcgccaaagcaaacatttccaacaaggcgtatgctaaggggatattagaaagacagattttcttttccttttttttctttttccaaatacactgtgcattgggatttgggcagccagcccttcacacctgtactttttcctatattcatattctctatgtttttacctaatcttcttgctacttgctaccttcagctaatgagaggggccta

SEQ ID NO: 9716 - DNA, 194 bp, Homo sapiens
tatccgcggaggtactcactgttaaccagcttagaagccccctgccagcacataagctgctcctgggtgctcctcatttctggcggaccccgagcctgctcttcgtccatatctgggcctagttacaccaatctgggaaaggaggcttgtactggggggttcctagaagggcagcctctccccctttccatccc

SEQ ID NO: 9717 - DNA, 337 bp, Homo sapiens
ttgtttgttggtttaaccttacccagaagaactgattccctagaaagccaaagtcagagaggtgatggagtggcagttgtttttccttttcctctttggagctatcatttctattttgaagatgatgacttaccatcatcttcccttacagtgagaaatatcttgcatggaagacatctctgtggatgatttcaaggttgagtactagagctaagatgatgagaacttggcccacttcagttgggcagtgtgaaaagaaacagtgtgatttttgtcagtctttagagagtggttgtcattaagtcagtaaagcaagatcttcctctagttacaatga

SEQ ID NO: 9718 - DNA, 293 bp, Homo sapiens
  misc_feature 2: k=g or t
  misc_feature 94: s=g or c
  misc_feature 137: m=a or c
  misc_feature 204: m=a or c
  misc_feature 262: v=a or c or g
tktcccttggccctgccaacaccactgtttttacttctgctcattggctgagtgcagtggttcctggaagccagtggcacgtttccccgcgtastcgcttatcccacagcacacacccaagggttctgttgctaacmcgctgaattaattctttgctcatcttacagagtgtgttttgactgcccccatttctgaggccttgtmaggccagagctttgttgcttcatcggcaggttgggacttagatggccgtgaatgtttvctctctgctgctgcagtaagtaagtgcccgc

SEQ ID NO: 9719 - DNA, 268 bp, Homo sapiens
  misc_feature 208: s=g or c
ttataccggtttccaaggtgaagccatttgcagggtcgctgggtttccccctccccccgaaagtcttgcgcgacccggggtgggccggatagtgtgcagttttttgagccttgggctggggacctccaggaagctgaagcggaaattgcctaggcccctggggcattggaggtcctaccgcagctcctagtaggtggtgggggcgcasggctgtccccactcagtgctggtggggtcgcacgtaacggtcctgagctatgcataagca

SEQ ID NO: 9720 - DNA, 249 bp, Homo sapiens
cagttgggcattttggtattgactagatcaacagagattgttgttgttgtttttgcattgttttgctctataaaatgcatctcttctggaggttttcttttagaaagtgatagtgtgactggttgtgttagcttcaaaacttagaacattggtcaaaacaagacaaatgatgagtgcatgtggaatgacacaccgatgggcccctttcattaacgaaaatgatgggttccagtttggatattggactgt

SEQ ID NO: 9721 - DNA, 250 bp, Homo sapiens
gttgctgatccagctatggagaaagccgcaggtaggaggccaggagaaatcctctgcaggggactttgggacaggcagggggccaacttggaggctgaagctttgggaccagggcacacttgattttggggcttggagccctgaggcagatctgcaggacacagcctcgttaactctgaagtttaagtttaacccaaagctgggcattgataatcctgtcctctccctggccgaagaccacgacccccac

SEQ ID NO: 9722 - DNA, 316 bp, Homo sapiens
  misc_feature 313: k=g or t
  misc_feature 314: m=a or c
tattgtctcttatttattatctgtaggtttttatctgtatatgccaatcagtttcctttttcccatttccattttatatataagttattgcaggttacatttaaaatttatcctttaggtaacagaattgagtcagactgtaactgaattttagagagaaatcatataactagtgatggaataactgttgggaccgagtctcctaatttggaagaacgggtaagaaagtcatcttttctttgaaggatagcttttcttgacaggtggaggcataggaagttcaaatgtgggtagaaggttgtatataggagckmat

SEQ ID NO: 9723 - DNA, 246 bp, Homo sapiens
  misc_feature 201: w=a or t
  misc_feature 205: k=g or t
  misc_feature 207: k=g or t
  misc_feature 224: y=c or t
  misc_feature 233: n=a, g, c or t
ctgtttgttggtacttggtgcatgtttctggttgacagtagttggtatgtgtttccagttgatggtagtttgtacatgtgcctgtttgatggtacttgatatgtgtgcctgtttgacggtagttggtacacgtgtctgtttgacggtagttggtatgtgtttctgtttgatggtagttgctacgtgtgtctgtttgatggwagtkgkacgtggttctggttgayggtagttgntatgtgtgtctgt

SEQ ID NO: 9724 - DNA, 360 bp, Homo sapiens
cccaaatatttaattttaaccttgatttaatttttaatcttttgctttccttcactacatgtattcacatacacacattcacaggttttgcatataaatatccatttacattaagaggtcaagaagcttgggcactttggaaaggtcttggacaaagtgaggagagcagtgacaagtgtgattatagtcctgtaaaagtgaagctctataaagatcttccctcagtactggatgtaaatactaaatatttaaactcagaatcagtttaaatagatgtcctgcaggcactaaatagtggataaaatatagtttacattttaacaactagttattacataatctctttcaattttccttaat

SEQ ID NO: 9725 - DNA, 338 bp, Homo sapiens
  misc_feature 101: w=a or t
  misc_feature 102: w=a or t
  misc_feature 111: s=g or c
  misc_feature 291: s=g or c
  misc_feature 323: d=a or g or t
attcccctgtactcctgcctggcttcctgccccctttggcctgcgtgtgtccggttttgagtgacccagacctcctatctccttcctttccgtcccactcwwccatccttscctcccacccccactttacttctccccagattactagttgtttgtatagggcaggggagaggggcttggatagccctaccccctgctccagttcgaggttggggcggggtgggggctcagccctctgagcctgtgagtcagcactgtcctcacgattggtctctccccttagctccccgsccctggggaggagccagaagcgctgggtccadgctgttctcttctca

SEQ ID NO: 9726 - DNA, 205 bp, Homo sapiens
ctccctttccaatttgcatgctttttatttctttctcttgcctaattattctgagtagaaattccagtactgtggtgaatagaagtggcaggaggagatgttgctatcttgttcctgatcctagaggaaaagttcttagtttttcaccattgagtatgatgttagctgtgagcttttcatgtacgatctttatttactgaggaac

SEQ ID NO: 9727 - DNA, 155 bp, Homo sapiens
ccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccaac

SEQ ID NO: 9728 - DNA, 432 bp, Homo sapiens
  misc_feature 292: d=a or g or t
atggatgaaatgaaatgttatctggggtttgctttagatagagaggagataatagatgaaacaatcaacttattagttggtcattgtcgatactagataatgaataaatggacttctttataccattttactttcatactttatttgaaacaaggtcttgctatgttgcccagctggccttgaactcctggcctcaagagattctcatgcctcagcctcccagagctttgggattacaggcatgaaccaccatgcccagcccataatagaaagttttaaattttaaaataadagtattcatagacttggctatcatggatcctggtaaagtagactagtgaacataatcagatgtttcagtctttccctgttgatactgcttgccctctgagcccatttcctctcctgatcatcgcctgctatttccaatca

SEQ ID NO: 9729 - DNA, 287 bp, Homo sapiens
  misc_feature 96: s=g or c
ttttatttatttatttatttatttttgagatggagtcttgctctgtcacccaggctggagtgcagtggcgcgatcttggctcgctgcaggctccgscttctgggttcatgccattctcctgcctcagcctcctgagtgatgggactgcaggcacccgccaccacgcccggctaattttgtttttttttgtattttacggggtttcaccatgttagcttggatggtctcaatctcctgacctcatgatcccccccgcctcggcctcccaaagtgtgggattgcaggca

SEQ ID NO: 9730 - DNA, 301 bp, Homo sapiens
gaatgacttctagtttgtgtgcaactttggttcttagaagcaatgctgcaatgaagaattttttgttttgttttgtttttttgagatggactctcgctctgtcacccaggctggagtgcagtggtgccatctcggctagctgcaagctctgcctcccaggttaacgcctcagcctcctgcctcagactcctgagtagctgggactacaggtgcccgccaccacgcccggctaatttctttttgtatttttggtagagacggggtttcaccgtgtggccagaatggtctcgatcccctgacg

SEQ ID NO: 9731 - DNA, 159 bp, Homo sapiens
  misc_feature 106: w=a or t
cagggttgtatgtatacttcttgtgttgaatataataattatatccggccgggcacggtggctcacgtctgtaatcccagcactttggggggccaaggtgggcggwtcacttgatggcaggagttcaagaccagcctgaccaatataatgaaaccccga

SEQ ID NO: 9732 - DNA, 296 bp, Homo sapiens
  misc_feature 74: k=g or t
  misc_feature 216: b=c or g or t
cagagttcacttctaggatattccttcccaatcttcacagtcacctcatagtcactatgaggattacatgagtkaatatttgtaaaaagcgttcaggagagtgcttgcttcacatcaaatactatatatacttgttaaataaatagatctcattcaccccacgaaacaatgatcgtttgtctcctgattctcaagtttttgtctccagcagagacbtctattctgagctccatagctacatatggggctttttatttcatagttccactggaggtttcacaaatccttcaaactca

SEQ ID NO: 9733 - DNA, 383 bp, Homo sapiens
  misc_feature 56: n=a, g, c or t
  misc_feature 355: s=g or c
catttgtcacctaaggagtcatattagaaaatcacgcagcttagagccttattctncatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaascttgagttatgaaatacttttatattta

SEQ ID NO: 9734 - DNA, 423 bp, Homo sapiens
  misc_feature 125: d=a or g or t
ctagattttctagttaattgcaaagaggtatttataatattctgtaatgatactttttatttctgtgggatcaatggttatatcccctttatcatttcttattgcatgtatttgattcttctctdcttccttattagtctggctagaagtttatttattttcttgatcttttcaaaaaaccagctcctggattcattgattttttggacgggctttttgtgtctctatctccttcagttctgctctgatcttaaatcttgtcttctgctagtttttgaatttgtttgctcttgcttccctagtttttttaattgtgatgttacggtgtcgattttagacatttttctgctttctcttgtggggatgtagtgctgtaaatttccctttcagactactttagctgtgtcgtattttactttttaa

SEQ ID NO: 9735 - DNA, 387 bp, Homo sapiens
  misc_feature 93: r=a or g
  misc_feature 95: m=a or c
  misc_feature 97: r=a or g
  misc_feature 319: y=c or t
  misc_feature 321: n=a, g, c or t
  misc_feature 322: k=g or t
  misc_feature 329: n=a, g, c or t
  misc_feature 330: s=g or c
  misc_feature 331: m=a or c
tttatttcttatggtatgtgccttcctcctacttattcatagcactcttttcttttcttttctattctattcttttcttttctttttttttgramcrgagtcttgctctgtcgcccagggtagagtgcagtggggagatctcagctcactgcaacctctgcctcctgggttgaagcaattctcctgcctcagcctcccgagtagctgggattgcaggcatgtgccaccatacccggctaatttttgtatttttagtagagatggggttttgccatgtcagccaggctggtcttgaactcctggcctcaggtgatccacytnkccccccnsmcccgccttggcctcccaaagtactgggatgacaggtgtgaaccactgcgcccgggc

SEQ ID NO: 9736 - DNA, 390 bp, Homo sapiens
  misc_feature 113: r=a or g
  misc_feature 389: s=g or c
gcacaatgaatatttatttaatggctatactgttcctgtggttcaagtcccatgtatttagtatgtctaagttatgggcgactctggatctccaaaggcaaattagtcatggragaatctttagttttggaaaatcactatgttgcttctcaaaaagtatactagttacgacaaggtagtatttagtgtcttttacatcaacattgaggctggcacggtggctcacgcctatagtcccggctcttgggggggctgatgcgggtggatcacctgaggtcaggagtttaaggccagcctggccagcatggtggaaccccatctctactaaaaatacaaaaatcagccaggcgtgttggtgtgcgcctgtggtccagctactcgggaggcgsc

SEQ ID NO: 9737 - DNA, 324 bp, Homo sapiens
  misc_feature 213: k=g or t
gagcgcgatcctgacttgtgtccgggtggactgaaatatcatttttacaaatggagaaaatgagatcgagatggacagacatagcaaggtgataatgtccgactcaattatttctactgggaatgactgaaaggtaaaggaatcgttaatgaatctggagatgacagaggcatgctttatttaatttttaaattagtaaggagtgcagacttkgggtggtggagagcaagggttttttttgttgttgttgctgtttgtttttgtggggttttttttctgctggttattgccaagtataatgactttctttaaatccgaaggaac

SEQ ID NO: 9738 - DNA, 399 bp, Homo sapiens
tacattttactcaaacttgctagcagccaatgtaaaccaagagtggactttttttccacattttgctgtccctgttgctcatgattttgtaaaagactaaaattgtaaaagcacattctgagcatggccaagtttttcaggtaaagtgtcactgagggaaatatgagtctgactctaggcccttgaccttttctgccttccatgaggtatcaggtctgccttcctatagccatcttgtttgctcattctgttggtcacaccagtggttgggtttggagtggagatggattgacgcagagcctcactggtggaaggcaactcaagcctcatgtcctgttgctgatgggtcaggaacagctatagcctacatgaagggtgtcatttttaattcaagtgctc

SEQ ID NO: 9739 - DNA, 388 bp, Homo sapiens
caatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttggtatgttgactgttaatgatgtacgtttctatagaaatgtcaggtccaaccatttcccatttgttcgactatgtggtctgttacatttatggcttaaagtcttttctcttaaacagttaaaaaaa

SEQ ID NO: 9740 - DNA, 410 bp, Homo sapiens
  misc_feature 284: d=a or g or t
  misc_feature 285: s=g or c
  misc_feature 287: d=a or g or t
  misc_feature 288: k=g or t
  misc_feature 347: d=a or g or t
  misc_feature 348: r=a or g
  misc_feature 382: r=a or g
gctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggdsadkggcttgtagaatcagaagctaaagatattacttgcttgtccctccttcccgtgactgadrctcagaatgcagtcgctaatgttaccagatgatrctacaaatcattctaactcctccaagga

SEQ ID NO: 9741 - DNA, 326 bp, Homo sapiens
aaaagtgctaggcaaagagtgttccaggaagaaggaatagcatgtgtgaaggctctgctctgctgctgaaattgtggttcagtttattgagtatggcatagaatgaatagtgcctgatgaggcaggaggtaggctgggatgagatcttttcagatcttgcactctgtactaggaagtttaggttgtattctgagttactggggagccattaaagggtttaaggaaggggagtgttgtgaatcagttatgtgttttgcagattctactctgactacagaatggatgagagcagaatgggagttagagcaaaagaaatgaggaaatca

SEQ ID NO: 9742 - DNA, 422 bp, Homo sapiens
tattcatgcctacagacctacagggtggttgtattgggttgatgtattttttattgctctttcactatatgaattacttcttttttttcagttaaccacttacacttgtgcaatccacagtagaatatcaatatttgtggtttgggttatttaaataatgtgtgtgagaaatataaaaagcaaataaaccataaaataatagaagaaggaactctcaatctgtacttattggaatgattttatacttgattatagggagttcaaattgacaggctgggtgtgtaggatatgctcctctcaacactctgtaaccatgatcggcttctcacacttatttccagcctgaggttccttgcctcttttatcatcttttgataaatctctatagcggtgctattgtagtatagctcacttgctaataa

SEQ ID NO: 9743 - DNA, 316 bp, Homo sapiens
  misc_feature 29: y=c or t
gctctggaggctcctttgattctctagayctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttcttttt

SEQ ID NO: 9744 - DNA, 386 bp, Homo sapiens
  misc_feature 207: b=c or g or t
tgaagaaactgaggcacaaggtggttaatatttggagttgccctctggctccagcatctgttctggcaccatgtgctttcctcttggccatgtccctcctgtgccttcttgaactggcccttaactctcatgtccacatgctcagccccagggctggggctctaagggagaggcccctggcagctgttcttctcttccaggattgtbgctgcacggctcaacggttcccttgatttcttctccttggagacccacactgccctcagccccctgcagtttagaggtcggagggcctggggtgggcaggtgttcacacttggtgggacgggcaggggccgtctacccattgctttctcagagattcttcacttggccttttgtcctca

SEQ ID NO: 9745 - DNA, 209 bp, Homo sapiens
cgtgttcaagcgattctccagcctaaccctcccaagtagctgggactacaggctcccaccaccacgcccagctaatgtttgtatttttaggagagacggggttttcccatgttggccaggctggtcttgaactcctgacctcaggtgatccacccgcctcggcctcccaaagtgctgggattacaggcgtgagccactgcaccgggcct

SEQ ID NO: 9746 - DNA, 377 bp, Homo sapiens
  misc_feature 197: n=a, g, c or t
  misc_feature 198: y=c or t
tttcattttaatttggatattactttgtcaaagattaggcaacgtaattttggcaaggtgttatttttggcagtgcacttacgaatgggtgagtcagcctggctgtggatgcatcattggtggcagggcaccatgggtttctttctttgtccagaaatagacactggtctctggactggtgacacttcaggaggctnyagatgactgtactgggtgcgtgtatagcagccttctatgaggaactaaaggggccacctcatcttggcctctagataggactctattctttaatgagtccttcagatatgtgggttcgagtcccatagggagagaaaaaacttttcccaaaaagttaaaatagagtgatcttttgtgat

SEQ ID NO: 9747 - DNA, 415 bp, Homo sapiens
  misc_feature 206: d=a or g or t
actgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctggdtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgctttttttgttttcattggcttggtagatcttccgcatccttttattttgagctatgtgt

SEQ ID NO: 9748 - DNA, 271 bp, Homo sapiens
aaaaaactgcattgggagaatttgctgctgcggggggactctttctgaggttactgtggagcacccaaagtctgtcagcctctggccgtgcaaacaggcacccagaggaaccagaccttgcttattcacccacagcctgggactgtcttctccagagtctccatcagctttgctaatcgactgattggaaataattcctcaaacaccaccaagtcaaggatacaggcagcagcggctcccctgttgtatggacattctgcacccgaaaccg

SEQ ID NO: 9749 - DNA, 334 bp, Homo sapiens
  misc_feature 299: n=a, g, c or t
tgcattatcactagcaatgaatgagagttcttgttctacatcttgtcagcatttggtattgtcattttaaaattttagccattctaaaaggtgtttagtggtatgcaattgttttaatttgcagttctctaatgacatatgatgttgaacatcttttcatatgcttatttgccacctgtgtatcttctttgatgagatgtctgttcagatctgtcacccatttttatttcagttagttttcttattgttgagttttaatagctctttctacattttggatatcagtcctttatcagggngatagtgtgtcttgcagatattttcgcccaatcat

SEQ ID NO: 9750 - DNA, 329 bp, Homo sapiens
  misc_feature 82: m=a or c
  misc_feature 146: b=c or g or t
  misc_feature 268: b=c or g or t
tgttgttcccctttgttcctgaagggtggttttgtcctatatggaatttggccttgacagttctttttctttaacatttgamaaatgtgccatttctttctggcttccatgatttctgatgagaaatctgatggcattcaaattabtgttccccttaaaggtaatgtgccatttctctttggctgcttttgagatttttttctttgtttttaattttctaaacttgacttatgatgtatcttttatttttattttttcccacttaggbtttttctcagcttcttgactctgtagatttatgtcttttgtcaaattgtgaagttttcagc

SEQ ID NO: 9751 - DNA, 357 bp, Homo sapiens
  misc_feature 83: r=a or g
  misc_feature 90: y=c or t
ccctttttcctcctgccagaatccaagccacagtaaaaatcccagagcacaggctcgccctcttccagaaagggattttctgratatgtycttcactcttccccgaccccaggtggacatcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggat

SEQ ID NO: 9752 - DNA, 233 bp, Homo sapiens
  misc_feature 6: r=a or g
  misc_feature 11: w=a or t
  misc_feature 119: n=a, g, c or t
  misc_feature 121: r=a or g
  misc_feature 128: n=a, g, c or t
  misc_feature 132: y=c or t
  misc_feature 232: w=a or t
gacgartcggwctgtggtagcggcggcggcggcggcggagcctgggtcggtgtctgcgcgctggtgtctgaggcccaggctgaggcctccgctattgctggagcgcaggcggcggagangratgactncctyctgccattctctcttgagctagcgagccgccgccaccctccaccctcccccggcagggcggagaggagcggccggagtcagcgatggtgcccggcgagawa

SEQ ID NO: 9753 - DNA, 422 bp, Homo sapiens
  misc_feature 309: n=a, g, c or t
  misc_feature 310: b=c or g or t
  misc_feature 397: w=a or t
cccgggcctttgtcttgggtgaggggagatttgcacctagacacttcttgaaaggagacactcagtttcacaagtgagccctcttgcccagcacacacctatggctggctgggcaaggcgctcaggcatgcaaccatgggcaccaggcaatacccatccatcacccatctcactctccccagtcctcaggcagcagcttttccaccccaggaatctctgttccttctctgtctgcctctccacagcccgtgatcccctgcttctggctcctaccactggacagtcattgtggatagagcagcctgctgnbctcaggaccagagaagggaaatgacttctccaggcagaggcagatctgagtctagaacccaggcttctaaatttctaggccagtacwctgctctcaaaagagattactggga

SEQ ID NO: 9754 - DNA, 370 bp, Homo sapiens
ccatgattgctaggatggctcacagaactcagggaaacacatatttacatttactgattcatgataaaggataaggatattacagaggatatagttgaacagccagatgaaaaggtactcagggcaaggtgtgtggaaagaggttcagagcttccatgccttctctgggtgcaccatcctcccagaacctttgcctggtcagcagcccagaaaccctctgaaccctgcacttcagagatttttatggaggcttcatcacgtaggcaggatccattattaattcaatctccaatccttccacccttctcaaaggctgtagagcagggctgaatgctccaaccttctaatcatgatttggtcttcctgatga

SEQ ID NO: 9755 - DNA, 365 bp, Homo sapiens
  misc_feature 97: s=g or c
ctccgcgacccccactcctcctcggctgttccccaaccctgtcactgtgctcccctccctactcccggcccgtagtggaggtgactttcctgcgcasgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgagattcgtgccccactggacggtttgcgaaggctgaggctgccttggggactcacaaaagaccacaggggtgattcgaagtgtaaata

SEQ ID NO: 9756 - DNA, 232 bp, Homo sapiens
tatataaggtcatgtcatctgcagctgcaaacacagggacagtttgacttcttcatttccaatttggatgcccagaactactttgtcttgttctggctaggacttgcagtagtatgttgggtaagagcagtgagagtgagatccttgtccaggtacagttactggaggaaaagcttttatctttctcttgttgagtaagatgatagctgtgggtttgtcatatatggcactc

SEQ ID NO: 9757 - DNA, 183 bp, Homo sapiens
agcatatttgatcactttgattctctgttcttttctctccgcggtgtgtgtgtgcgtgcgcgcgtgtgtgttttcttcttctcctcctcctcctccccgagttgcctcctttctccgggtgccgtactgccttttttcccctctttcattctttctctccgtctttttctcccccctctgcgc

SEQ ID NO: 9758 - DNA, 207 bp, Homo sapiens
cctgtattttctacttttgttttaactggagcctcagctgaaaaggtttatggtgctgctattcagttttatgaaccatactctgaagaagaatctcacagaaaagcagagacttcttttgggtttaacatcagcagatgggaagtctgatagttccaaaacaattcatactaacaaatgcatctgtcttctttctcactggcccgt

SEQ ID NO: 9759 - DNA, 374 bp, Homo sapiens
  misc_feature 8: m=a or c
  misc_feature 111: h=a or c or t
  misc_feature 112: m=a or c
  misc_feature 113: m=a or c
  misc_feature 199: r=a or g
  misc_feature 210: n=a, g, c or t
  misc_feature 211: n=a, g, c or t
  misc_feature 276: w=a or t
  misc_feature 277: s=g or c
  misc_feature 298: r=a or g
  misc_feature 329: v=a or c or g
  misc_feature 340: n=a, g, c or t
accaaagmaatataaatcattttattataaagacacatggctgcatatgttcattgcagaaatgtggtatgttttcttcatgtagtacatgaaatactatgcgtccataahmmtgaacagttgttatgtcctttgcaggaacatggatggagctggaggccattatccttagcaaactaacacaggaatagaaaagcaratactgcatgnnctcacttacaagtgggagctagatgatgagaaaacacggacacatagaggggaatgacacaaagwsttcaatttcatatatcagaarataaagggtgggagaagggagaggatcaggvaaagtaactancagatattaggcttaatactgggtgatgaataaa

SEQ ID NO: 9760 - DNA, 224 bp, Homo sapiens
ttttgtttttgtagagacggggtctccctatgttacccatgctagtcttaaactgggctcaagcagtcctccctcctcagcctcccagagtgctgggattacaggcttaagccaccatgccaggaaagctcttaattagagattagtttgttaacactggcttgagtacttgagtgaatgatggtgccatttcctaagtcaggaaacactagagaaaagcaata

SEQ ID NO: 9761 - DNA, 327 bp, Homo sapiens
atatgagtgcagccagcctccatgaatcacatggacctaaatggcaaacagatcaggtttcacagaggctgttattcctccccatggaagccctggcttgtagagagggactatcacttggggtacgcagctcagtgttttggacagggacagttcttgtgttagtatttgtaatttcttttgccatcccactttctgaaaatagctttcttgtgtaaagaaatctcttctctcatgttggccagaatgactgtcttcacctctttttgagagagtcattcacttcttttagccaaaaccctattgtattgctagttagagtgagcc

SEQ ID NO: 9762 - DNA, 303 bp, Homo sapiens
aaacatagtaattgttaaataattgtcagctattattaatcctggctggcttttatcttgtatttgtcctctattagtattttaaggtgtcatttcaccttgtataaaaataaaatgggtataaagggtgatcatattaagcagagaaatttttatgttatgtttttatttatttcatcctatcctctgcttcacgctggcatttgtcagcctgcatgtctttccctggcttcccttaaaagagaagtggtaggtattcagcattaaaacacaagttctccatctttgactccagcggtccca

SEQ ID NO: 9763 - DNA, 183 bp, Homo sapiens
  misc_feature 17: w=a or t
  misc_feature 65: w=a or t
  misc_feature 66: r=a or g
  misc_feature 67: r=a or g
  misc_feature 68: r=a or g
  misc_feature 129: r=a or g
  misc_feature 131: w=a or t
  misc_feature 172: r=a or g
ttttttatgacatctawttatattgagttgcatgcatgttttgttcaacatagtcacaacaaatwrrrataaccattttgggttgttagattttgttgtgcagtgttgtgattcattaagaaaccatargwggtcatttcagtcatcttacttgaggctaaatcattcatgrcatacatgtgt

SEQ ID NO: 9764 - DNA, 322 bp, Homo sapiens
  misc_feature 103: w=a or t
  misc_feature 106: s=g or c
  misc_feature 123: w=a or t
  misc_feature 124: w=a or t
  misc_feature 126: k=g or t
  misc_feature 128: w=a or t
  misc_feature 258: r=a or g
  misc_feature 261: r=a or g
  misc_feature 299: y=c or t
  misc_feature 301: r=a or g
gatgttaataatatactgatatttgtgtctgttgggaaaaaaagataatgacggtaaatggcactagcagccatagcagttcattatggctatcatttgctawtgstgtaagccaaagtaatwwgktwaaccacctcattttaaattatgtcttaacttcaagcacagtggtttccctgtttgttttacagaaactagaaaaactgcttttggaattatctctacagtgaagaaacctcggccatcagaaggagatgragrttgtcttccagcttccaagaaagccaagtgtgagggcygraaagaatgccccagtctctgt

SEQ ID NO: 9765 - DNA, 210 bp, Homo sapiens
  misc_feature 71: y=c or t
  misc_feature 72: d=a or g or t
  misc_feature 73: n=a, g, c or t
  misc_feature 102: r=a or g
  misc_feature 106: v=a or c or g
  misc_feature 118: h=a or c or t
atcagatttttgccgcatcacattgttccacagactgaatgctgtgttcgtatcgattgatgaaacgtgaydngtccgccaattgctcgtttgcactgagaraggvcaacagtttgahacttacttttgtgtgtgtgtggctttggaagccagtagctacttccttagttcagttctttactgttcctcgaataatctcctgactaaggc

SEQ ID NO: 9766 - DNA, 327 bp, Homo sapiens
attctttaaacttatggtgctctagtaccccagtgttaagtgctcagtggctaagtgttcttccctggagacgtggaaaatgtgcttttttctcatcttttttctttctttgtttctcttttctctctcttttttctgtttgagcatatgaagatataaaacacttttaagcaaacattagtgataaatgtccagaatagtctgattataaaacatttatttttaagtttgcttccacacaagccattatgtaaagaatagccccagattaggttgactatggattctttgcaaagcttttttttcttttcttttctttctttcttt

SEQ ID NO: 9767 - DNA, 354 bp, Homo sapiens
  misc_feature 187: w=a or t
  misc_feature 209: r=a or g
  misc_feature 300: s=g or c
  misc_feature 301: r=a or g
  misc_feature 323: h=a or c or t
  misc_feature 339: k=g or t
ttgcattatcagaggtctgatatgtaatttattgtaaagaaattaaatatatagaggctcaattaaaaaataaccatattctcaaacctccattaccactaatatcttggggttgtcaatgatagactatatatatatatgtatgtatatgtgtatatatatatatatataatttttttttttgagwcggagtcttgctctgtcacccrggctggagtacagctcacagcaacctctgcctcccaggttcaagcaattctgcctcagcctcccgagtagctggaattacagacgcctgcsrccacacccagctaatttttcghattttttagtagagakggggtttcaccatgt

SEQ ID NO: 9768 - DNA, 419 bp, Homo sapiens
attgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggcctgtggagtcacatcccggcctcatgctcggcataggggacgctgcttaggtccatgcagtcgctcagggcccaggctgtgcagcgcca

SEQ ID NO: 9769 - DNA, 269 bp, Homo sapiens
  misc_feature 75: k=g or t
catttagcacaccattataattaaaaataaagaatttatgtgtgtgttccagaagcccttgattcctagaatttktgtttagaattccagattagtccagcactgcctcattcacttcaattatttattattattattattatgattttgagactgagtctcactctgtcaccgaggctggagtgcagtggcatgaaggatcttggctcactgcaacctctgcactctccccgcctacttccccctaccccctactcaagcaatcctcc

SEQ ID NO: 9770 - DNA, 267 bp, Homo sapiens
  misc_feature 80: m=a or c
  misc_feature 110: y=c or t
  misc_feature 254: y=c or t
gtaaatgctatgaccataaagccattactgttaacacttaagtttatcttctgaaagaagcctatgaaatatctccagamagactaggggattttcttctgtttgtttgyttgtttgtttgagatggagtttgctctgttgctcaggctggagtgcagtggtgcgatctcggctcactgcaacctctgcctcccaggttcaagtcattctcctgcctcggcctctggagtagccaggactacgcactgcgccaycacacccagctac

SEQ ID NO: 9771 - DNA, 301 bp, Homo sapiens
  misc_feature 81: d=a or g or t
  misc_feature 82: b=c or g or t
ccaaatgttcccttttgtatttttttatttttttgatacagagacttgctctgttgcccaggctgttgtgtagtggcacgdbcttggctcactgcaatctctgcctcccaggttcaggcgattttcctgcctcagcctcctgagtagctgggatgacaggcacgcgccaccatacccacctaatttttgtatttttagtaaagaccatttcaccacgttgatcaggctggtcttgaactcctgacctcgtgatccacccgtctcagcctcccaaaatgctgggattacagactacagacgt

SEQ ID NO: 9772 - DNA, 347 bp, Homo sapiens
atcatgctctatattcttttattaatagagacagggtcttgctatgttgcccaggctggtcttgaactcgtagcgttaattgatcctcccacctttgcctcccaaagcacttgtattatagatatgagccaccacacttaccatgttctttaccaaacattttgtggaagaggtgtagaggtggcaaacaattataaatttaagatatgttcactgtggagtagagtatgattatttatttatttagagatggagtttcgctcttctcgcccaggctggagtgcagtggcacgatcttggctcactgcagcctctgccttccgggttcaagtgattctcctgcctca

SEQ ID NO: 9773 - DNA, 239 bp, Homo sapiens
  misc_feature 234: w=a or t
  misc_feature 235: y=c or t
tgcaatgggtggtgttttataatgctctcttccctaatcatgttaatcaggagattttccttttggaactcctgactgaaagcttcttagtttacacacatgttcctccaggatgaacgctgaaaataactttttcggttttgtttgtttgtttgttttcctctatacaaccccttgcaattgctttggtttagaacacctttggattctaagtttcatggttgttctgggagwyacca

SEQ ID NO: 9774 - DNA, 242 bp, Homo sapiens
  misc_feature 27: y=c or t
tgtttgtttgtttgtttgttttcaggyagaggaaacagtgtgtgcaaaggctccaaggcaggagaaaaattgttcaagaaatgcaagaatgccagagctgctggagcactgagtggggccgagagggataaagatgaagctggagaattaggcagcaacagagaatagtcattctgtgacctgtctagtgattcccttgaagaccctacttgaaaggcttgtcttttttttttttttttttt

SEQ ID NO: 9775 - DNA, 410 bp, Homo sapiens
  misc_feature 71: m=a or c
  misc_feature 398: n=a, g, c or t
attttttctataagaatgtggcctatgtgaacctccttttctggtaccagttcttttgtggattttcaggmacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggcatacttaccccataccttctggatcaccttattggatgctttttatcaaagcctggtctgcttctttgtgccttattttacctaccagggctcagatactgacatctttgcatttggaaccccctgaacacagccgctctgttcatcgttctcctccatctggtcattgaaagcnagagtttgactt

SEQ ID NO: 9776 - DNA, 397 bp, Homo sapiens
  misc_feature 364: w=a or t
cattgtggggatatgacattttttacctcttaccatatatcgattctcacccaccccccattttttgaaacaaggtcttgctttgtcacccagggtggagtgcatggctcactgcagcctcgacctcctgggctcaagcagtcctcccacttcagcctcccaagtagtcaggaccacaggtgtatgccaccatgactggctaattgtttaatttttttgtagagatggggtcgcactgtgttgcccaggctggtctcgaactcctgggctcaagctgtctccctgccttggcttctcaaagtgctaggattgcaggcatgagccaccacactcagctgattccctttttagtaaatctactagwctatgacttatttgttaataattagagtagcac

SEQ ID NO: 9777 - DNA, 272 bp, Homo sapiens
  misc_feature 108: d=a or g or t
  misc_feature 164: n=a, g, c or t
gttgggatgtagggtaaatttttgaaaattactcttaacgttgtaagattttagatgcatgcctttatgcttggtgagcctctgcattcgagtatttagccctgcgcdtatttttattcccaggaagagagaagggcacagttacctaagtatcaacgtaatcntcctcggccaggacaggcccccatcggtaatccaccagttggaccaattggaggtatgatgccaccacagccaggcatcccacagcaacaaggaatgagacccccaat

SEQ ID NO: 9778 - DNA, 415 bp, Homo sapiens
tagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgattatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgt

SEQ ID NO: 9779 - DNA, 374 bp, Homo sapiens
  misc_feature 100: r=a or g
  misc_feature 322: y=c or t
ataaaccttactttaacagaatttaacagatatctctttaaaaaactgctttaatgtttttaccttctatcttctttttctccagctttatcctgacagrgaagttagcactaattaatctattttctcttccccctcttttttcccttgtgtgtgtcttttctgccttcatctaccccagtgaatttgttcagcattttggctcactcatttcttcagctaactacagcttactactacagccaccactactagagccactcctgtctcatcctggatggttgacagagatgaaaacatcttgctaaagcaaatatacagycccctttcactggctctccagtcctcctgctgtctttgcttgacctcctgca

SEQ ID NO: 9780 - DNA, 340 bp, Homo sapiens
  misc_feature 193: w=a or t
tcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcatwcctctcctttccctttgcctcccctgttgccttttcttcccctgatttctcctctggtcatctcctctcccttctgcgtgtaagccatgggaaagggatgagggaggacagcttctggttaaacacaggtcctcttccacatcaaat

SEQ ID NO: 9781 - DNA, 210 bp, Homo sapiens
  misc_feature 132: y=c or t
gttatcgccgggtcctggggctgcacgtgtggtgaggcctacagaagcggccttcagctggaccttggtctccccgccggacttcgaggggtgtcatcgccgcccctgttgggggtgagcgccgcgcggctyccagcatgcctcacaggaagaaaaagccctttatagagaagaagaaagctgtgtcttttcacttggtccaccggacgc

SEQ ID NO: 9782 - DNA, 408 bp, Homo sapiens
  misc_feature 321: k=g or t
  misc_feature 322: y=c or t
  misc_feature 323: r=a or g
  misc_feature 324: k=g or t
aaggatcctcagtctagacgtttgaagcatgaatatcaagctcttactactaggacttattgaagtgtatgggttgaatatcccttatctgaagtgtttcggaccagaagcgtttcagattccagactttttttggattttgaaatgtttgcgttatacttacctgttgaacatcccaaatccaaaatgcttcaatgagcatttcctttgaatgtcatgttggctcagaaaattgggatttttggagcattttggctttgggatgctgaactcatctatattttatagatcttttactttagagttgagatcacctgtcakyrktttagttttatattacagaggtgagtgggtaaaggattgagtgtgaagctattggtttctcttggtctccacatattgacacgt

SEQ ID NO: 9783 - DNA, 295 bp, Homo sapiens
ttctgtttaaagccttttactttgagtagtcttcagttagctcagtctagttttttcagactcctttggtttcttggtagccatactcttgcctgctttattgctttcatttgtacaattttgtttcattttcttgcaagacacactgaaatctcaacgtttctatggaagttgtggtaccctcccacatcacaaattatttttaccctctattctgcttagtgaggcctagcctaagcaccctatctatctaaagtagtctatgcctgtttgtcccactctatccccttgaccc

SEQ ID NO: 9784 - DNA, 380 bp, Homo sapiens
  misc_feature 241: b=c or g or t
  misc_feature 298: b=c or g or t
gctttcatgattattcacatacatgagcagagcagtgaagaatttgggtctcctgaggcaaatgttacagctgaggcggggcagggcgatgctctgctttccggtttcagctcatactataaagagggtcctttttgaggtgcatttggtgctatgtttttcacattgtcgtgcttcttattggtgacttttttgtttttttttgagacagggtctcagcctcaacctcccaggctcaacbaatcctcccacctcagcctcctgagcagctgggactatagacattcaccaccacacbcggctaatttttaattttttttgtggagacagggtcccactatgttgtacaggctggtctcaaactcctgggctcatgtgat

SEQ ID NO: 9785 - DNA, 139 bp, Homo sapiens
ccttctccaagcgcctgcagggccggctcccaggcctcagggtccgctgcatcttcctggcctggctgggcgtctttgcaggcagctggctggtgtacgtgcactactcgtcctactcggagcgctgtcgcggccaact

SEQ ID NO: 9786 - DNA, 243 bp, Homo sapiens
  misc_feature 91: w=a or t
  misc_feature 108: k=g or t
  misc_feature 111: k=g or t
  misc_feature 124: k=g or t
  misc_feature 147: w=a or t
aatgtgcctgatcttgcaatgcatccatgcaaccttggctatattgacctttggcaacacttttcttttatgttatctactcaagtttaawatttttttcagcacttkgckgaagggctattckgatcctcaagtcaccttgatctwactggatgcacagctggaatacaatgattgaatgaggcaatctgtgcattaataaagcataacttgcaaaacaagaaatttgaaaatggaccatga

SEQ ID NO: 9787 - DNA, 214 bp, Homo sapiens
ctatagtactaacctcttggttaacaagcatttatgttttgtgcagagagctgtgtcctgcagataccatgaaaaacatagtgttcttccctttgtagtcttggtagggaagacagcatgtgcctgcaaaacacctggtgcaagtgtgtaccatggtaaatgctatcagaacagcaaggaccttgtgttgtcagaggaggtggaggtcatctct

SEQ ID NO: 9788 - DNA, 233 bp, Homo sapiens
  misc_feature 63: r=a or g
  misc_feature 79: r=a or g
  misc_feature 115: r=a or g
  misc_feature 116: k=g or t
  misc_feature 130: d=a or g or t
  misc_feature 145: k=g or t
  misc_feature 153: v=a or c or g
  misc_feature 222: s=g or c
cccatttcccagttactttctgttgtccaaaagtttaactgtcctgccagccaaagctgctgrgcattactctgatagrccatcagtccttggtaagtgtcctgtgcatctgggrkaagcatccgtttgdtttcagctgcgcttkcctgtgavcttgctctgccgtgagtccctcgggtccacgtggggccggttgcgctgggttcccagcctgcccgacasactcactgcga

SEQ ID NO: 9789 - DNA, 279 bp, Homo sapiens
tgtggacagtcttcagcgagtttgaagaccattagcctatgtgtaatttccttgaatacaggggaccctcttttgctgtttgacccttctctgtaacagcaaaaatatttatctagagtaagctgtcaatcaatgcctgttgcactgagaaatgatgtcagctttgtttggggtctcgctctgttgcccaggctggagtgctgtggcacgatctcggctcactgcagcctctgcctcccgggttcaggtgattctcctgcctcagcctcccaagtagct

SEQ ID NO: 9790 - DNA, 364 bp, Homo sapiens
  misc_feature 315: r=a or g
  misc_feature 329: s=g or c
  misc_feature 345: s=g or c
tctcttctaggaccatcctcctggaggcacagtgcactggcagcatgcccctcttcccaaggatgtagacacagcttggcctcaaagcctagggtgttcacctgcctgtgtacaaccccctcaaagtgcagggtggaccaggggtcagctgtctccacactgacatgctctggcaaggagctccaaggagttggaaagctcacctggaacctatgtttcaagttcttatgaaggtacatatgtcaagatagaagagtaagatctattttatttactagtttgttagcccttgtcccctgtcccacgaatgttagragcaagcaaaaatsctttcatccaaattascttcctcttcataaaaata

SEQ ID NO: 9791 - DNA, 166 bp, Homo sapiens
  misc_feature 147: w=a or t
caccaaactataacattttgacagatattctaccagtgttctcttctgttttctctttctctaacacacatctatatgttttaaaagtaatatttaactcttctccacttcctttcctcttcctggaaaaattcagtccaaaaaacwattaggtgaggtcaagcat

SEQ ID NO: 9792 - DNA, 322 bp, Homo sapiens
  misc_feature 221: k=g or t
  misc_feature 226: m=a or c
  misc_feature 229: y=c or t
  misc_feature 232: k=g or t
  misc_feature 235: y=c or t
  misc_feature 237: k=g or t
  misc_feature 240: k=g or t
  misc_feature 243: h=a or c or t
  misc_feature 248: m=a or c
  misc_feature 264: m=a or c
  misc_feature 277: y=c or t
  misc_feature 294: k=g or t
  misc_feature 299: y=c or t
  misc_feature 311: y=c or t
  misc_feature 322: k=g or t
aattgatactgctttagatgtttctgtctcattttacaaaaatgtaagaaaaaagaaaaatcaaactatactgttacctatttcttgtatattcttaacagaatgttctgtacacataagtgtatgtgtgttaatcctcttgtttaaatgccatgaaacttcagtttgccttttgttattttctttatttagataccttttttctttttcttttttttttkgagamagyctkgcyckgtkgchtaggmaggagtgcagtggcamaacctcagctcaytgcagcctccaccttckggttycaagcaattttyctgccccagck

SEQ ID NO: 9793 - DNA, 275 bp, Homo sapiens
  misc_feature 126: r=a or g
atagtcataaatcaaaataccaaacagatctttatgaaagagaaaggagtaaaaagagagaccgaagcagaagtccaaagaagtccaaagataaagaaaaatctaagtatagatgaaagatgaagraggcagaattgagaggctaacatatttactcttgtctaacttaagagtgccaggaaagcagatgcttagattttgtgtcaaagcttgttatttttttcatactaggattatggtctttagattaatactgattatatagagcacgaaga

SEQ ID NO: 9794 - DNA, 131 bp, Homo sapiens
actagttgttttccccttcttcttctcctttctctcctttttctccctcctccttgtctcttttactccattcctgcagaagagagagggctaaacttaaagaaaaaaaaaaaggaggaggaggaggagga

SEQ ID NO: 9795 - DNA, 486 bp, Homo sapiens
  misc_feature 396: n=a, g, c or t
  misc_feature 441: v=a or c or g
  misc_feature 486: m=a or c
ccagttctatttaagagaaatccagttctatttttgccttcacttttcttgaaactgacccatgggtgtggggaatggggtgtttgtagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaaggtattgtcctaggctgttacctcagacctgctctgtgtgcatagaggacagagggtagtttgtgtgcaggtggaacatggtgatgtgtttggtttgtttttttgtttttgtttgtttgttttgctttaatgccttttttttcctgagcgaagtggngtggatttttcttcttaaaaatatgtcttgatgtctaatatatavtgcgatgaattcctgtctgtgttgtggttcttcatattttctttm

SEQ ID NO: 9796 - DNA, 474 bp, Homo sapiens
  misc_feature 6: h=a or c or t
taaaghtctctatactgttcagaaagaatctgaaattgattagtatcttagatggaatcaaataggcatgacaaatttccagggaacagtttattgtgagtttgtggtagtttaaacagtgatattagtatagtaatacacagagcacaggaacagagggcacagggtgcacctctctggtaatacatggagagaagggtgttgtagggtacatattttattttattttatttatgtatgtatgtatttatttatttatttttgagatggagtctcactctgtcgcccaggctggagtgcagtggcgtgatcttggctcactgcaacctccgcctcctgggttcaagcaattctgcctcagcctcccgagtagctgggactacaggtgtgtgccaccacgcccagctaattttttgtattcttagtagagatggggtttcaccatgttagccaggatggtcttgatctcttgac

SEQ ID NO: 9797 - DNA, 399 bp, Homo sapiens
tctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacattc

SEQ ID NO: 9798 - DNA, 203 bp, Homo sapiens
  misc_feature 140: y=c or t
  misc_feature 142: r=a or g
  misc_feature 143: w=a or t
  misc_feature 145: k=g or t
  misc_feature 150: r=a or g
  misc_feature 152: k=g or t
cgaaaaagagtgaaagaacaaagcttccacagcatggaaagggactggagcaggttgccactgctggctcgggtggccagcttttattcccttatttggccccgcccacatctgctgattggtccgttttacagagtgcygrwtkggccrakttttacagagtggctgattgctacctttacaaacctttagctagccagctc

SEQ ID NO: 9799 - DNA, 141 bp, Homo sapiens
  misc_feature 122: y=c or t
  misc_feature 127: m=a or c
tgagcgattatcctgcctcagcctcccgagtagctgggattataggcatgagccaccatgcccagctactttttttgtatttttattagagacagggtttctccatgttggtcaggctggtyctttmaaactcccgacgcc

SEQ ID NO: 9800 - DNA, 457 bp, Homo sapiens
  misc_feature 430: m=a or c
  misc_feature 433: m=a or c
ctgaatcttgcacaaacctgccttggttgcctcttgtcacactgtcatccacttccctgccacctctactccagacttccctcctgatcagcacccatctcttccagcgaccctgcttgatttctgttctcctggcactgctgccaacaccatggctgccatccagagttagcctcagggcaggcctctgctctcctcccttacaaagggccattcctgctcctccttctcacctgcatgtggggtcagaacccagaagtagttctagctatggctgcagtaactgctgactgctccagaaactcaccatttccctgtgttgctaattcatctaatacttgcactggaaaccaactttctattaactgaaaaacaaaccaaagaggtgtgttggtaccatctggctggctgcctctgggtgcaccctcamcamccacatactccagccctcactaca

SEQ ID NO: 9801 - DNA, 466 bp, Homo sapiens
  misc_feature 125: m=a or c
  misc_feature 436: m=a or c
ctctcttctactggaatggtacccttgttgactgactcatgtatagctgcttggcttaatggtagaccagatattcaggtcctctgagacaggcccctgatgacttttgcaactacatctttcamcacagcctgccttgcattttggactctagcaacactgaaatacatgtcatttcccaaggcatgttaagctgtttctattctctaggctctccctttttcctagaatgcccttttcctctaggctaatgtctttctcctttaaattagtcatcttcaacaaaggctaccttgaccttctcttgactttgccacattcctgctgctgccttccttccatggcctttgtcacgctatatggtaattgacaggttccatgatcttgaggaacttatggattttagcagtgggtcttagcttgccatcttcttcamccatcaagtttcatttctctctttactcat

SEQ ID NO: 9802 - DNA, 398 bp, Homo sapiens
  misc_feature 168: k=g or t
caacaaatggtgcttcctggctaatatcagcgtgtcccatagatttctgcttccattgaatagacctaataagaaagagaatgaagtcaaagccaacagggcagaaagaaattgaaaacctgaagaacccagcactcaaactgtctccacttgcgtttgctttttcckttactcttctccttctggttttcaacagccaaagcaggatttaaatttggttatgttgcaaaaatcatttccctcttcaggccctgtcatgtgacttgattttttcgtccattttagagaagctgtacccaccctggtttcaggacacggaactaaatttattaagaaaagaagccacttcaagtcatgaaggagaaacacaaagattcttggatttagttctaagacta

SEQ ID NO: 9803 - DNA, 357 bp, Homo sapiens
  misc_feature 150: d=a or g or t
  misc_feature 221: k=g or t
tattacccaatcagaataaaaaagggaaatattttggtgacagtgctactgtttgctcagcagtagtggctaagaaacagtggatgctacataggtattttctccataacttgtgcctggtagtagctgtgccaattttcaccagacctdgattacctgttagagttttgaagggagagcttatctggtgaggacttgggtgacgttgcttgtgggaggakggccaagcacggaatggaagttgaatgttagaagtgctagacctccagattcagtaaacttggagaatccctgtcccttgtggtaaacttgagacttgactacattttgcggttaagggaatttcagccggtcagc

SEQ ID NO: 9804 - DNA, 410 bp, Homo sapiens
  misc_feature 313: b=c or g or t
  misc_feature 352: d=a or g or t
agtgggagatatcatggaagtgatttatgaagcctttttttttctttttcttttttgagatggcatcttgctctgttgcccagagtggagtgcagtggcgttatcacgcctcactgcaacctctgccttttgggttcaagcggttctcctgtctcagcctcctgaataactgggattacaggtgcccgccaccacacccggctaattttttgtatttttagtagagatgaggtttcaccattttggataggctggtcttgaactcctgacttcacgtgatccgctcgcctcagcctcccaaagtgctgggatbacaggcctgagtccccgcgccggtccgatttatgaagcdtgttacttcaagtattagaaaagtaaaatggaaagatggtttagagaagatttctttt

SEQ ID NO: 9805 - DNA, 506 bp, Homo sapiens
  misc_feature 133: k=g or t
  misc_feature 141: w=a or t
  misc_feature 142: m=a or c
  misc_feature 159: k=g or t
  misc_feature 446: r=a or g
taaaaacatcaaccctgaatttgtggaagcatgagtaagagtagatatattattattcttggtatctcacttatgttggttatatttattttttgcatatgccttatacatgctttctttgggaactcaaggkagaatttwmcaggctggagatgcttkttaactctcaggataataacctcagtctggtttcatgaactgtgctttcattaagtattgatatgtttaggaaaggagatgtcttaatatttaaatagcagttcaaactccagtttctttagtattcattgactttctaattgtcaaatttgtcaggacagtaaaaattgtattaacatatagtgtctagagagaagttcttaaatttgccgattgtggtagctgttagaattggcagactgaagacattgatacacatgggaaatcattcagggcagtgcttaaarataaaacgaaaaatacctttcagcaaatacaatcttttcttggcattctgttaagttgtc

SEQ ID NO: 9806 - DNA, 473 bp, Homo sapiens
  misc_feature 312: n=a, g, c or t
  misc_feature 313: n=a, g, c or t
  misc_feature 473: s=g or c
ttttagatatttgatccttaaaaatggctgatatgtaatgcttattatcttagttatagcatcattgaaaatataatttttagtttagtaataaacatttaaaagttttttgaggagtaatgttcatgaacttcaacttaagtgtataatttgtcaagtgttggaatatgtatacatcatttctacaatcattagatgatatgtcatctctgaataaagacagttttactatttcctttttaatctggatggctttatttccttttcttctttattgcattggttggacctctaatacaatgtggaataganntggtgaaagtggacattcttgtctttttcctgattttagggggaaagcattcatcattcagtctttcaccattaagtatgatcctagccatagctgtttttgcaaatgtcctttatcaaattgtggaaattctgttttacagtgagggttttgtcattgs

SEQ ID NO: 9807 - DNA, 146 bp, Homo sapiens
tatttaggtatctatttatatagatctgtattaggaaacaaattagatagacttcacaccagtgcttcaaatcacagttcaaaaatctcatgctttgttctggttctccctctttccatatttgtatcttcatccttcagtagtga

SEQ ID NO: 9808 - DNA, 387 bp, Homo sapiens
  misc_feature 140: w=a or t
aggcaaatcattcccaccatcacttaacgccgggattatacacattctagaaatgattctgagaggagtgtatagtatggtgcctatctacactcacatgatattcttattcacgttttttttaaccataagtgggcaawtattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagct

SEQ ID NO: 9809 - DNA, 330 bp, Homo sapiens
  misc_feature 215: k=g or t
  misc_feature 277: y=c or t
ttccggccctgctgtctgcctcccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacctcagcctcctgagtagctggaaccatcatatkcaccagcacgcctggctaagtattttgtgttttctttttttttaatttctagagacaggatyttgttatgttgcccaggctggtctcaaactctaggactcaagtgatctacccc

SEQ ID NO: 9810 - DNA, 271 bp, Homo sapiens
  misc_feature 113: s=g or c
  misc_feature 128: s=g or c
ccaatatataaattgcaaatgttttctcccgttctgttttgcccccacttttttttgagatggagtctctgtcatctgggctggagtgcagtggcacaatctcggctcattgsaacctctggcttccsgagttcaagtgattctccttcctcagcttccttggtagctgggaatacaggtgtgtgccaccacacctggctaatttttttttattttttaattttttgtgttttttggtagagacggggtttcaccatgttggccaggcaat

SEQ ID NO: 9811 - DNA, 387 bp, Homo sapiens
tttcaatatcccactgagaactcacccccaggatgggactctgctcaccccgtcctctactcaagcagaagcctctcagcgatcatagggcaaggcctgaacacaagcttctgttggtgtaaagtggaggcacaggctgcaggactgtctcagaagggaaataatatttaccttccaaactgagatctaaaacccgaacaaagcctcaggaaacatactccaccaccatcttacaagtttgtgctacgggtggagggaaaatgaatctaatgtaggaggcctcccgctgtgcgtctagcaggaaagaccatacggtgcaagtctccaggatcactagaggggtggattgttcatttcagtccaggtagcaacaggaagcccgtgcgg

SEQ ID NO: 9812 - DNA, 220 bp, Homo sapiens
  misc_feature 61: s=g or c
  misc_feature 62: h=a or c or t
  misc_feature 63: n=a, g, c or t
  misc_feature 133: r=a or g
  misc_feature 140: s=g or c
  misc_feature 168: k=g or t
  misc_feature 171: k=g or t
  misc_feature 182: y=c or t
gtttgtttggttggttggttgttttttgtttgtttgtttttattttgagacggagtcttgshntgtcgctcaatctggagcacagtggtgtcatcatggcttattgcagcctcaacctcctgggctcgggtgrtctcccsgcctcagcctcctgagtggctggtactkcakgcatgtgccaycatgcccagctatttttttttttttttttttttttttt

SEQ ID NO: 9813 - DNA, 424 bp, Homo sapiens
  misc_feature 408: n=a, g, c or t
ctgttgggaaggaatgattggttttgaaatgtgaggattatgaaatttggaggagcccagggaggaatgatatggtttggctgtgtccccacccaaatctcaacttgaattgtatctcccagaattcccacatgttgtgggagggacgcagtgggaggtaattgaatcatggaggccagtcttttctgtgctattctcgtgataataagtcccacaagatctggtgggtttatgaagagtttctgcttttgcttcttcctcattttgctcttgatgccaccacgtaagaagtaccttttgcctcccacctgattttgaggcctccccagccatgtggaactgtaagtccaattaaaccctttttgtttccagtctcagatatgtctttatcagcagcatggaaacganctaatacaatcatagt

SEQ ID NO: 9814 - DNA, 159 bp, Homo sapiens
tttctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgct

SEQ ID NO: 9815 - DNA, 323 bp, Homo sapiens
  misc_feature 97: r=a or g
atatgtaaatgtactatacagaattatacataaaagagaaacttttcatgtatgtaagtttaaaaatgaagtaaatgggggtttcaaataacattaraattggttatgagtttttgaaaaggaaatcatacttggcattctaaacttaatatttctttgcaatgtttaggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaaa

SEQ ID NO: 9816 - DNA, 196 bp, Homo sapiens
agagcctgtgctactggaaggtggcgtgccctcctctggctggtaccatgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggaacg

SEQ ID NO: 9817 - DNA, 358 bp, Homo sapiens
  misc_feature 99: k=g or t
  misc_feature 139: w=a or t
catgttggagggtgtcacctttgctcatagaggcccacatgaccaggccccttttctctgagggctctgtgagactacatcacttaggcctctcccctkgtttggccgttccctctcatggcacacttccctttcctgwcctggccaattgagaagtctgcagaggcccagtgttatactagatgcgctttccttaaactctagtgggatgtgagaccctcttctgtagcaacctatgtatcccaggattgaatttcctgtgtgacaatgacttatttgtgtgtcatccccctgccagctgtcaggggtagaagaccaggtgtcaccctttcgtctagtgaaaaacaggcactcgaga

SEQ ID NO: 9818 - DNA, 226 bp, Homo sapiens
tctcatcctccagaccgtcctgccaggtcattccttttaggggtgaacaaattcgcacgcaagtgttcatgaccccacttctgggagtgcttgcctcaccaaagagctcctgccatgggtggcaactaatggaagccactggaagctcagtctcagggtgaaccttgcagcagctgccctctgggctcctggagactctggaagccactgctactgccccccgcac

SEQ ID NO: 9819 - DNA, 237 bp, Homo sapiens
  misc_feature 145: r=a or g
  misc_feature 150: k=g or t
  misc_feature 154: y=c or t
  misc_feature 155: y=c or t
  misc_feature 158: v=a or c or g
  misc_feature 161: h=a or c or t
  misc_feature 166: n=a, g, c or t
  misc_feature 167: d=a or g or t
  misc_feature 168: h=a or c or t
  misc_feature 187: s=g or c
catagctcactgcagccttgagctcccaggctcaagcaatcctcccacctcagccttcccagtgtccgggactacaggcatgtgccaccacacccagctaatttttgtattttttgtagagacagggttttgccatgttgcccarggctkgtgyytcvaahtcctndhctcaagcgatttgccctcstcgacctcccaaagtccattataggtatgagccattgcacttggccctcc

SEQ ID NO: 9820 - DNA, 200 bp, Homo sapiens
  misc_feature 142: s=g or c
  misc_feature 148: k=g or t
  misc_feature 150: y=c or t
  misc_feature 157: y=c or t
  misc_feature 160: k=g or t
  misc_feature 163: k=g or t
  misc_feature 166: v=a or c or g
  misc_feature 168: k=g or t
  misc_feature 178: k=g or t
  misc_feature 183: r=a or g
gaattaacttgtgttacatctataaagagcaaaataacacactccagaacttggcagttgtagcattagttatacagttttgggtgttcttgccacccgtgggatgcctgcttctcactaccacctgtgtctggacacatgsttatgkcycaatttycckttkggvakgtggaaagckgtcartgcagtgtaaggcctct

SEQ ID NO: 9821 - DNA, 200 bp, Homo sapiens
cctaaagaatatatttttgaactccttgtttctgcgctgtccttcttagcccaggacattcagggtgctttgcttgttgtcaaaccagggaaaggagaaaactcctgtgcctttctgggccagcctgtcaccctggcctggtcggcagccattcccctacctcctcactcaggaactgtcacaccaggaaccggcgaaca

SEQ ID NO: 9822 - DNA, 359 bp, Homo sapiens
  misc_feature 137: r=a or g
  misc_feature 231: d=a or g or t
  misc_feature 234: h=a or c or t
aaaggttatacaaaatacttaatgtccacggctataagagacactgggcaaatccatccatggcttctgccagtgcctctgctgtggaagataatcctctgtcggcttcactgagccactgttggaggttagttcarggaaatgttgcccatgttggggttccccctgtgaaatacaggcgcaaatagaaatgcaagtatattttcgcttattgtaaacttacatgacttdaahgcggaccaaatactgttgttgaatatactctgaaagcctaatataagtaggactttagttaatgaatttcctcctccacatgttctagccttgctttgtcagtgacatgaaaacaaccaaaatgc

SEQ ID NO: 9823 - DNA, 348 bp, Homo sapiens
  misc_feature 207: n=a, g, c or t
ttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctcnttttgacagtaaacttctgcctatggcttacagtttgacatttaatttattagcgctgctctgcacccctcccttgggagggagacttcatgtggtttattgcgagttttttgtttacttttcaggtttgtaccacaaggc

SEQ ID NO: 9824 - DNA, 315 bp, Homo sapiens
aaaaggaatacgttatttatttgtttatttcagacagggttttgctcttgttgcccaggctggagtgcagtggcatgatctgggctcactgcaacctctgtctccctagttcgggcaattctcctgcctcagcctcccaagtagctgagattaccggcatgcgccaccacgcccagctaattttttgcatttttagtagagacggagtttcaccatgttggccaggctggtctcgaactcctgacctcaggtgattgacccgcctcaacctcccaaagtgctgggattacaggtgtgagccactgcactgggccg

SEQ ID NO: 9825 - DNA, 562 bp, Homo sapiens
  misc_feature 491: w=a or t
  misc_feature 493: v=a or c or g
  misc_feature 494: n=a, g, c or t
  misc_feature 528: w=a or t
atttatggatgcctaccatctaccaggtactgttctagctacaaggaataactaaaaataggtaaacaaaacagatgaaaaacttagaaatttatactgatgttatcagagtaatgtttaatttttcagataattgttatgtctaaattagcatttgatttttcaattaagaatttttaaattatccaatattgcaagcatatatagaaacatggaaaacaacaaaattctcatgcatatacttcaaacacagagctaacagatgttattattttttatttctttcacaacccaactttcgggaaacaaaataggcacagcaaaactgggatctcctcatccccttctcctttcttatataaaagtaatcctgctcttggtacagctatgtatcatactcatccaggttttaatttttcttatataacggaacatatatggtgttattttacggattttaaagctttacataaatggtgtcatgtgatgtwcvntcttatgtgatcatttttactgcactctttttawtgctgcatagtgtggcaataaatgaagagtttat

SEQ ID NO: 9826 - DNA, 155 bp, Homo sapiens
  misc_feature 142: s=g or c
atttgctcacacccagcaggcagagaaggcagcagcaggcaggaccgccaccctcccatgcaaatcacccccgggagtgcagctgggctcctcccgctcctcctaggcaatgctcctggggagtctgttgggggaagatgcsatccagggtgctg

SEQ ID NO: 9827 - DNA, 438 bp, Homo sapiens
  misc_feature 26: n=a, g, c or t
  misc_feature 137: r=a or g
  misc_feature 162: k=g or t
  misc_feature 205: d=a or g or t
  misc_feature 371: n=a, g, c or t
aaagcaagtgcaagaccacgcattcnaccctggcttgcagattaaaccagctgtcaagccagggtgaaggatccgtggccaggcagaggtctgtggagtggagaggcgaggcctcacggtggaactctcagatgtgragttccaacaaattggttcaaaaakaggggggataaacacgctggcccatgctgggcaagcatggcadcaccttccaggcactgtcttcttctgatcagcactctgggtgtctttgcacttaactgcttcaccaaaggtcagaagaacagcacgctcatcttcacaagggaaaacaccattcggaactgcagctgttctgcggacatccgggattgtgactacagtttggccancctgatgtgcactgtaaaaccgtcctgccccttgcagtagagcgaaccagctacaatggccatctga

SEQ ID NO: 9828 - DNA, 460 bp, Homo sapiens
  misc_feature 126: y=c or t
  misc_feature 130: r=a or g
  misc_feature 132: k=g or t
  misc_feature 139: k=g or t
  misc_feature 446: k=g or t
ggcatataggatgtttgaattgttacttctgaagatttggcttcacgtgattttaagtggtttattttgtttcagattttctgcaaataatgcatctggttgtattaaatatgttatgttcttgcyaatrakattaagkgtagaatattatgaaagatttctgcctcagtatgctttattatgtaccttgactattaaaatactaacatgatagaaatttagagctagactttacatacaatgaaatgtaagtgattttctcattaaaactgagtatactacatgtccatgtaaaggcttgtcccatgaaagatggattttatttcagtatatgagcaatgtgaagttctgttttagcttatcacatctgttttttctttacagaagcctgtcttcttgtatttggtatgctagctctttcatttatacaacagttacttgttgakcatatattatatgc

SEQ ID NO: 9829 - DNA, 474 bp, Homo sapiens
  misc_feature 436: m=a or c
cactttataagaaacacccaaagtcatggctttgataggatctcggttaactctcttccatctctttgaagtggtgtctttcatttccagccagtaccctgtcacaggagagcctccatcatattctggctcttcccagttgacagtcatggagttacgagtcacgctgctaactgttggtttatctggtgctccagggacagctgtgaaaaagatcatattgattataagaaatttaaaaaaaaagtaaaaatggctttgtatgtgaaaatgttctcctacttacagaagaggtttcttgctgtttcaggttcactgtcaagaggttctccaatgccatatttattctgggccatgattcggaatacatattcatggccttctagcaatttgggaatcgtgtacgtgcactccttaggttcactggagacatggmccatgtcttcctgttagcttctcttttctcaattacat

SEQ ID NO: 9830 - DNA, 414 bp, Homo sapiens
  misc_feature 134: m=a or c
tattgagattctacagtttctattaagtttgaagtttcttcttaatttgatacttcttttttttatttttgagatagagtcttgctctgtcacccaggctggagcgcagtggtgcgatctcagctcactgcaamctctgcctcccaggttggagggattcttgtccctcagcctcccgagtagctgggactgcgggcgtgtgccatcacgcccggctaattttttgtgtttttagtggagatagggttttgccatgttggccaggctggtctcaaactactgacttcaggtgatctgcctacctcagcactgttttcttcttatatggtatttatatatctgtcttgcaattttatggttacttaatatcacacattatgtgtgatattaaggtaacataattcatttagctaa

SEQ ID NO: 9831 - DNA, 347 bp, Homo sapiens
  misc_feature 136: w=a or t
  misc_feature 187: n=a, g, c or t
  misc_feature 304: r=a or g
  misc_feature 313: h=a or c or t
  misc_feature 314: n=a, g, c or t
accacacctctgagtcgtctgagctcactgtgagcaaaatcccacagtggaaactcttaagcctctgcgaagtaaatcattcttgtgaatgtgacacacgatctctccagtttccatatgttgagattctacttawtttcatcagtttgttgtgcttgtcaagatcaggtaggttatttacaaactngttttcttaactgcttaaaaaatagaattagttgtgttgtcattttgcatgtcatcattccacttccttcggtgaacttaagtccatagagtcgtttttaaggaaaaagatataggragcctgtahntttccttaacatttccttaaaaaaaaaaaaaaa

SEQ ID NO: 9832 - DNA, 317 bp, Homo sapiens
  misc_feature 128: s=g or c
  misc_feature 197: d=a or g or t
  misc_feature 206: n=a, g, c or t
  misc_feature 207: n=a, g, c or t
gcggttcttcctcacctggcttgggccactgtgcacagctgtgccgctggctcagccccgccccctgcggccctccgccgtggcttccccctccctacagagagatgctgtcccgtgggtaagttccsgggcaccatcggggtcccagtctcctgttagttttggagggagggagggctttgttgatgctcactcgdcgtgtgttnncgtgagtgcgatctgccgctgccctgcgcctgtttccggtccctatgaacttccccttcccgcaaggtgtgaggacccccggctcactcatgctcctctgccccctcttt

SEQ ID NO: 9833 - DNA, 434 bp, Homo sapiens
  misc_feature 80: b=c or g or t
  misc_feature 82: b=c or g or t
  misc_feature 124: m=a or c
  misc_feature 127: w=a or t
  misc_feature 128: y=c or t
  misc_feature 299: n=a, g, c or t
  misc_feature 300: s=g or c
  misc_feature 303: d=a or g or t
  misc_feature 347: s=g or c
cagtgcctcccactcttctagttgcctctctgcctgcctttgtacatttatttatttatttatttatttatttatttatbabacagagtcttactgtatcacccaggctggagtttagtggcamcawyctcagctcactgcaacctctacctcccagactcaagcaatcctcccacctcagcctcccgaggagtgggaccataggcacgtgccactatgcccggttaatttattgtaatttttgtagagatggggtttcatcgtgttgcccaggctagtcttgaactcctggactcagnsgadtcgcccgtctcagtctcccaaagtgctgggattataggcgtgascaccatgcccagccgctagcactcatcttaatcgtatatttacttatctggctttcccaccagactgcgggctcttcaagagtaaat

SEQ ID NO: 9834 - DNA, 429 bp, Homo sapiens
  misc_feature 303: r=a or g
  misc_feature 379: r=a or g
aacaaactcagtgaagtgtggttctattttaccttctggccttcagcctctttgggaaagtctgtcatttgcagggcattagcatttgcagtcacagaggatgggacagggattctaactgcattgtggagagtgttatgatctagtccagggacctgggcttggtgcccatgtgtgtgtaggtatgtgcaggtgtgcatgcctctgtgtgtgtgtgtgtgtgggtgtgtgtgtgaactttcatttccaattcctcacagactggtatttagccaaatacactgacaattcctagagagatgraaatttaaaactctaagtcttgcaaaaggtaagctctatttttttcttgttagattcaacagacataaaattacgrcgtcctgtttccatagcagtttctagacactcactgtcatttctgagcat

SEQ ID NO: 9835 - DNA, 310 bp, Homo sapiens
  misc_feature 158: r=a or g
ttttttctctgtgcatcctcagtgacgcggggcacagctctgcccgggggcctaccagccccacctggaccccacactgggtcagccctggtgcggaggaggccgctgtaggcgcggccaggtcacagtcggcaccagaagtttggcagatctcagtraggcgttagtttgcatttccttgtgacggagtctcactctgttgccaggctggagtacaatggtgccatcttgactcactgcaacctccgcctcccgggttcaagctattctcctgcctcagcttcctgagtagctggtactacaggcgttg

SEQ ID NO: 9836 - DNA, 352 bp, Homo sapiens
  misc_feature 101: m=a or c
  misc_feature 118: k=g or t
  misc_feature 123: k=g or t
  misc_feature 127: y=c or t
  misc_feature 132: n=a, g, c or t
  misc_feature 135: s=g or c
  misc_feature 140: b=c or g or t
  misc_feature 144: k=g or t
  misc_feature 152: r=a or g
  misc_feature 197: n=a, g, c or t
  misc_feature 219: k=g or t
  misc_feature 307: h=a or c or t
ccatgtttagtgaatttttgaaattgtgaaatatttaaagttatctatctgtttcacaatgtagctaattaaaatgtttgttaaataattcaacttaagamatctaaaaggaaatgckttctkggcyttaantgsagtabttgkcttcagarcaatatgccaataatgactcatcccttctttattcatagtaactntggttttagcttttttggggtktcttttgttttgtttttggagaagggaccttgctctgctggccaggctgtagtgcagtggcacgatctcagctcactgcagccttgahctcccgggctcgagcggtcctcccacctcagcctcctaaatagct

SEQ ID NO: 9837 - DNA, 402 bp, Homo sapiens
  misc_feature 128: r=a or g
  misc_feature 138: m=a or c
tagaagagctgtgtactttggaatgtgatgggatacatttaaagaccctcaaatagatcagaacatatgtgatcttactttcttagtgtggtagattttgaaaccacacaggagaacaggtttatagrataataaggmctcaaaccatattggcctcagttcatttttgttaattgtgtcattggatgaatcgggagctcttacttccattttttagcttttcattttttggtattagtcagataaaaaggttggaacttcttctttgccagggagctcagagccaagttatactaatgattaagggacctaagacaggcaggagggagaaatacaaagtatagcgcttgggtggcatatgtggatatactctagaaaaggagtaaaacttggaaacgctaa

SEQ ID NO: 9838 - DNA, 414 bp, Homo sapiens
tacattccttacaaacaaacaaaaggcagataaacaatgttgtataggaacttcaacacacactgtacaatattcccactttgctgacataagttatggaaatttcatggtttacttgagtgtcgctaccagtattttgcttctctgatgatttttatcaacttcctcatctgttaacttctctccaaggtatgtcatgtcacaacatactgccgctgcacgaacatggccagtgtcttcctattaaacatgtagaatgctttcctaatttctctttttactctctgtctttgtgttctgcattttccttacttttattgtcagaaactccagaaagtcaatcgtactaatttatcacgatttgctttattaatttatactttgcttatatggaattttgcccagcagacctca

SEQ ID NO: 9839 - DNA, 407 bp, Homo sapiens
  misc_feature 351: r=a or g
  misc_feature 367: s=g or c
  misc_feature 386: r=a or g
caaaggaacaatcagtgatggcaggagccatgctggcagctgggagcctcctcccctggtggggacaactgtacagtttcgaagacccaccccaccaatcactctggagaggcaatgtgcatgggaagctgggagagaaggacaaacacagccgggagaggttttgcaggggtggagtgggccacaaagttgagcgatgaagaatgctgccctccctcctggaagcccaggggctacaccaccttgtggggtggtgggctcaggtggaaggagaggtgaggaggggcactgagagcccaagtgatgatgggggacaggctctgcagcctccaccctggccctcagcatcarcagggccgtggcttasccgaggatggcacagttarggccgacactccatagtacgt

SEQ ID NO: 9840 - DNA, 260 bp, Homo sapiens
tggagcagaggtccagctgtggtgaggattggcacagtcgtgcttgtgggactcctccttggtccaactctaatgctcaacctacaccatcacccctgtgcttgctcctctaatgcctaagcactgtcattcctttatcactagtagttgcctgttgggtttgctccatttgtcctcacagtttagctgccctggaaggaaactccaccctgctcagagacacactgaggctgagacccaagggaggcccctctctgaca

SEQ ID NO: 9841 - DNA, 435 bp, Homo sapiens
  misc_feature 167: y=c or t
cttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattycagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaggagaaggatatgaactcctctgaccttaagc

SEQ ID NO: 9842 - DNA, 195 bp, Homo sapiens
  misc_feature 93: n=a, g, c or t
  misc_feature 121: s=g or c
  misc_feature 123: r=a or g
  misc_feature 131: y=c or t
  misc_feature 139: m=a or c
gacattagaagtaagattctttttcttcttttttttttcaagatagagtcccactctgtcacccaggctggagtgcagtggcatgatctgggntcactgcaacctccgcctcccaggttcsargcaattcycgggcttmagtctcccacctgcttggactgcaggtgccaccacgactggctttttttttttttt

SEQ ID NO: 9843 - DNA, 477 bp, Homo sapiens
  misc_feature 291: h=a or c or t
  misc_feature 293: n=a, g, c or t
  misc_feature 382: n=a, g, c or t
  misc_feature 383: n=a, g, c or t
  misc_feature 384: y=c or t
cattaaaaactgatgagcattcaacgtagatttctgagtctcattgctgatgtgttttttatttttattttttatttttttggagacagagtcttgctctgtcgcccaggctggagtgcagtggcgcgaatctcagctcactgcaacctctgcttcccttgttgcccaggctggtcttgaaccgaactcctggcctcaagctatcctcccatctcaacctccaaagcactgggattacaggtgtgaaccaccatacccagtcttgtatttgcttgtaatgtttcttttgchtnaacattttaaataaagtcaggctatcatattttacctgtaaacacttcagcttgcatctttagaaaataaggacattttctttcttttnnyttttgagatggagtttcactcttgttgcccaggctggagtgcaatggcacgatcttggctcactgcagcctctgcctcccgggttcaagcgat

SEQ ID NO: 9844 - DNA, 288 bp, Homo sapiens
  misc_feature 110: s=g or c
  misc_feature 122: r=a or g
  misc_feature 147: w=a or t
  misc_feature 153: k=g or t
ccggctaatttttttgtattatttgtagacatggggtttcgccgtgttgcccaggctagtctggaattcctgaggtcaagctgtctgcccatctcggcctcccaaagtgstgggattgcagragtgcaccaccacacctggcctgawacccakattttatttatttatttattcattttttgagatggagtcttgctctattgcctaggcttgagtgcagtggcgcgatcttggctcgctgcaacctccacctccctggttcaagcgattctcctgcctcggccccga

SEQ ID NO: 9845 - DNA, 181 bp, Homo sapiens
  misc_feature 98: y=c or t
  misc_feature 104: y=c or t
  misc_feature 155: w=a or t
  misc_feature 179: k=g or t
ttaagatttctggtttagctggtctgtccctcagtgagagtctctgtctcgttctctctctctctctctgtctcgctctgtctcctctctctctctcyctctcyctctttctctctctttctctcacccgtctcctcctctctctttggagtttwtagccctggctcttaacctggtakct

SEQ ID NO: 9846 - DNA, 358 bp, Homo sapiens
  misc_feature 135: k=g or t
  misc_feature 149: k=g or t
caaacaaaatttcctttgagatttttttccccctctttgggaatagggtctcaccctgttgcccaggctggagtgcagtggcgtgatctcggctcactgcacctctgcctcctggctttcaagttgagtcttgtkgcttcaagcctcckgagtagctgggattacaggcgtgcgccaccacaccgggctaatttttgtatttttagtagagatgggcttttgtcatgttggccaggctggtctcaagctcttgacctcaagtgatccacccaccttggcctctcaaagtgctgggattactggtgtgagcaccccacccagcacctgttagattttgaaatggatttattgatcaggc

SEQ ID NO: 9847 - DNA, 487 bp, Homo sapiens
  misc_feature 139: n=a, g, c or t
  misc_feature 349: d=a or g or t
  misc_feature 350: k=g or t
  misc_feature 351: n=a, g, c or t
cattctctcccaatagatctcatgtctaacactactctaactttgctcccctctgagaccagcatgaactccagttctttctaaattgtgtaattcttttttttaaaaattaattaattattaattttaagttctgggntacatgatgtgcaggtataattctttcttaatagattctgagcttgaccttccagtcgtcttctactgctcagccacacccccctccatttttgttcttttctctttcttcgggcaaatctgcaattgtgggcgcatatttaccttgttattttttacagtattcccatgtgaacattttgccagcggcctcttcttaattttagtcccdknctggggaagggttaatagttcaaacccattgtttttcttttgagggttgagacttgttataaaagctgcctggagtgggactgtccctcgggaggggaggggcacaggcctggcatggggataactgggaattggc

SEQ ID NO: 9848 - DNA, 186 bp, Homo sapiens
  misc_feature 18: r=a or g
  misc_feature 19: r=a or g
  misc_feature 126: s=g or c
  misc_feature 129: s=g or c
  misc_feature 131: k=g or t
ctttcaaaataaaaaccrrtgttactttttgttgttgttgttctttctcgctatgtcacccagggtggagcgcagtggtgcagtctcggctcactgcaagctctgtctcctgggtaaatgccattsttstkgcgtcagcctcctgggtagctgggactacaggtgcccccccaccacgccccccac

SEQ ID NO: 9849 - DNA, 315 bp, Homo sapiens
ctttccaacctccccctcccaatttgaaagggtgaagctgctgggctactttttaattgctgaagtgttttgccttctcttaacacgtcgggtcatgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcggatctcccgc

SEQ ID NO: 9850 - DNA, 452 bp, Homo sapiens
  misc_feature 446: r=a or g
ttgcttttctctaaataagtgggggtaatacctatattagaggattatgataaaaagatgtgaacatattataaaattattttataaactagaagacatttcaaagaagttaagctgccactgttagttttcacaagacttgggtgtattagatgaacagcttttcagttattgcttctatagttgtcctcttgccctttcctggattatcagtttctgcctgtctacctagtcattcccatcagtgtaaaacatttatactgttatttcttccaagttcagaaaaaaccctctctcgactccccccatcccattctagcacatacaccctgattctctgcttccctttataaatagaattgctggaagaattgtctgtgtctcttttctttaactcttctcctcccattctctcttaaattcactgcagtgatcctttcctccgrccattt

SEQ ID NO: 9851 - DNA, 408 bp, Homo sapiens
  misc_feature 301: k=g or t
  misc_feature 304: k=g or t
  misc_feature 310: k=g or t
  misc_feature 311: k=g or t
  misc_feature 343: d=a or g or t
  misc_feature 344: n=a, g, c or t
tgttttgagacagggtatcactctgttgcccaggctggcgtgcagtggcacaatctcggctgactgcaacctctgcctcccggactcaagtgatcctacacctcagcctcccaagtagctgggtctacaggtgcacactaccacatccagctaatttttaattttttgaagagacagagtctcactatcttgccaagtctggtcttgaactcctggactcaagcagtcctctcacccagcctcccaaagtactgagatgacatgcatgagccaccacacccagcctacatgttttgtttckttktttctkkttttagagacaggatctcactgtgcgcccagdnggaagtacagtggcacagtcacggctcactgtaacttcaaactcttgggctcaagtgatcctct

SEQ ID NO: 9852 - DNA, 279 bp, Homo sapiens
  misc_feature 134: k=g or t
cacaagccctaaccatgggtcttaaaaacagcagattctgggagccttccatgctctctctctctcctcttttatctacttccctcccaaatgagagagtgacagagaattgtttttttataaatcgaagtttkcctaatagtatcaggttttgatacgtcagtggtctaaaatgctatagtgcaattactagcagttactgcacggagtgcaccgtgccaatagaggactgttgttttaacaagggaactcttagcccatttcctccctcccgcgctg

SEQ ID NO: 9853 - DNA, 300 bp, Homo sapiens
tctggacagtaattcatgtcaagtgtcatctgttgcttttctatgtgattccacttcaccagggctgtcctgggaggggtccttggttgtgtttagctttcatcgagttagggtagtaactcctagtctccttcctctccatcctctgtaccttgtgtctcttttcccatttctgatttttgtatccaggagtttctgatttttgccttttgagttttgtttcttaaactaagtggagctaggtttttatggggaaataatttctcagcctgtcatcttgacagtgaaacatttcttttt

SEQ ID NO: 9854 - DNA, 256 bp, Homo sapiens
  misc_feature 128: r=a or g
  misc_feature 134: n=a, g, c or t
  misc_feature 196: k=g or t
atttaaaaggattttttaaaggacctctatagttataagtcagcttaattaaaaatggatattccatagtcatatttatatatatatacacacacatatatatgtatgtatgtgtgtatatatatatrtttaanagacctgtatgatttttttcttcttggaacttatttttttgagagaaagtgttttgtgtgtktgttgtttgtttttcttctcagtggactgaattatttctccattctgtctttttaccccc

SEQ ID NO: 9855 - DNA, 409 bp, Homo sapiens
  misc_feature 253: w=a or t
agggaattcggctgtctcctttctacccgccgcccgagtttattttgtgcacggtttcttttgtagcggacgttactgggaggaatgagggcgaggaagagaaagacgttagtcctcggaccgtttccgagagtcatctccgggagtaatgcgaagatggacacgctcagtcctgcctgtgcatgcgcgttcgcgttgtacggaattcccaagccagctgcgtagtttctgccttgaagctatttggcgagawgtttcgcctgttcctttactttgtgggtcagggcttgggtgcttgagtgggagaaacagaaagccagctagccctggaaccccttctaagatcgtcatccacccagccatccataaatctgttcatccatgaaacaaataatcattgagcacccgt

SEQ ID NO: 9856 - DNA, 335 bp, Homo sapiens
  misc_feature 252: w=a or t
  misc_feature 328: d=a or g or t
aaattgctacttctctggggctccaggtcctgcttgtgctcagctccagctcactggctggccaccgagacttctggacaggaaactgcaccatcctcttctcacagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttcwggggagaagtgaggggtgatggtgatggaagcttgggacaggagcaggactctgggtcccagaataactcattaadgggccct

SEQ ID NO: 9857 - DNA, 204 bp, Homo sapiens
  misc_feature 136: k=g or t
  misc_feature 140: k=g or t
  misc_feature 142: m=a or c
  misc_feature 172: k=g or t
ctcctggttgtttagggtggtgctcactctttcaggtactcagaacattgtatcttttatcacatttaccaccttgtattttaaccttttttttttccagacagagtcttgctctgttgcccaggctggagtgcaktggkgmaatctcggctcactgcaacctccacctcckgggttcaagtgattctcatgccttagcctcct

SEQ ID NO: 9858 - DNA, 181 bp, Homo sapiens
  misc_feature 132: r=a or g
  misc_feature 161: r=a or g
ctcattccgtgggttgtctcttcacttttttgatcattttctttgctgtgcacaagcttttttgcttggcgaaaccccatttgtacatttttgctttggtttcctgtgcttttgaggtcttagagacacaaraaaatctttgtccaggccagtgttctagragcaattctccaacgttttc

SEQ ID NO: 9859 - DNA, 417 bp, Homo sapiens
  misc_feature 401: w=a or t
catatgcaaccttcccctagagttagtgattgtcttatttttctttatttgcatagctcttttgtagcgtttaccgagtcttccctctctccaattcctcagcatgttttccatgtgccggatccatcggatgatctgaccctcctgttcctcaccaccgtcctctatccctggagcactttgcctctgctccaggttgtagcagtgacatgccctacatggtgtcactgtgggactttctttctcacatctgtctgtgggatggatgactagcattaagcatattaagcatactgtctcgactatagaacaagggttggcatttgagctgggccagggcaacctctttgataaacaaccacacaactatttaaaaactgttctctccattttttggtggwgtacaacctccagcaa

SEQ ID NO: 9860 - DNA, 493 bp, Homo sapiens
  misc_feature 298: r=a or g
  misc_feature 300: k=g or t
  misc_feature 375: w=a or t
  misc_feature 493: m=a or c
ttaggtgttctgatagttaagtggtagtatcatggtcttaatttttccttgaagtggcttttgatttgcatttccttaatgactaattaggttgagcatcttttcatgtacttactggccttctttggagaaataccttttccaaatccaatgggttgtctttttttattgttgatcttaagggttcttaggtgttctgggtaccagtttcttgtgagatgtgtgacttgtaaatactttcttccattctccatgttgtctttttattctcttgatggtattctttgaaatacaaaartktttatatttgacaaagttcagtttatttatttatttattgccattcgtgcttttggttttgataatccatttttwttgtttttatttttatttacttagagatggggtctccctatgttgcccacgttggtcttgaactcttgacctcaagtgatcctccctccttggcctcccaagtgctgggaatacattm

SEQ ID NO: 9861 - DNA, 398 bp, Homo sapiens
  misc_feature 362: m=a or c
  misc_feature 386: r=a or g
ctaattctccgggaacacagggaatgcggatcaccatcagtttattattggcagctccagaagaggaaaagtaactctagcatttctcactacattttcaaactatcttttcaaaatggcctctttaaaaatacaagttggtgacaattatgtcctttcaatcagccttcaagacagcacgtgtttttaaatggtcaaatacttttctgctttcttatggcaaagtgtgcacaccgatctctaaatgcaggctcttcctctccctactccttcagttatattcagaggataattttcataccgtgaggagaccagaggcattctagggctgtgctatcccatacagtagccacaagccacamgtggatatctcattttaaatctgrattaattaaagt

SEQ ID NO: 9862 - DNA, 170 bp, Homo sapiens
attagatgtacataatgtttcaaaaatgtttgaatttgaaaagtcttttgattgggtgtgtgttccccagtttgccacagcctactggacttccctcttatatcagacaacttctctactttgtagttcctgctcagccctgaagacctcttaagtttgagacccctgct

SEQ ID NO: 9863 - DNA, 350 bp, Homo sapiens
  misc_feature 334: s=g or c
tattattatcgcctggccaagttttcttttttgagacagagtctcactctgttgcacaggctggagtgcagtggcacgatctccgctcactgcaacctctgcctcctagggattctcatgcctcagcctcccgagtagctgggacctgcaagtgcatgccaccacacctgactaacttttctttttgttttattgttgttttgagatggagtttcgctcttgttgcccaggctggagtgcaatggcacaatctcggcttactgcagtttccacctcctgggttcaagtgattctcctgcttcagcctcctgagtagctgggattacaagtgctsactaccacacctagct

SEQ ID NO: 9864 - DNA, 152 bp, Homo sapiens
caagctcgaacccggtcccctccccgctcccgcgggtagctactgcttgtcccccgccgagacgcctcctcccattggccgcctgaaacgcacacgcccattggcagctgctctgttctccctgctcgtcaccattggattttttttttttt

SEQ ID NO: 9865 - DNA, 285 bp, Homo sapiens
  misc_feature 146: y=c or t
  misc_feature 149: k=g or t
  misc_feature 151: y=c or t
  misc_feature 153: w=a or t
tagggcttttgtgtccagttcttctatcaggactatgattatagcctataattcagccctgttgaccaactcgttcttaactttttccataggattttactttctgctggactctgaacatctacttttcatacagaattgccctyagktycwagaacagtcatctttgtgaaccaggtccaattgcctggcatccatgggcaaataattgaaaggagggatcctaggaggaaaagactacttgctcatgaatctgatgattctttcacatagatcccctggctc

SEQ ID NO: 9866 - DNA, 423 bp, Homo sapiens
  misc_feature 114: d=a or g or t
  misc_feature 327: w=a or t
  misc_feature 328: n=a, g, c or t
  misc_feature 329: k=g or t
tacttaggttgtttccactttctgactatgaataatactggtatgaatatttgtgtacagatttttatgtggatatatttttttcatttctcttatatatacacctaggagtgdaattgctggggcatatggtaactctatgtttaacctttttgaagaactgccacattgttttccaaagcagctttaccattttacatttccaccagcaatgcatgagggtttaaatttctccacaccctctccaacacttgttattgtctgtctttttgattgtagtcatcctagttggtgtgaagtggtatttcattgtggttttgatttgcwnktccctgatagctaatgatgttgaacatcttttcatgtgcttataggccatttgtatatttactttggagaaatgccttcatattgtgcttttct

SEQ ID NO: 9867 - DNA, 482 bp, Homo sapiens
  misc_feature 136: m=a or c
  misc_feature 141: r=a or g
  misc_feature 453: d=a or g or t
tattgaaacaaatgtacatctgtgaactagctaaaatcatcttatgtaccactaatatgcccagcacattttgtaaaacagtcctgatttggcctccaagggtatttattgaactaccagcagtatctagggagamccacraaggaataccacgaaggaatttatgctccagtgcttgccataatttgtctgagaaggaatctgttaaataaaagcttttatcctctaacctttaccttcatcagaccttataaaaggtcaaatggtgattcttaagttttttagtcacaaatcttacttattcagtattagtgcgaagagtagaatactttcaagtaagcctaaacttacatgaaaacaaattacataaatctagctctgagaataggaaattggtgacaagatcaatctgtaagatgttgagcacttatctgaagtaaatgggtaatgagdttcacatcttataaatacaagttagcatc

SEQ ID NO: 9868 - DNA, 405 bp, Homo sapiens
  misc_feature 97: w=a or t
  misc_feature 303: r=a or g
  misc_feature 310: k=g or t
cttctaaaacctatatttttaatgtctttaagtatatgtagagcgttacatgcttcattaatagtttaatgctgacagatgcacttttgagcaactwtgaaataagtgcaaaagacaatggcaacagtatctcactcttaagacttttaggatgtacactgatatttttaatattatgtgaaaaagacactaaaatgctggtattagcatttttgctgcagtattgtaattactgtcaattgtaagtggcaaagccagtgtccaaatttaggtactggaaacggcaaaggcctgtggcctccragccagkggtacccaaagtagtccatctgccgattgttcttgttctgtgatgagataaaggtcagtcattgcacagcttccttgatcaaaaaagtctcgcat

SEQ ID NO: 9869 - DNA, 198 bp, Homo sapiens
aaaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcag

SEQ ID NO: 9870 - DNA, 288 bp, Homo sapiens
  misc_feature 287: n=a, g, c or t
  misc_feature 288: n=a, g, c or t
tttattgattgttactaagcaaatatttctcaaaatctggctcccacctaatgttctacttcttttttcccctcttcctattgcctcatgttttgctctccaactactaagaattatttgtagttgttttgtatatacaatacatttcttcaggtctgtgcttttgctcctgcagaagccaccgccaccccaaccccagtttgcagaactctaaatttcagcttcttacctcccctaagagggttatcatgcccttctaggttggctctaggtgtctgccccccgann

SEQ ID NO: 9871 - DNA, 282 bp, Homo sapiens
agtcactgctacactggcaaagaagggttgagtagttttaagaagcttagttgctgtccaacagtcttattgcatctgattcttttggtgcttgcttactcaagtagggatcacatagcatgggaaggaaagagcagatctgtgattctgttgtttacatctcagaattgtggtttgtgaatagttttgaaatttttcttatagttttgggagaaatttgttaacggaatttttaaggattataggacagcacaaaataatttctcttgtttagatgctagt

SEQ ID NO: 9872 - DNA, 200 bp, Homo sapiens
  misc_feature 28: s=g or c
  misc_feature 73: s=g or c
  misc_feature 111: n=a, g, c or t
acttccggtacgaaaactcgctgctgcsccaacctggcttgacaggcttggtctctgcaagtggctctcagcsccttcttctttcctgcctcaccttccaattcgtttgcngccgccgtcccgcagctgctgtttccggagttgccccttccccatgttccggggcaggagtccgcaaagcgaagatccgcccgccggca

SEQ ID NO: 9873 - DNA, 197 bp, Homo sapiens
ttgttgtagttttacttttttgagacggagtctccctctgtcgcccaggctggaatgcagtggcatgatctcggctcactgcaacctccgtctcctgggttcaagcgattctcctacctcagcctcctgagtggctgcgattgcaggcacccgccaccacgccaggctaatttttgcatttttagtggagatgagtt

SEQ ID NO: 9874 - DNA, 441 bp, Homo sapiens
  misc_feature 145: h=a or c or t
  misc_feature 146: k=g or t
  misc_feature 152: m=a or c
  misc_feature 160: r=a or g
  misc_feature 274: n=a, g, c or t
  misc_feature 423: r=a or g
cagatgagttttttactttttaaaattatttgttttgaggcaggattttgctgtgttgtccaggctggagtccagtggtatgatcatgactcactgcagccttgaccttcagggctcaagtgatccttccacctcagccaaccahktagtcmagactacrgatatgtactaccacgtctggctaattttttattttttgtggagttgggggtcttgctacattgccccggctggtctcaaactcctggtctcaagcaatcctcttgtctcggcntgccaaattgctgggattacaggtgtgagccactgtgccagccttcagatgagttttgagatcagagcataataataaatgaatcatgtaagtgacgataactcatgtttgttaaatgaaacatattcttttatgttagaggtaaaggrtacatttacaagacttgt

SEQ ID NO: 9875 - DNA, 498 bp, Homo sapiens
  misc_feature 133: w=a or t
  misc_feature 136: m=a or c
  misc_feature 141: k=g or t
acattgagtctcaccctgtcacccaggctggagtttctggcatgaccatggcttacagcagcctcaaccttttgggcttaagcaagcctcccacctcagcctctggagatgctgggactacaagcacaaactwacmacaakgcttggctaatttttctattcttattttgtagagatggggtctcattatgttgcccagactggtctctaactctcaggctcaagtgattctcctgcctcggcctcccaaattgctaagactacagcgtgagtcactgcacccagccctttgctcatttttgaattggattgtttgtctttttgagttgtaagagttctttatgtattctaattactaaatagacccttatcaggtgtatgatttgcaaatattttcttccacttcgtagattgtcttttcactctcttggtaatgttctttgatgcccaaagtgtctaatttttctgaagtcaaatttttctatattttcttttgtc

SEQ ID NO: 9876 - DNA, 293 bp, Homo sapiens
  misc_feature 146: w=a or t
tactatatcctccaaagactctcgtaagaaatctgtggatcaccttgttcaggatcccttgtaccccatgattcttgtttctcttcctactttttgttttgttttgttttgttttttatttatttatttatttatttttaaatttwattattattatactttaagttttagggtacatgtgcacaatgtgcaggtttgttacatatgtatacatgtgccatgttggtgtgctgcacccattaactcgtcatttagcattaggtatctctcctaatgctatccctcccccccca

SEQ ID NO: 9877 - DNA, 372 bp, Homo sapiens
  misc_feature 139: w=a or t
  misc_feature 140: y=c or t
  misc_feature 143: r=a or g
  misc_feature 146: y=c or t
  misc_feature 150: k=g or t
  misc_feature 152: h=a or c or t
tcacgagagtcttggcttcagcaacttgtgtttctgtgttgtgttgtcattgagcatactatggaatctgtaatagaaaggctttcttattttggaattgacaggtgaaacaagtgaacagctgattaaatgtcagtawyctragycttkghcctcttgatgctcatttgtttaaaacctgtctttcctgccgggcgtggtagctctcacgcctgtaatcacagcattttgggaggccgaggcggatcgcatgaggtcaggagtgaagagaccagcctgcccaatatggcaaaaccccgtctctactaaaaatacaaaaaattagctgggtgtgctggcgggcgcctgtagtcccagctactcaggaggcat

SEQ ID NO: 9878 - DNA, 465 bp, Homo sapiens
  misc_feature 123: r=a or g
  misc_feature 134: s=g or c
  misc_feature 236: d=a or g or t
  misc_feature 261: h=a or c or t
  misc_feature 314: s=g or c
tggattgaaacagctaatcagctgcagaaactggagggcagcagtggacctgtgcggacgtctcctcacagcccacggccagggctacggcaagagcgggctgctcaccagccacacgacagrttcactgcagstcttggtttgtcaggctggcactactagtgaagttgggccttttccagaatgctgagatggaatttgaacccttcggaaatcttgatcagccagatctttadtacgagtactacccgcacgtgtachctgggcgcaggggctccatggtccccttctcgatgcgcatcttgcacgcggasttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctat

SEQ ID NO: 9879 - DNA, 142 bp, Homo sapiens
  misc_feature 9: r=a or g
  misc_feature 10: s=g or c
agacgcggrscatggccgaggtgttgcggacgctggccggaaaaccaaaatgccacgcacttcgacctatgatccttttcctaataatgcttgtcttggtcttgtttggttacggggtcctaagccccagaagtctaatgcc

SEQ ID NO: 9880 - DNA, 247 bp, Homo sapiens
  misc_feature 36: s=g or c
  misc_feature 37: m=a or c
  misc_feature 38: s=g or c
  misc_feature 47: r=a or g
  misc_feature 143: r=a or g
  misc_feature 144: r=a or g
caacatcaaccgacagttggaggtatacacaagcgsmsgtgacccaragagtgtggctggggagtatgggcggcactccctctacaaaatgcttggttacttcagcctggtcgggcttctccgcctgcactccctgttaaggrrgattactaccaggccatcaagagtatgtattcccgtgtgccagagtgccaggtcaccacatactattatgttgggtttgcatatttgatgatgcgtcgttacc

SEQ ID NO: 9881 - DNA, 259 bp, Homo sapiens
  misc_feature 131: r=a or g
  misc_feature 137: k=g or t
  misc_feature 138: s=g or c
  misc_feature 251: n=a, g, c or t
  misc_feature 255: h=a or c or t
aatcaccgctctaaatgccagcgggcagcacacaatacgcgcccattaacaggtttaaagtgtcgcagcgctcgctttaaatgagaaaagcaggcgacaaaagggggaaaaagccaagttcctcaacttgragaatksccttgggtcgcctcgaaatcatctacgcgagtttaaaattcggagctagctccgcagaaaagctgaggccccggtgcgagggctgggggtgggaacgggggctgtgaataacncgchtgcc

SEQ ID NO: 9882 - DNA, 202 bp, Homo sapiens
tggatctccacctttctttctggaaacctcattctttcatccacaagagttgttcccatctcaagatattaaccctttatttttgggtgttcgtcaatatagaaaagtactgccttcccacattcttccttcatcccagtttttcccaccctaactccctgttaggctagtcagtattgtcctttgggattccagaccctgc

SEQ ID NO: 9883 - DNA, 462 bp, Homo sapiens
  misc_feature 150: k=g or t
  misc_feature 151: r=a or g
  misc_feature 155: w=a or t
tgtaaaaataaattgtttactccttttaagaattttctgtagaatattgttaataacatggataaagggggaagattcccaaggcctatgtaaggctacagggagccaaatatcttgtctggctctgactattaaaatactatgatattkrattwaaaggatgaagtcaatacaagtatacaagtaacaattaacacaggtaattatgttggtttttgaactaatatgcaactttcctgctaataacatatatggtggtttaacacaacttttaagtggtatagttttgttggactccatatagagagtatatacattttgaggtgacaaagtggatttacttataacactttctccagcccaaactctcataccagtcatagctattgttaatctccataatttggaatgttcaggtcctatgtggggaacaatgagccttggctttggaggcgcaacccc

SEQ ID NO: 9884 - DNA, 316 bp, Homo sapiens
  misc_feature 158: n=a, g, c or t
aaaaaatttttgcacagagtatctttttctatgtgttccatgtatttgtgtctttggagctatagtctcttgtagacagcatatcactatcttgttttgttttgttttgttttttctgtccattctgccaatttctgccttttgattggaaaatttantccatttgcatttaaagtaattaaggaaggactttcttctaccatttaacacttcttctatatgtcatatacttttttggcccctcatttcctctttatggccttcttttctgtttttttgtagtgaactagtctgattctctttccactccccctca

SEQ ID NO: 9885 - DNA, 133 bp, Homo sapiens
ttcttattaaagatttatttttgtagagacagatgtctcaatgtgttgcccaggctggaacgcagtgtcgcaatcttggctcgctgcaccttccacctcctgggttcaagagattctcgtacttcagcctcca

SEQ ID NO: 9886 - DNA, 436 bp, Homo sapiens
tcattacacgaacatggcacactcacccaagactaactgcgtttgcgcaggatgtcttaccacattgttttggtgtttttgagtttacttgtctgatacaaaatatctggttcagttctgtttcccatagtgctcagcaaaatgcctggcataatagattcagtaagttattcactgaatgaatgatgtcttagtaattgtataattatatttgttggtacatgtattacctaaagtattttagtggaatgtcagcacttgttatatctaattggtttgctgtaaattgtgcatctggaaggagagaagtctcaaaagtaattctatacagagtgtgggttatttaatcatcagagcttaactcatgccttagggaccttatgaacaaagtttctagacaaaaacatcaaagacaaaatgttagaaaaggaaagga

SEQ ID NO: 9887 - DNA, 483 bp, Homo sapiens
  misc_feature 317: n=a, g, c or t
  misc_feature 454: v=a or c or g
tccacagtagccatttgctgcattaaggtgcttaagggctttccccaaatttgttttatgggtaccaatgatattttcaacatgaagaaaaggtgctaattatgtcttggctgttactgtagaaaatattttgacaagagttaaggtaattgtgagcatgggactggaacaggaggaaagtagtgcattgaccttcttggcattttgttccacacagccttgttctgttgatattccagaactgtattttcagactgaaatcccaaagatggtatcagagtctagctttaaaatgtcatgctcatgaaactctagtnctaggacataactgaaatactgaaagcagcacactatttttaaataattcgtattttgtaaagattatttgtaatgcagactccttaaaggaaaaacaattcattcagatcccaccagcacaaatactttaattagvcaaaatcttcaagttatttcctctcacaa

SEQ ID NO: 9888 - DNA, 466 bp, Homo sapiens
  misc_feature 427: k=g or t
catggtctttaatattaatctatgtataaagtcctgtatgcagttttacctactttcacagctgaaggaacaatagcttagagaagatgtgagataaagtagtttgcccaagcccatagcacaaataagtgaagttcttcggctgtccatggatcgaagactcccaagtctatctctagcctggacttctgtcctgagcaccagacatgtatgtatatcaagatgcctgcaggtcatatccaccaggacaacccatgagtacagggaattcaacatgcccaatatcactcatcttttccttcgccctcccctttgtactcatcccctgtcggtaagctctgttattttaaaaaattgaaatgtattcacatagcatacaatttacacttttcaagtgtaacatgggttttagtatattcacaagggktgtgcagtcattactactaattccagaatgttattatca

SEQ ID NO: 9889 - DNA, 450 bp, Homo sapiens
tttggttccagcttacagtcctttgatgtgggaagccatagactctgagcattgggggtttagcctttatccagctaaaatattgcctgttgatgttatctatctattttctcttgttatacaatgccatttgcatgcacttatcccccagtcctcccaccctgtgagtcattctctcctatattagaagtaatctttttattagggcaggagtattgttggatttttttgcctaacggcctcttcctccttcttctatcccttggtttaaatttaattaaaaatagtacaatagaaatccttttatgtatatatctaccccaccaaaactgagggtgggattccatgcgcaccgtgcatctttgatccttggcaaactgacaaggatgtcatatatgtattgtagtggtcaaaattaatgttttgtttacttttttttttggagacgga

SEQ ID NO: 9890 - DNA, 428 bp, Homo sapiens
  misc_feature 159: w=a or t
  misc_feature 379: k=g or t
tcttgaactctattttgtctaatacttgtataggtactccactttttttggcttccattgccatgaattatctttttccatcccgttgttttctttctgtgcatgtctttatagacaaagtgtgtttcttagaggcaacagattggtgttttgtttgtwtgtttgtttttccatttagccagactatgtcttttgattggagagtttagtccatttacattcaatgttagtattggtagttaggacttacttttgtcattttgttatttgttttctggttatgttgtggtctgctcgtctttctttcctaccttcctatttttctttagtgaaggttattttctctggtgatataatatagttttttgctttttatgtktgtgtatccattctatgctttttggtttgagattaccatgaggcttgca

SEQ ID NO: 9891 - DNA, 324 bp, Homo sapiens
  misc_feature 27: v=a or c or g
  misc_feature 143: y=c or t
  misc_feature 158: r=a or g
  misc_feature 178: s=g or c
tttgtttgctttagtctctctaaaatvtcagggaaaaactatgagtctcaaaatgcttataagcaggaacaagctgattttactactaggaatagtcttttttgaacaaggtaaatctgcaactctttcgctccccaaagctyccagtttgtgggcaraagtctggttaaggtacagscttggaattattttaacattttcagtcgcattcttggaggaagccaagtggagaagggttcctatccctggcaggtatctctgaaacaaaggcagaagcatatttgtggaggaagcatcgtctcaccacagtgggtgatcacggcg

SEQ ID NO: 9892 - DNA, 301 bp, Homo sapiens
  misc_feature 32: s=g or c
  misc_feature 34: m=a or c
  misc_feature 38: s=g or c
  misc_feature 133: m=a or c
  misc_feature 145: w=a or t
  misc_feature 146: w=a or t
  misc_feature 162: s=g or c
  misc_feature 173: s=g or c
catgatttaatatatggatttttttatttaasamaaasacgagggactctttgtcacgtgggtttgttttctgtctccgtgcctccggcttcccaaagagatccaggtctttgcgtttccagggcgtggggamcccggccccctwwgcggcaacgccgccasaccgccctcascctggcttctgtgctacttggcagttccatttcattatttattttttgtgctgctttttatcatgatataaattattgaaaacagatcacatgtgggcccgtgtctggccgccgccgccctgccccct

SEQ ID NO: 9893 - DNA, 326 bp, Homo sapiens
aatatttaggtaggcattgtggtataatggatagcgtgttggataggagtcagtcttggttgacagttgcggtactgctaccaggatttgattgtagtcaagtcatatataatctttctggatttttgtgtcatttctatgacatgagctatatgacctagatgatttttaaaaagtaaaaattctaccttttaggaagtaggcatatgaatgagcatttaaaaaatattaggtagacatggacttaatgtatgtaaatgactcatttaagattgtgtttttctttagaggatcgcttcttaacaactttgtccagccagagcacc

SEQ ID NO: 9894 - DNA, 426 bp, Homo sapiens
  misc_feature 18: m=a or c
  misc_feature 138: r=a or g
  misc_feature 372: m=a or c
  misc_feature 373: w=a or t
  misc_feature 374: w=a or t
  misc_feature 375: w=a or t
  misc_feature 404: k=g or t
ttactatgttggacaggmaggtctcgaactcctggcctgtggtgatccacccaccttggcctcccaaagtgctgggattacaggcctgagccactgcgctcagcccactttcttttttcacttgaactactgtggtarccttttaactttattcctgtaccattgtgtactctatttcattattcacagagcagtgatcctttaaaaatgatattcgattgtgtcattattgtgcttaaaaccctttaatgtctttccattggatctaaaaatagcatgcatactctatagcctgcaaggatctgcattgtttatttgttccctctccttgtctggaaccttgcttactgtcttactggcccattggccttmwwwctcttacctgaacacgagacatttttctktatatttgttcctcttctctgt

SEQ ID NO: 9895 - DNA, 159 bp, Homo sapiens
gcttatcccacattgagtcctttatcctttccttctcttttccaccaaacttcctcttctgtgtcttacttatctcagtaaggggcacattcattatccagtggctcaaggcatacaaagtaacagttttcctttattctgatcttgtcatcatacccc

SEQ ID NO: 9896 - DNA, 238 bp, Homo sapiens
  misc_feature 134: w=a or t
  misc_feature 181: k=g or t
cagctgttatttcttcatatactttccaagccctgcccgctgtcttttctcccttggtactctgatgatgagaatgttagttcttttttcacagtcccacaagtccctgtggctctattattagctttatttcwtctggtctatttctcgatttctctctattgttaagtttgggtaattkcttttgttccatctttcagttcactgattctttcttctgttctgctgttgagcacat

SEQ ID NO: 9897 - DNA, 295 bp, Homo sapiens
  misc_feature 58: r=a or g
  misc_feature 59: w=a or t
  misc_feature 69: r=a or g
  misc_feature 82: r=a or g
  misc_feature 83: w=a or t
  misc_feature 126: k=g or t
  misc_feature 129: m=a or c
  misc_feature 133: m=a or c
  misc_feature 136: r=a or g
  misc_feature 158: b=c or g or t
aatcagtacggccttccatttgaaaaatggcttcttatcgggtccctgctctttggtrwcctgttcctrgtgataggcctcrwcctcctgggtagaatcctctcggaatcactccgcaggaaacgktamctcmagractggattacttgatcaatggbatctatgtggacatctaaggatggaactcggtgtctcttaattcatttagtaaccagaagcccaaatgcaatgagtttctgctgacttgctagtcttagcaggaggttgtattttgaagacaggaaaatgccccctt

SEQ ID NO: 9898 - DNA, 276 bp, Homo sapiens
  misc_feature 267: n=a, g, c or t
cattcagtttttataatgtatttttgcaaactactgtaaatagcaaatcaatgccaatgttaaacaaagaggaaaacgttgtgtggactttgttctcttgcaccggtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgtttngagagacac

SEQ ID NO: 9899 - DNA, 354 bp, Homo sapiens
  misc_feature 109: r=a or g
  misc_feature 110: k=g or t
  misc_feature 288: s=g or c
  misc_feature 315: k=g or t
gtctgcaggatggcaccggacccctgatggagtctcacagtgtcgccgggctggagtgcaatggtgtgatctcagctcactgcaaccttcgcctcctgggttcaagcgrktctcctgcctcggcctcccaagtggctgggattacaggcacccgccaccatgcctggctaattttttgtatttttagttgagacggggtttcactatgttggccaggctggtctcgaacttctgacctcatgatctgcccgcctcggcctcccaaagtgctgggattacaagcgtgasccaccgcgtccggtctgcttaagtatkttctatatgaatagaaagtaaaaatgctctgagagtaag

SEQ ID NO: 9900 - DNA, 302 bp, Homo sapiens
  misc_feature 251: n=a, g, c or t
  misc_feature 253: d=a or g or t
  misc_feature 269: s=g or c
ccaaatgttcccttttgtatttttttatttttttgatacagagacttgctctgttgcccaggctgttgtgtagtggcacagtcttggctcactgcaatctctgcctcccaggttcaggcgattttcctgccctcagcctcctgagtagctgggatgacaggcacgcgccaccatacccacctaatttttgtatttttagtaaagaccatttcaccacgttgatcaggctggtcttgaactcctgacctcgngdtccacccgtctcagcstcccaaaatgctgggattacagactacagacgt

SEQ ID NO: 9901 - DNA, 274 bp, Homo sapiens
aatgcagtctggaccttctgggctcaagcgaccctcctgcctcagcctcccgagcagctgggaacacaggcgcacaccaccacgcccggctaatttttaaattttttgtagagacagggcattgctatgtttcccaggctggtctcaaactcctgagctcaagcgatcctcccgcctcggcctctcaaagtgctgggattacaggcaggagccaccacgcctggcctatagcaattttgaaaactggctcaagcccattcctctaccccctaac

SEQ ID NO: 9902 - DNA, 253 bp, Homo sapiens
actaagatcatcaactttcttaaactgaatctggttttccttgggctctgtcgtctgtgttgtgggtttgtggtggtggacacaggatgtgacattcttgctgggatccctgaagtgactatatcctctgcaataacagaaattttcactgtattttcttcaactcaggccctccctctgttgttacctgccatctgacacggaattttgtgtaattttccttccaagtaaagaagggaagtttagccccata

SEQ ID NO: 9903 - DNA, 182 bp, Homo sapiens
  misc_feature 124: w=a or t
  misc_feature 143: n=a, g, c or t
  misc_feature 145: n=a, g, c or t
  misc_feature 172: d=a or g or t
  misc_feature 173: v=a or c or g
  misc_feature 174: d=a or g or t
  misc_feature 175: n=a, g, c or t
caaagacgcactacttagtacagagaggttttgaatacatgctctgtgcatgcaaggcacgtggggtgatgctgctgctgttctcagggtggttggtttggtggggcagtaggtcctcacagtwcctcagaatgcctgagagntnagtaagtggggagggtcgaagcgatcdvdngccacat

SEQ ID NO: 9904 - DNA, 211 bp, Homo sapiens
cagctctccacattgccccctggtggtacaggcccggctctgcgtctacccctactacacagccacctgttgccgctcttgcgcacatgtcctggagcggtctccccaggatccctcctgaaaggggtccggggcaccttcacggttttctgtgccaccatcggtcacccattgatcggcccactctgaaccccctggctccccagcccct

SEQ ID NO: 9905 - DNA, 230 bp, Homo sapiens
  misc_feature 207: k=g or t
tttggggcggtcttgctctgtcccccaggctggagtgcagtggcaccatctctgctcactgcaacctccgcccctcgggtttatgcacttcttctgcctgagcctcccaggtggctgagattacaggcgtgtgccaccacacccagctaatttttgtattttcagtagggtcagggtttcgccatgttgcccaggttggtctcgaaktcctgacctcaagtgatccacac

SEQ ID NO: 9906 - DNA, 395 bp, Homo sapiens
  misc_feature 127: n=a, g, c or t
acattgtagcaaaattttttgccctgtcagtaatgaattgctacatcattaattttgtcaaaggatcaagaaacaacattgctgagctcaaagaaactcctagatgaatgaatatagttgggttgangtgctggtgtggttagttgaattcagcagttgaatccacatgaccgtttctttcctcatggtcagcctgacctcaactgccaagggtggcagggtgcgtcccatcccccagtggggaggaggctgtgtagtcaacactgcattcggttccttacgtttccctgtgacactgtcctggcctgtatatatttatatattcacttacttcaggcatgtctaaagtggtaaatgaaaaaatacattaaaaaaaagtcagttggaataaaaat

SEQ ID NO: 9907 - DNA, 411 bp, Homo sapiens
  misc_feature 119: d=a or g or t
  misc_feature 120: n=a, g, c or t
  misc_feature 124: d=a or g or t
tcattcagcagtttcaacaaaactcattttacatcaacagtagctccctcatacacctactaagcttgggtgctgcaaaaggagagaagcaacacatttgtagagtcagttccagagcdncacdagttccgtgcagatttttctgcccactaaatgtgctttttggaggcaggtattctttgattccccagtcagagtattttccttaaagtcacttgaattataactaagcagtttccctgtactctgcccaccaaatattcctgagtaagaagtttcttttcttggcaccatgcccaggactcacatccaggagtggtgcctctgagccttttctggcctctattttcagaaatctgcaatcaactgctaacatcccctgcttgttacgggtcctcacgttttatgata

SEQ ID NO: 9908 - DNA, 221 bp, Homo sapiens
  misc_feature 22: r=a or g
  misc_feature 134: r=a or g
  misc_feature 137: r=a or g
  misc_feature 142: k=g or t
  misc_feature 143: n=a, g, c or t
cacagcatagccacgtcagtgrgttgcgcctctcgcacaggccattctgggtctggtggtgccaggtgccgtgacacgccgtgctgggcttgtgctgcagctgggtggtgtggcccctcattctcatgttccarctrctggknagtgctctgcctgtgtgctgcgcctgcaggctgcgtgtgctgccgtggatctcctgcatcccttgacccctcccgcga

SEQ ID NO: 9909 - DNA, 322 bp, Homo sapiens
  misc_feature 112: h=a or c or t
  misc_feature 115: w=a or t
  misc_feature 129: k=g or t
  misc_feature 142: w=a or t
  misc_feature 316: k=g or t
ttatcaattaggttaaggtgttttaatagcacttttcaaataatctatgtatttgttgttgttttttgttgttgttgttttgtctcattctatcagctgccaagaagaaaghtawaatatccaactatkactgtggaattawctgtttttcccttaattctgtcaagtttttctcactcattttgaagctctgttgtaagacatgtacaacttatgattattatgttgttttgacaaattgacctttttattgtgatgaaatgtctctctgtttctggtaataatcttttccttgaagtctgctttatttgatgtkaatata

SEQ ID NO: 9910 - DNA, 441 bp, Homo sapiens
  misc_feature 49: m=a or c
  misc_feature 119: r=a or g
  misc_feature 148: r=a or g
  misc_feature 149: r=a or g
  misc_feature 217: m=a or c
  misc_feature 286: b=c or g or t
  misc_feature 316: w=a or t
  misc_feature 321: m=a or c
  misc_feature 322: m=a or c
  misc_feature 367: k=g or t
  misc_feature 378: m=a or c
  misc_feature 418: m=a or c
  misc_feature 439: w=a or t
  misc_feature 441: y=c or t
taatttttttatttttagtagagtcccggtttcaccatgttggccaggmtgttcttgaactcctgacctcaagtgatccacctgcctcggcctcccaaagtgctggaattataggtgtragccaccatgcctggcctagagttctttrraatgggatttatctcagagttaaaaatagttaaacatcgttgagtggtttccatgtgccaggcactgmgatgtgttttacatatattatctcatttaatcttcactataatccaatgacataagtctatttttattbtttatgtatatgtaaatggtaaatgtatgwataammagcagtaaagcaaggcactaggttaactaacttgtccaacatcakattggtaatamgtgattgagtcaaaatttgaatttggcattcattcttcamcatgttttactcttcatggtway

SEQ ID NO: 9911 - DNA, 325 bp, Homo sapiens
  misc_feature 15: k=g or t
  misc_feature 16: k=g or t
  misc_feature 104: w=a or t
ctatacatagtgttkkttcttaattatttgtaagagcccttttatatattagatgttagagataattttcttcagtttatcatttttatttttaatttgcttawggtggtgttttgctgtcctgatgtttccatttttacataggcgtatctataaaacatttccttttgggtcatgcttaggagtaaatttttgtgttccatatttatgtaagttctctgtgctgtaggctttggtagtatttttaacctctcctttttagcagttatcatgattcattagttctgtgattttttttttctataaacagtttggcacctttctc

SEQ ID NO: 9912 - DNA, 249 bp, Homo sapiens
gagagacccgagtgcacgtgtggagaagcggcggcacaagcgcggcggcgggagacactcccgcccccaccagactcaagccctcactcgactctcgcggcctttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggagcat

SEQ ID NO: 9913 - DNA, 430 bp, Homo sapiens
  misc_feature 93: m=a or c
  misc_feature 96: r=a or g
  misc_feature 272: v=a or c or g
  misc_feature 274: b=c or g or t
  misc_feature 366: n=a, g, c or t
taaaacatatgtgtctatggttttcaattggagtagtctttcttactttcccccttcccctctttggttctcctaaccagcttagaggacccmaargagagcttagggatagacaccagaatactctgtggaggtggaacaacttaacctcactgttttcccttccaagtataggaagagcaaatagagcatagtaactgtatctaaattctctacctgctcttagcaaaagcaaaatcccacagaatgattgcctgctgtctttacctatvcbtcaaggaaaacaggccacttttggagaccatagagcaccatttatctgtcaaatacttggaaactatttacttaacggtcatcagtaaaaancctaaacaaggtcatgatataatttaagaccaattcccctactctcccaataatcacatagtct

SEQ ID NO: 9914 - DNA, 273 bp, Homo sapiens
  misc_feature 80: b=c or g or t
ccctgtgtctggtgggcgtggcgtgcccggccacacgtctgcctcccagcctgcgcccctgccgtcgccttgcctccagbattctcactgggcagttctgtggccctctggctcctggcccttgctgtgcagctgcggggcttcagctccttgcctctaatctccacgttcagaaatctcacggcagtgtgagcccatcaggcctttgctctctgacagcttcctgtcctgagcttctgttgaattcgtcgttagatgtgtctcccttcttct

SEQ ID NO: 9915 - DNA, 362 bp, Homo sapiens
  misc_feature 172: n=a, g, c or t
  misc_feature 326: m=a or c
ccattcacaattgcaatgaatcctcacagcaatcctatgaggaatgtattatcattcccattttgcagatgaagaaactaagtctgaagagcttaagatcttgcctaaggtccccaccaggccaagctggggtttgaacctagggccaccttgacactaaggcacatgcccntcatcacagtcttggtgctgtcaggagccaagggatgaggtctcttaaaatccctcttggctgtaggattctaagcctttcgatggccagcccagactgttttgctcgtaatgcgtgttcactttgcccacatttaccaggaatgctgtggtgmatcacctgtaggtagactgctatgaggcccatgcac

SEQ ID NO: 9916 - DNA, 316 bp, Homo sapiens
aaagttgaaagtgtcctttctctctctctttaataaactcagtttggtacttgataaataatcatagtcttaaatgttagaaatcctatataatattatttatttaaaattgcagatttttaatttaaaatacatttttatttttaaattttgtcttttcccttttttttcagatcaacaacccctccccgtcgtaaacgctgaggaatgatgtggcaagaatgccatgatgttctttaaaaaaattccatgagttttaagggcttgtctcattatagaggcacattgtggctgtgtaggtgaaacagaatctttt

SEQ ID NO: 9917 - DNA, 443 bp, Homo sapiens
  misc_feature 109: y=c or t
  misc_feature 113: k=g or t
  misc_feature 116: m=a or c
  misc_feature 345: k=g or t
  misc_feature 361: d=a or g or t
  misc_feature 362: n=a, g, c or t
gaattttgctttgctgtctcagtcaggtttctgtttttctgtcctccttgcctttcttcccgttttgcttcctgttttccttcttccttcccgttttccttcttccttycctkgcmtcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccaktggtgaaaatacatgdnctttagttctagtagtgagcattcaaaggtccgtgatagggcttgtcacagagagagagaaatcatttatccctattgtgc

SEQ ID NO: 9918 - DNA, 387 bp, Homo sapiens
  misc_feature 17: r=a or g
  misc_feature 18: k=g or t
  misc_feature 108: s=g or c
  misc_feature 109: m=a or c
  misc_feature 267: r=a or g
gggatttggcaatatcrkattttgcctttttgtgttcagttttgcctttgtgtgttgttaggttattaacatttagcctaagaaaaatgtgtttaattttgctttttsmagagttggcctctactttgaccagagaaactatagcagtcttagacatagcaaacccacctctgcctactacactcgggtttgtctaaacttttttggctttatgtgtttgattcacttttaacatatttctaatctcgccattttgcattttgactrgctgtaactaatctgtaaatggctacgtatatactagtttttggtaactgaatttatatagtctgtgggagtctctttaaacaacgggaactattcagtcatcatgtttataaatcagta

SEQ ID NO: 9919 - DNA, 221 bp, Homo sapiens
  misc_feature 139: b=c or g or t
ttgtacaagaatttgcttttcttgccttttcgaacttctcatggttgtacgtagatctagttctttgcttctattgttgtgtgctgttttcaaatatacacacacacgtgtacacagcaaattgtatttgtccttttcbttaatcatctgcatttggttgccattattttgctactaaaaatagtaccttgctggacttttagaacatatattccccacaa

SEQ ID NO: 9920 - DNA, 162 bp, Homo sapiens
  misc_feature 160: k=g or t
caaactgttgaaaagttaactcttatgttatttatattttcagacatagattggaagatggacttatgctttttctctttctctcctttccttccctcccttcctttgttggaggctgaaagaatgagggtcagtgatcaacttcagtataccactggakac

SEQ ID NO: 9921 - DNA, 285 bp, Homo sapiens
  misc_feature 84: k=g or t
  misc_feature 132: s=g or c
  misc_feature 134: k=g or t
  misc_feature 138: k=g or t
cctcaggtgatccacctgccttagcctctgaaagtgctgggattatagccatgaactacctcgcctggctgttgtgtgttttakgacttctaaatgagtgcatatactccttggacatttatatacgtcttstktttktattttattttatttgagacgagtctcgctctgtcgctaggctggagtgcagtggcgcaatcttggctcactgcaacctccgactccttgttcaaaggattctcctgccgcagcagctggaattacaggcacgtgccaccacgcccc

SEQ ID NO: 9922 - DNA, 457 bp, Homo sapiens
  misc_feature 358: n=a, g, c or t
  misc_feature 380: s=g or c
  misc_feature 389: s=g or c
  misc_feature 440: r=a or g
actatcaagcaaccaaactgcaagctttgggagttgttcgctgtccctgccctgctctgctagggagagaacgccagagggaggcggctggcccggcggcaggctctcagaaccgctaccggcgatgctactgctgtgggtgtcggtggtcgcagccttggcgctggcggtactggcccccggagcaggggagcagaggcggagagcagccaaagcgcccaatgtggtgctggtcgtgagcgactccttcgatggaaggttaacatttcatccaggaagtcaggtagtgaaacttccttttatcaactttatgaagacacgtgggacttcctttctgaatgcctacacaaactctccnatttgttgcccatcacgcgcasaatgtgagstggcctcttcactcacttaacagaatcttggaataattttaagggtctagrtccaaattatacaacat

SEQ ID NO: 9923 - DNA, 341 bp, Homo sapiens
  misc_feature 184: d=a or g or t
  misc_feature 245: s=g or c
  misc_feature 317: n=a, g, c or t
atctttccttccttcacttaatcacctgttagcatttaccaagtgcttgctctgtcctggacgttatacaatgaggtggccctggaccctggggtcttgctgtgtgtgggcgggggtgatttcccagggatggctctcaaaacagggacgtgaaaatgcatttggagagatcttcaaattcctdgaggatttgaaattttcatttttatttcaacaataacttgttcagccaggcgcggtggctsatgcctgtaatcccagcactttgagaggccgaggcaggtggatctcctgaggtcaggagttcgagaccagcntggctaacatggtgaacccccccc

SEQ ID NO: 9924 - DNA, 426 bp, Homo sapiens
  misc_feature 344: b=c or g or t
  misc_feature 346: s=g or c
  misc_feature 372: d=a or g or t
  misc_feature 373: b=c or g or t
ctttttcatgtattgtgaagttggaaatgtattgaattgaaatttcgattaaaaaatgtagtgaagcatattactttgtcctctaacctaactattaataactttcttgttgtttttatatttaaaaaataactctggattttttaattccaccattttgtgaagctccaacttaggaaaaatcagtcattcatcctctctgcactttgggcaaatgagcgtgtgccttgggtggactccagtgttaggtgggcttggggttgccttgctgtcctcatgccctcgtctgccccactgccaccctgctccagctctgcaccgagtaaatcatctctcagagctcbtsaccatgctcaggatatcgtcctgctdbcaattctacagataaaaattgtaaaaatcaggaaacaccaccttagcttcata

SEQ ID NO: 9925 - DNA, 303 bp, Homo sapiens
  misc_feature 267: w=a or t
  misc_feature 268: n=a, g, c or t
  misc_feature 280: m=a or c
  misc_feature 281: m=a or c
  misc_feature 297: r=a or g
ctcacacacacacgcactttcttcaggaaccctccagccctccaccacgtggcctgaatggagccctcctcgtccacctgttttgggcttggttctgctcctttttcctgagtgggggattttggagggtgctgcccttgggcactcagtgtggatttgatgctgtggaaggggacaggagagctggtgggccaagctgggagggcagttaccgtggagtgagagccaaggccagccggcagaagtcacccacaagagggtgaacgwnggaagtggggcmmaaggaaattactgacratttta

SEQ ID NO: 9926 - DNA, 315 bp, Homo sapiens
ggtttagttaacatactgcacacacacactctctgtctctctcacacacttagcttttctatgtgtatatacatgtacatgtatctatattctaacctggctttggtggaaccagctttcttgctctgtgcacagacaccttcctgctgctcgtttcagccctgatgtggtggaatgtgtctgaagcatgcgtttctaggtcttttccttatggcctccacaaagtggtctcgatggccctcagttctgttcagcagtaatgcaaagtgaagatgtttctctgactcaaaagtgagatgacattaattgagcgcc

SEQ ID NO: 9927 - DNA, 221 bp, Homo sapiens
  misc_feature 104: y=c or t
  misc_feature 124: r=a or g
  misc_feature 159: w=a or t
  misc_feature 199: k=g or t
  misc_feature 201: n=a, g, c or t
  misc_feature 202: s=g or c
gggaaagctgcttccgggtcaatgcaggacactgggctccggcggccagagtgggggactagcattttaagaaagaaagatggatcaacctagtggaagaagtytcatgcaagtaatttatgtraaaaatatagtcctgaaaattttccttatcgccgwggcccggggatgggagtccatgtcccagccacacctcagkgnsctcctatgaaagatcgccc

SEQ ID NO: 9928 - DNA, 150 bp, Homo sapiens
  misc_feature 96: m=a or c
  misc_feature 106: m=a or c
  misc_feature 119: y=c or t
  misc_feature 120: m=a or c
  misc_feature 122: m=a or c
  misc_feature 134: m=a or c
tttcccctgccctgtcctctcattccccttcttctggagcatttcatccacagaccccttgcccaagaatgtctgtctcagctctgcttctagagmtcctccaagmtgccatccctcgymamacctcaggcttmcaagacctgcccaact

SEQ ID NO: 9929 - DNA, 373 bp, Homo sapiens
  misc_feature 71: m=a or c
  misc_feature 115: w=a or t
  misc_feature 125: r=a or g
  misc_feature 279: k=g or t
  misc_feature 305: h=a or c or t
  misc_feature 306: w=a or t
  misc_feature 307: w=a or t
tccaacagctaaaccctaagttaggaaaaaagaatataatttgacttcatctggaaaaaaaattatcctamaagatggttagaacattcagtaatagtttgcagtttttaaagawaagctcacargtaaagttcttgactgttctttcattaagcaaaaaacatgaagcttttttctttctccaaagtctcttcaaggcgcccgctagactcaaactcatcacaccttatattccatgcctgagtttccctttgtaaattaatggctctcttctctctkgttcctccaaagtttaatttgtacahwwgccctacagttgtgatttattgtaaaagaatattctgtctttttctcaccttttccccagatgagc

SEQ ID NO: 9930 - DNA, 194 bp, Homo sapiens
  misc_feature 103: y=c or t
  misc_feature 120: m=a or c
  misc_feature 176: n=a, g, c or t
ctcaactaaagccctgccccacctaatgtatattagataaggggtgggggatggtggtggtagtaatcaggactctgaccaatattctatgccaaaggatgcyaaagatacaaagttttmagttctcagtagatttccatgaaaagtccttggccaccctggaagaggcatactgnctgtcctacccccaccat

SEQ ID NO: 9931 - DNA, 183 bp, Homo sapiens
accgcatgcaccaccacgcccagatagtttttgtatttttagtagagaggtttcaccatgttgcccaggctggtcttaaactcctggcctcaagtgatccacccacctctgcctccccaggtgctgggattacgggcaagccaccacacctggcccaataggtagtttttcaatcttcaccct

SEQ ID NO: 9932 - DNA, 323 bp, Homo sapiens
  misc_feature 124: m=a or c
cagccaagtttcttctacctctttggtttgtttgtttgtttgtttgttcgtttgtttgtttgttttttagtcggagccttgctctgtcgcccaggctggagtgcagtggtgcaatcttggctcmctgcaacctccgcttcccaggttcgagccattctcctgcctcagcctcccgagtagctgggattacaggcatgtgtcaccatgcctggcttatttttgtatttttagtagagacggggtttcaccatgttgaccaggctggtctcgaactcctgacctcaggtgatccgcccacctcggcctcccaaaggtgctggaat

SEQ ID NO: 9933 - DNA, 137 bp, Homo sapiens
  misc_feature 54: k=g or t
  misc_feature 92: r=a or g
  misc_feature 93: v=a or c or g
  misc_feature 98: m=a or c
  misc_feature 100: v=a or c or g
  misc_feature 108: b=c or g or t
  misc_feature 109: r=a or g
  misc_feature 114: r=a or g
ttattatttttatgggacatgttgtgtttggggatataaaaaatagtttattakgtttaagggcttcgcagcttagtgagggagacacatgrvtgaamtvatgtccabrtatgrtgagaggtaaacacatatcctat

SEQ ID NO: 9934 - DNA, 439 bp, Homo sapiens
ctcatctgtcttccagttcacgaatgccctcttctgctgtgttttatttgctgctgaacccctccatgagtggttccctccgtccattgagttttacattttgattatgaaagtttttatttctaaaagttttgttatttttgtcaaatctgcaatgttactttttatagttttctattctaggtattctcaagctcaccatttgtgtctttaaacatagtttgacgtctgtaatcccagcactttgggaggccgagggggtgggtcatttgaggtcaggagtttgagaccagtctggccaacatgatgaaaccctgtctctactaaaagtacaaaaattaggctgggacagtggttcacacctgtggtcccagcactttgggaggctgaggaggtggatcacgaggtcaggagtttgagaccagctggtcaacagggt

SEQ ID NO: 9935 - DNA, 225 bp, Homo sapiens
ccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgcccccgcct

SEQ ID NO: 9936 - DNA, 262 bp, Homo sapiens
ttagtaaatatttctggaatgacattattctttgcaccctcagagactcctgtgtacttactggtgagacttctggtctctctctgggtaactgggaggtcatttgatttgaggtacaggctgaaggttgtggctgatggagaagccctctcacaacattccagtccctggcccactagggcatcccctcttacctgtgcaaataaaagtcctagttgattcaggcccatacatggtttagcctgctgcacttcaccgagga

SEQ ID NO: 9937 - DNA, 344 bp, Homo sapiens
  misc_feature 328: r=a or g
taagagaaaaagattcccatggagaaatgttcttcgaagtgataaccatgcttactcataaggagttgaaatgtagcttacctgctagttttcctccaataaaaatgtgtttatctttcattctgatttgttgtgaagcttttgcacactctaatttaaatcttggtagcatatatctagttgagtacccacagtgcaccaggctctattccagggcccaggaaatggaagtcagtaagacacgtggttcaagccctccctgagacagatggtagtacagaatggtatgtggtatgatgtgctgtagcacaagttgctggtagagtgraaaagaaagcttctac

SEQ ID NO: 9938 - DNA, 352 bp, Homo sapiens
  misc_feature 283: y=c or t
atttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttycatcttttggaaacagaatttctgctcccctgtgtacaccctttctctgtaattgcagtgtatgttttt

SEQ ID NO: 9939 - DNA, 218 bp, Homo sapiens
ttctcagatctccagctgcgtgatgggagaaccactactctctccaaagctgtcagacagggacatttaagtctgcagaggtttctgctgccttttgtttggctatgccctgcccccagaggtggagtctacagaggcaggcaggcctccttgaactgcggtgggctccactgacctcgagcttcctggccgctttgttttcctactcaagcctcgac

SEQ ID NO: 9940 - DNA, 393 bp, Homo sapiens
  misc_feature 374: s=g or c
gtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactctcagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgstattcaggatgcagttgga

SEQ ID NO: 9941 - DNA, 381 bp, Homo sapiens
  misc_feature 233: k=g or t
  misc_feature 234: h=a or c or t
agaaagaggtcttggtcaatcagcaggtgttcatcctataccttctgagtactcagcactgtgccagtgctgtgaggggtctgaatgaaacatatgggagtttcaatggtactggccctcttctgattcaaagtttgtcaactggccaggcatagtggttcacacctgtaatcccagcactttgggaggctgtggaggtagaccacttaaggccaggagttcgagaccagcckhgccaacatggtgaaacccgtgtctattaacaaatacaaaaattgctgggcgcggtggctcacgcctataatcccagcactttgggaggctgaggcgggcggatcacaaggtcaggagttcgagaccagcctggacaatactgtaaaa

SEQ ID NO: 9942 - DNA, 411 bp, Homo sapiens
  misc_feature 127: d=a or g or t
ctgctttgaaacagtttttctcccctctttttgttgggctgtcagctgttacttcttgtagctgtcagaatacttgcctctggctactatattctccacccttcctttgttattttctaacctgcgdttggctaggaaactatttaatctagcttgttggccttatatgtaaagtacaaataaacagacattgagtagatctctaaagactcctgaatcaaatgcatgaacttcagtgtacaggtttttgcataatttagatatttaaagattcttacttatttttttgtaattggcattggatgagtgaaatataattttgtgttgaactatgacctgaagagagcaacagttctccaaagggctcctaatttctggctgatgtcatctcaagttatttgtgtatttttt

SEQ ID NO: 9943 - DNA, 199 bp, Homo sapiens
  misc_feature 95: m=a or c
  misc_feature 114: v=a or c or g
  misc_feature 124: w=a or t
  misc_feature 130: s=g or c
  misc_feature 131: w=a or t
  misc_feature 164: m=a or c
  misc_feature 165: y=c or t
  misc_feature 167: k=g or t
cgagaccagcctgagcaacgttgtgagactgtctcaacaaaatttagctaggtgtggtggtacatgcctgttgtcccagctacttgggaggctgmggcaggaaaattgcttgavcccgggaggwggaggswgcagtgagctgagatcttgccattgcaccccamyckgggcaacaagagtgaaactccgtctcaaaaaa

SEQ ID NO: 9944 - DNA, 420 bp, Homo sapiens
  misc_feature 218: s=g or c
  misc_feature 219: m=a or c
  misc_feature 408: y=c or t
caattttggaataggtgtggtgtggtgctgaaaaaagtgtatattctgttgacttggggtggagagttctgtagatgtctattaggtccgcttggtgcagagctgttactcaagagtcttcttagctttcaagtaattgaagccatcttcacttagcttgagcaaaaatggaaaagaaagatactgggatatctcatacaactcaaggactcaggaasmgaatgaaatcaggaactggaaagatgttaggactttaatttgctttatctctttatctttttatctctgcttctctcgtagtatctgcttcatttttttcctctgcacatctgcctactctgcttttctagtctgcatggagaaggccctactgttgtaccccagtacccaagcttatgttacagttgyatgctagtttct

SEQ ID NO: 9945 - DNA, 335 bp, Homo sapiens
  misc_feature 102: r=a or g
  misc_feature 127: r=a or g
  misc_feature 238: r=a or g
  misc_feature 289: r=a or g
  misc_feature 319: r=a or g
ctattctgttctgttctattctgttctatactgtttttagaataacacactaggtaaagaaactttaactgcaaggagtcagtgacttttagtgctccctgrtaaatgatgttattgacaaaagtaraaaattatttcattgtttttttcctgtattactatctcctctcctgtgcttttgacagtgtgtttagtggatggataatatgtatttctctttcccactcccagattccarattccctgcctttttggcccacctcaccacaaaagctccatagtttattartgtaagtttgaatggatgcttctttggggraacttcaggagttaat

SEQ ID NO: 9946 - DNA, 313 bp, Homo sapiens
cttcagttctgctctgattttagttatttcttgccttctgctagcttttgaatgtgtttgctcttgcttttctagttcttttcattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggcct

SEQ ID NO: 9947 - DNA, 283 bp, Homo sapiens
agtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggatccc

SEQ ID NO: 9948 - DNA, 269 bp, Homo sapiens
tagttttcttgaggaggtggcaaagggtgaattacattgaacacaaagtaatgaatcctaaatttccctacacgtcagacttcccagtttctttctttcttttttcttttttcttttttttgagacgagtctcgctctgtcgcccaggctggagtgcagtggtgcaatctcggctcactgcaagctctgcctcccgggttcaggctgttctcctgcctcagcctcccgagtagctgagactataggctctcgccaccacagccgggcta

SEQ ID NO: 9949 - DNA, 146 bp, Homo sapiens
gtcttactctgttccccaagctgaagtgcagtgacagtggtgcgatctcggttcactgcaacctctgcctcctgggttcaagcaattattgtgcctcagcctcccaagtagctgggattacaggagcacgccactatgcccagcaa

SEQ ID NO: 9950 - DNA, 272 bp, Homo sapiens
  misc_feature 116: s=g or c
  misc_feature 121: m=a or c
tttgtgattagaacacttgaaatctactttcttagcaattttcaaggaaacaatacagtagtcaccatgttatacaatagatctcttgaatttattcctcctcccacaacctccgstgaamccagcattctactctctacttgtgtgagttcaacttttgtagattgtacatgtgaatgagaccattcagtatttgtctttctgtgcctggctatttcacttaacatagtattttccaggttcatcatgttgtcacaaatgacaggatgccc

SEQ ID NO: 9951 - DNA, 157 bp, Homo sapiens
  misc_feature 117: k=g or t
  misc_feature 122: y=c or t
tattatttaaatctgcacctctctctattttatttgccaggggcacgatgtgacatatctgcagtcccagcacagtgggacaaaaagaatttagaccccaaaagtgtcctcggcatkggatycttgaacagaaccagtatctgtcatggaactgaac

SEQ ID NO: 9952 - DNA, 245 bp, Homo sapiens
  misc_feature 85: k=g or t
  misc_feature 86: k=g or t
  misc_feature 95: k=g or t
  misc_feature 96: r=a or g
  misc_feature 98: k=g or t
  misc_feature 105: k=g or t
  misc_feature 114: s=g or c
  misc_feature 116: r=a or g
  misc_feature 245: h=a or c or t
ttttctgggtcatttgtacatctggatagcagagaactattaggttggtgcaaaagtaattgtggttttgcaattacttttattkktatttattkrtktattatktttgagtcsgrgtctcactgtcacccaggctggagtgcagtggtgtaatctcagctcactgcaacctccacctcccgggctcaagtgattctctctgcctcaacctcccaagtagcctcccaagccaccaccacgcccth

SEQ ID NO: 9953 - DNA, 154 bp, Homo sapiens
tttgtttgtttgtttgtttttttgtttttttttcctgtttctggggcttgaatcaggaaggaggtttttttgttgttgttgttttgagaaaggatattgctctgcattccagcctgggtgacagagtgagacttcatctcaaaaaaaaaaaaaa

SEQ ID NO: 9954 - DNA, 142 bp, Homo sapiens
caagttcatggccttaggtagcatgtatctggtcttaactctgattgtagcaaaagttctgagaggagctgagccctgttgtggcccattaaagaacagggtcctcaggccctgcccgcttcctgtccactgccccctcccc

SEQ ID NO: 9955 - DNA, 291 bp, Homo sapiens
cacatatattttagagtagagaagttctatagggcttattacaaagaatctgtcacctaccccatattctgctttttagtggcaaccactttaattcttccagctgactcctttgagttttgcctccatcttgccctctctttaattgaggtaatacttacagtgtaatgcacacatcctaagtgcacctcagtgaccatttactgatgtatatagtttcatgtaactaccacccagaacacaaaacattttcatcaccccacaaaggtttcctcattatcctttcccaca

SEQ ID NO: 9956 - DNA, 224 bp, Homo sapiens
  misc_feature 56: y=c or t
  misc_feature 79: k=g or t
  misc_feature 112: y=c or t
  misc_feature 121: k=g or t
  misc_feature 140: y=c or t
  misc_feature 208: y=c or t
  misc_feature 214: y=c or t
tttttagtagagataggatttcaccatattgaccaggctgatctccagctcctgayctcgtggtcaggctcccaaagckctgggactacaggtgtgagccaccgcgcctggyctgatttaktcttgctgtgtcgccaggytggagtgcagtggcgcaatctcggctcactgcaacctccgactccctggtttaggtgattcttctgcytcatcycccacccctc

SEQ ID NO: 9957 - DNA, 252 bp, Homo sapiens
  misc_feature 237: k=g or t
catgggaattgcattgaatttatggatcgcttttggcaatatggtcatctacacaatattgattctacccacccataagcaggggatgtgtttccatttgttcatgtcatctatgacttctttcagcagtgttttgtagttttccttgtggagagctttcacctccttggttaggtatatttctcccttggttagctatattcctaagtatttttattttatttttttgcagctgtkataaaaggggttgct

SEQ ID NO: 9958 - DNA, 340 bp, Homo sapiens
  misc_feature 88: m=a or c
  misc_feature 161: m=a or c
  misc_feature 312: m=a or c
  misc_feature 313: m=a or c
  misc_feature 314: m=a or c
  misc_feature 324: m=a or c
tgtttatttctgataattaacctaagcccttatgaaaataaacaaaatgaagggattatgacaggtattaccaaaaacaccaaaaggmacaaaggggcctgcgttaaaacctaattgctaatgcttcacaactaggagagcatgccgtcttgatgtttaamaaacccagggtctccacccttcctttgatttgtgcaattctgtcttccacagttccggagccttcagtgaggggtagctacatgccccatgcctgccctttctttccttctttgctcactttactatgggtgtattttaatcttgtataammmtatgcatgamtgagtcatgcacatgt

SEQ ID NO: 9959 - DNA, 269 bp, Homo sapiens
  misc_feature 235: k=g or t
tgagtaacttagaactgaaaatgatctcttttaaaaagaaattaaatcagacaccacatggtggtgtccttggatctcactgtgcagaattagcagtgtataaccatcttctcttttcatcttgttccaattctctcctctttcctttccattctgctttaagctcatgtgtcaggcagactttaccagagtgtcagacattacctaaaacacatacgttagccatgctgctggkatggagaaattccacaccatgattattagcctcc

SEQ ID NO: 9960 - DNA, 233 bp, Homo sapiens
  misc_feature 31: y=c or t
  misc_feature 117: k=g or t
  misc_feature 136: k=g or t
  misc_feature 185: w=a or t
  misc_feature 198: w=a or t
  misc_feature 223: y=c or t
  misc_feature 224: y=c or t
aatcccttctacctcttaaatgatttttgtyaattgatatggggtctggctatgttgcccaggctcatctcaaactcctggcctcaagctatcttcccacctcagcttcccaatgtkctgggattccaggtatgakccaccatgcccacccccttttagctcttgatactaaactttttactaawagatttttttttwaggtttttatgaagccatagaagayyagaccacac

SEQ ID NO: 9961 - DNA, 282 bp, Homo sapiens
tatacagagaataaacgtcatccctctaacattaatatgttcagttttatgtacctgagagttgatggtttaatttgtgggtttgcccagactctcttgcgacttctctcatcatctgctctttagcacttccatgagacggggcaagagattgttggagtctcaatccagcagcccgaaagcctgtctgcagcttgggtttgagactgaactaactcagggtgttttgtggattttagttatccaggctgtccctgttccctcattaacaaaaacaaaaca

SEQ ID NO: 9962 - DNA, 364 bp, Homo sapiens
  misc_feature 21: n=a, g, c or t
  misc_feature 108: r=a or g
  misc_feature 128: y=c or t
  misc_feature 169: k=g or t
  misc_feature 305: b=c or g or t
  misc_feature 306: n=a, g, c or t
  misc_feature 307: n=a, g, c or t
  misc_feature 358: k=g or t
caatgcaatttttaatttttngttaatatcaacagcaaaagcctagtgcattgggagatgtgcaacctccctgaaaatcttttctgtttctggagtacttcaggggtrgcctctggccccagagcctytgccacagtgctcccaccagcccccacctcatccgtctgtktgcagagcctcatctacaggtccccacgctgccttctttactcactctgcgcttggccgttttgttatttggcttagtctacattgggcggaagtctgtgtgcacagagtgggtgttccttcgagccccttccacbnngagggccacacccagcgatgccagtgaaggtggcacagcctctcttcagtktctcct

SEQ ID NO: 9963 - DNA, 312 bp, Homo sapiens
ttagtatttacagttgatgatgaaagattcgtgaggtgctgccaatatacatcaaaaggtggagcttgtttggccaacttgccacctgatttaatcaacaactactagtgctgagatgcagaaagggggaaaatggaggaattatggaccaagtctgtctttatagatgacagtcacaggacaagggttaggctttgactgcagacttcagtctttgctctggccagccctgttcaccacaggcctgaatgggttatcaaaaataaagctggtggccgggcgcggtggctcacatctgtggtccagcacttt

SEQ ID NO: 9964 - DNA, 235 bp, Homo sapiens
aactcctgacctcaggtgatccactcgcctttgcctctgaaagtgctgggattacaggcatgagccaccacacctgtttttagcatgtattgtcttaatgtgccatgttgtttcttacttccttgtattcttggaaatgttctccttgaggataccattcacattttttctcctctctggataattcttatttgtcccttaatgcctagtaattacttcttacacagtgtcatag

SEQ ID NO: 9965 - DNA, 133 bp, Homo sapiens
  misc_feature 100: k=g or t
  misc_feature 101: s=g or c
gcttccgggcaggggcggggcttccggcggcgcctcaggtcgcggggcgcctaggcctgggttgtcctttgcatctgcacgtgttcgcagtcgtttccgksaatgctgcctctgctgcgctgcgtgcccccaa

SEQ ID NO: 9966 - DNA, 338 bp, Homo sapiens
  misc_feature 92: d=a or g or t
aacagctcttgcacctgtttctcttgcacctgacgtgcagctgctccacccacctctcctggctgagccttgcctgatacagcagcccggadgcaccactttgcttccccgagtctcaccctcccaggcagctcctacactcaactgcttctctaggaaaggtctcacctccagcctggagcagtcgggattacagaaagccccatccttggcttagggagcgccatgacgactgaaattggttggtggaagctgactttcctccggaaaaagaaatccactcccaaagtgctgtatgagatccctgacacctatgcccaaacagagggagatgcaga

SEQ ID NO: 9967 - DNA, 214 bp, Homo sapiens
  misc_feature 71: m=a or c
  misc_feature 181: m=a or c
ctgtatcccctttcagttctggaggctagaagtccaaacaggttgttggtggggcttctgcttcctctaamagctttagggcaggggcccccagccccagagccacagaccattacttgtctgtggcctgtcaggacacaaggtcacacagcaggagataagtaacaggtgagcacttgamgtttcatctgtatttatggctgccccccatcgt

SEQ ID NO: 9968 - DNA, 345 bp, Homo sapiens
  misc_feature 2: k=g or t
tkctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaa

SEQ ID NO: 9969 - DNA, 425 bp, Homo sapiens
  misc_feature 26: k=g or t
  misc_feature 408: s=g or c
tatttttattttttattttttttatkttttatttttttcataggtatataaactatttattaacagacaaggcctacagacttatttcttcttggacacacccacggtgcggccacggcggccagtggtcttggtgtgctggcctcggacacgaaggccccagaagtgacgcagccctctatgggcccgaatcttcttcagtcgctccaggtcttcacggagcttgttgtccagaccattggctaggacctggctattttccatcctttacatccttctgtctgttcaagaaccagtctgggatcttgcactggcgtggattctgcataatggtgatcacacgttccacctcatcatcagtgagttctcccgccctcttggtgaggtcagtgtctgcttcctcaacascacatgagcatatcttc

SEQ ID NO: 9970 - DNA, 217 bp, Homo sapiens
cataggtactcttttgtgtctgctttgttctgctcaacaccatatttctgaaatcattaccattgttgtatggttctctaactccatcatttccatttcagactcagcatatgctgagttcaacctgttgaagggctatctctgtttaattcaccatcttgaaagaaacatttaaaattgagatgttttcaagaatatatagttaaatcctgaggaa

SEQ ID NO: 9971 - DNA, 200 bp, Homo sapiens
ccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttcccc

SEQ ID NO: 9972 - DNA, 334 bp, Homo sapiens
ctaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagcca

SEQ ID NO: 9973 - DNA, 162 bp, Homo sapiens
agatgtattatccaaaggcctgcttctgaagcccctcttgcctcctctctctgcagccttcttgaaacacatcctaagcgtctgagtgctgcagatccagtggggtccggacactgggccccgcaggcgaaagcacgttccagccaccaggaggccacctca

SEQ ID NO: 9974 - DNA, 220 bp, Homo sapiens
acttccctcaacccttcccacaaactgggaggaaaactgagacctcctggtcacccgccgccgggccttttagaaactcccacaagctctgccttccctccctggtcctcttcagaccccctcttagttcttcgcggctaacggtaagctctctccttacctctccctaatcggcccctctggagaggaaaagaaaacttaagagtcgggtcgcgctagc

SEQ ID NO: 9975 - DNA, 166 bp, Homo sapiens
  misc_feature 96: d=a or g or t
  misc_feature 97: m=a or c
  misc_feature 115: r=a or g
agatggggtttcaccatgttggccagatggtctcgatctcctgacctcgtgatccgcctgcttcagcctcccaaagtgctggcatttcaggcatgdmgcactgcacccaaccgargaacacattttttaagccagggtagccaagcaatggggaacaatagcatgg

SEQ ID NO: 9976 - DNA, 257 bp, Homo sapiens
  misc_feature 237: n=a, g, c or t
agaatgctgatggtttcattgatctagaagagtatattggtaagtctctgcttttagtgtttttcttagaaaagctgagaagctttgaaaggtgtatttgctggctgggcacggtggctcatgcctgtaatcccaacactggggggccggggcgggcagatcacctgaggtcaggagtccaagtccagcctggccaacatggggaggccccgtctctactaaaaatacaaaaaaatnagttgggtgtggtggcaggc

SEQ ID NO: 9977 - DNA, 290 bp, Homo sapiens
  misc_feature 55: s=g or c
  misc_feature 242: r=a or g
  misc_feature 254: k=g or t
tggattattgtagctttgtagtaagtttggaaatcaggaagtgtgagtcctctgsctttgtgcttcttcaagattcttgtagctgttcagcgtcccttgagattccatatgaatttgacaatggggtttttccatttctgcaagaaagatgtttaggatttcgataggtactggactgaattgtagatcgctttgagtagtattgacatcttaacaatattgaatcttataatacacatgarcgtaggatgtgkttccatttatttgtctttcatttctttcagcaacat

SEQ ID NO: 9978 - DNA, 395 bp, Homo sapiens
  misc_feature 172: v=a or c or g
  misc_feature 252: n=a, g, c or t
  misc_feature 255: w=a or t
  misc_feature 272: n=a, g, c or t
cagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgavgctcactgttgatgtagagtagggcaaatctgtgtgtgtatgtcattaaaaaaattctaccatctttctttatcatctgntgwgggcgcactctacagtnccttcagtctgctcagaacgaatgtggaggccggccgaaactgatgctgcccacagtcccagtgaagttaggtgggttaattactgcattcctttctaagtgtgttttatggcatcctgccac

SEQ ID NO: 9979 - DNA, 256 bp, Homo sapiens
  misc_feature 39: s=g or c
cgcttatagatgagcttgtaaaactagtgaactcaaaasacagaattgtggtctctgaaccttgtctctggctccctccggcttctatacctgtcctttctgcttctgtttccctcctttccttcctctggccattcctttcactgtactgacagcctactatatgtcatgcattataatagtcttttgggggattcaaaggtgagaagacacagtgctttccatctggaaccatgaagtctagtgttgagggaga

SEQ ID NO: 9980 - DNA, 403 bp, Homo sapiens
  misc_feature 366: d=a or g or t
  misc_feature 367: n=a, g, c or t
cctttgtccaaaatcaattgattgtaaatgtgtgagtttatttatgaacttttaattctgctccattggctgatgtatctgtttttatgccagtattatgctgttttgattataatcactttataatatattttgaagtcagggatgtaatgcctccagctttgttctttttgtttaagattttttgtatgtggctattcagtgtcttttgtggttctatatggatttaaggatttccccccctatttctatgcaaaatgacattggaattttaataggaattgaattgaacctgtaaatgggtttaggtagcatagacactttaacaattttagttctttcaacccatgaacacagggtatattdncatttatttgtgttttcttcaatttctttcactagt

SEQ ID NO: 9981 - DNA, 179 bp, Homo sapiens
atgaatggctagaaagttaaagctatagaaaattatgatgcagttttttttggttttgttcttgttttttttgagatggagtctcgctccgtcacccaggctggaatgcaatggtgcgatctcagctcactacaacctctgctcctgggttcaagtgattctcctacctcagcctccca

SEQ ID NO: 9982 - DNA, 327 bp, Homo sapiens
taataaagccaaaagcagcgggtgctattcgtggcaacacacttcactgaacccacttgcttccaaaacgatgccagcccgaggcactgctacgccagcagctgccacatgggatggtggctcaggcgctccctccaggattctgcccctgcctgtccacagactcctttgtgctggaacctgggctcctccagctgccaggcaggagtcggtaggactgtgcctgtgcctccctcagcggggccctgggcggggttccaaggcctgcgagctgggaaaggacagatgaggggacctcgtgccttcttgctgtcatgcaatgacccc

SEQ ID NO: 9983 - DNA, 284 bp, Homo sapiens
  misc_feature 77: w=a or t
  misc_feature 78: w=a or t
  misc_feature 85: m=a or c
  misc_feature 89: m=a or c
  misc_feature 105: w=a or t
ttctaagtatttttaccacaattagaagtagtagcagttgttgctgctgccgctgctgttgtaggaatggagatgawwacatggmatamagctctgctgcctggwcattctgctgctcctacggctgcagatgtgctagttctgcgcagactttagacttctgttgtgaagctgtaacttaagagactttcagtgctctgctgtggcaggaaaaaagtttgagtcaagacagaacaacaattctgtgaatttgaaggtggagggtaggatggttctggggcgca

SEQ ID NO: 9984 - DNA, 203 bp, Homo sapiens
  misc_feature 12: y=c or t
aaagaccttttycatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgagcctc

SEQ ID NO: 9985 - DNA, 173 bp, Homo sapiens
  misc_feature 101: k=g or t
  misc_feature 117: r=a or g
  misc_feature 128: r=a or g
  misc_feature 130: k=g or t
aattgtccggagttcggcgagtcgggtggtccctttggctggagtgcctctctggtctggggatcacctcaggcgctgtccttcactgggcgatccagcakgaccccgaggacgaargggtaaccggraktgatgtctgtggggccgccggcggcccggcttcaggaaccagt

SEQ ID NO: 9986 - DNA, 285 bp, Homo sapiens
  misc_feature 138: v=a or c or g
gtcatcagaagcatcattcatttttttctgaaacagaagtgggcttgtatactttattctgtatgtcattgctgatccttgaatttaattctggtatgtcactaagccagcagttaattcaagaacagatgttgatavctatagttaattctggatgatagggagctcttatttgtgcatttggcttatcagcgtacctggaggttgtgattttttattttatgactgcagtggcactaaatttttattattcccatctgccccactgccaccactagtgcacct

SEQ ID NO: 9987 - DNA, 177 bp, Homo sapiens
  misc_feature 150: s=g or c
ttttcaaataaatactttccttgccattcccatggcagccggacactcatcctattgcttgcatgtaatctccatctctcttctccttcacccctttttgcacacccctgtcagaacccaaacttagctttcacagaaacctacaccagsttccttcccttgcggtttcccagagct

SEQ ID NO: 9988 - DNA, 388 bp, Homo sapiens
  misc_feature 14: s=g or c
  misc_feature 161: d=a or g or t
  misc_feature 162: k=g or t
  misc_feature 170: s=g or c
ggatttggcgcgasgcggctggagtttgctgctgccgctgtgcagtttgttcaggggcttgtggtggtgagtccgagagggcgtgtgagagacgtgagaaggatcctgcactgaggaggtggaaagaagaggattgctcgaggaggcctggggtctgtgadkcagcggastgaggtgaaggctgcgggttccggcgaggcctgagctgtgctgtcgtcatgcctcaaacccgatcccaggcacaggctacaatcagttttccaaaaaggaagctgtctcgggcattgaacaaagctaaaaactccagtgatgccaaactagaaccaacaaatgtccaaaccgtaacctgttctcctcgtgtaaaagccctgcctctcagccccaggaa

SEQ ID NO: 9989 - DNA, 221 bp, Homo sapiens
  misc_feature 142: r=a or g
  misc_feature 152: r=a or g
  misc_feature 219: k=g or t
tttccgagcgagtggtggtggtagtggtggtggtggcggccgagacggcggcggccattttggtgaggcctcgggagcggcaggacggttcgctgggagtagcgtctgccctttttcccacccaccgtccgcatctgtgtgrctgcgcgaaraggcagtggaggcaaggcggtggcagtagccgcagtctccaggggagtttaaaggccgcgaaggcgktg

SEQ ID NO: 9990 - DNA, 353 bp, Homo sapiens
ctaactgcctgcttctgcatcggtcttcccaaccagatgatgatggtgtcttattcatttctgcatctccagatcctagtccactgcctggaacatggaagatgctccataattgtttgctgaaggaacgagtgataaccagagaagccagctcctgcttcctgattaaggcatgcagtcaggccagtggggaaatgggcctcatggtggagcttgcctctgctggaagactgacggagccaggtgcccacacttacataaggccctttagcttacgctccctgccagtctctgacagggaacctgggcatcacacgtagtctgtgagaggagtatctataccaagcgttgtc

SEQ ID NO: 9991 - DNA, 251 bp, Homo sapiens
  misc_feature 246: k=g or t
catgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatckcttga

SEQ ID NO: 9992 - DNA, 241 bp, Homo sapiens
  misc_feature 130: s=g or c
  misc_feature 173: m=a or c
  misc_feature 185: k=g or t
acacacagccattgggggttgctcggatccgggactgccgcagggggtgccacagcagtgcctggcagcgtgggctgggaccttgtcactaaagcagagaagccacttcttctgggcccacgaggccagstggtcccatggctctgctgagcacggtggtgccatgcctctgmaactcctcctgktgctgatcctacttggggccctgggcaacagcttgcagctgtgggacacctgggca

SEQ ID NO: 9993 - DNA, 289 bp, Homo sapiens
ttactcgaaagacggactcgtccccttccccttgtctgtgggttggaacaacgctaggaacagtgcttgtcattgcactgaaccttcccccagggggagagcaaagacttcttcagccagtaattgtgttctccaagtggtactatattgaggttaaaaggtgcaatcttgagaatggcatttctggataccacaggctgcttaataccacctgcgtatgaaccctggagagagcacaatgttcctgaagaaaaagacgaaaaggagaaattgaaaaaacggcggccta

SEQ ID NO: 9994 - DNA, 157 bp, Homo sapiens
gataaacactccgcggcggtggcgactgctgctctgctccgggttctgtcactgtgtcggcggtgcccagctcactggccccctccctctcttgtcgagcgtggttgccagagaggctccctcagccctgctccgcggggtccacagcgggctgaag

SEQ ID NO: 9995 - DNA, 291 bp, Homo sapiens
acaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtcccccccctttttt

SEQ ID NO: 9996 - DNA, 313 bp, Homo sapiens
agaagacactcttcctctaccactacctgcccgcactcaccttccaaatccttctgctccctgtggtcctgcagcacatcagcgaccacctgtgcaggtcccagctccagaggagcatcttcagcgccctggtggtggcctggtactcctccgcgtgccacgtgtccaacacgctgcgcccactcacctacggggacaagtcactctcgccacatgactcaaggcccttcgctggaaagacagctgggacatcttgatccgaaaacactagaacaagagtgtggcaaagaacacccgtgctggggtcgggatc

SEQ ID NO: 9997 - DNA, 318 bp, Homo sapiens
  misc_feature 92: s=g or c
  misc_feature 95: m=a or c
  misc_feature 100: s=g or c
  misc_feature 158: r=a or g
  misc_feature 166: k=g or t
  misc_feature 210: k=g or t
  misc_feature 211: m=a or c
  misc_feature 215: r=a or g
  misc_feature 225: k=g or t
  misc_feature 284: d=a or g or t
  misc_feature 294: h=a or c or t
  misc_feature 295: k=g or t
catactaacatgttattctgtattttttttttctttttgagacagagtctcgctctgtcacccaggctggagtgcagtggcgtgatctcggstcmctggsaagctccacctcctgggttcacgccattctcctgcctcagtctcctgagtagctgggrctacaggkgcctgccaccacacccggctgattttttgtattttttagtagakmtggrgtttcatcgkgttagccaggatggtctcaatctcctgacctcgtgatctgcccgcctcagtctcccaadgtgctgggahkacagatggagtctacactggcac

SEQ ID NO: 9998 - DNA, 348 bp, Homo sapiens
  misc_feature 288: r=a or g
  misc_feature 289: n=a, g, c or t
  misc_feature 301: n=a, g, c or t
  misc_feature 321: h=a or c or t
  misc_feature 326: k=g or t
  misc_feature 334: m=a or c
gtgtcttgtaagaattggtcattgtttcatggggacgactggctcctttgggtgggatctgatggcatctcatggagttgaggttgtctgccaacgctaactggccagctctgacaggaggtgcgtggcccaggaggagccatcaggccagttctctgggatactgctgtgtctccagctctgcagtttgctctgcgtcactcagcggcagacggagaggcagacacgagccccttgtgagccctcctccttaccgtcatctcacaatgctctgaaataaggaggcarntggctgaggtcncctcagttgtagatgtgathgagtkctatctamcagaagcatatgct

SEQ ID NO: 9999 - DNA, 273 bp, Homo sapiens
  misc_feature 47: k=g or t
  misc_feature 72: m=a or c
  misc_feature 131: r=a or g
  misc_feature 140: s=g or c
  misc_feature 200: k=g or t
  misc_feature 243: k=g or t
  misc_feature 262: k=g or t
gattactggtgcaagccatcatgcccagctaattttaaaaaattatktgttagaaatgggctctcactacgmtgctcaagctggccttgaactactgaccgcaaacaatcctcccaccttgggctggccaraagtgctgstattacaggcatgagccaccatgttgggctgagtcttaacacattttcgttacatttatktccaggtatttcatctctttgcagtcttaatgaggtattttcktatgtgtattatctatcckaattgatagtt

SEQ ID NO: 10000 - DNA, 214 bp, Homo sapiens
gctcaccacaaactctgcctcccaagttcaagggattctcctgcttcagcctcctgagtagctgggattacaggcatgtgccaccatgcctggctaattctgtatttttaatagtgacacagtctttgctatgttgccggggctggtcttgaactcctgggctcaagcagtcctcccacctcagcttcccaaagtgctgggattgtaggcatac

SEQ ID NO: 10001 - DNA, 222 bp, Homo sapiens
  misc_feature 119: k=g or t
  misc_feature 120: k=g or t
acactaattctacaatgtgccagatacatgtttcctatgcccaggaagttatgaagacttcaacaattaaactgaaaccaggggaagcttgcttagttttgggtttcattataaactckkagcctcagtccaggttaatctgaagtttgaaagctcagattaagcaagccatgccaagaaactggacgatgtgtaagcctagactctaaaattcaagatgtg

SEQ ID NO: 10002 - DNA, 212 bp, Homo sapiens
taacacgatcttgtctcagcttttccacagagccctccccttcacccttccctcattgttcaggaaagcttaggccacgtgacagtgaggggagtgcccccacaatgattatgtcagcagctgcttggaggcctgttcatctactacccacgtttccagggagccctgcgaggaactactcatcacggtcctggatggagggggctgtgtaa

SEQ ID NO: 10003 - DNA, 177 bp, Homo sapiens
ttcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctctttttttttttttttt

SEQ ID NO: 10004 - DNA, 383 bp, Homo sapiens
  misc_feature 99: h=a or c or t
tggtctatcaatcttgtttatcctttcaaaaaacaaacttttggttttatggattctttgtatggatttggaggtttcaatttcatttagttttgctchgattttagttatttcttttcttctgctggcattgagattaatttgttgttttttgtagtccctctagatgtgatgatagatcattaatttgagatctttctaactttttgaggtaggcacttagcgctataaactttgttcttaacactgtttttgctgcatcccagaggttttcaaaatgttgtgtctctgttttcttttatttcaaaaaacttttatttattccttgattttgttgtttacccaagtcattcaagaacaggttgttaaatttccatgtaatt

SEQ ID NO: 10005 - DNA, 202 bp, Homo sapiens
tcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttctttctttgttctctttcattaaaccccttccccagtttttttttatactttaaaccccgctcct

SEQ ID NO: 10006 - DNA, 327 bp, Homo sapiens
ctacagagattggagtcaggggagagaaaaagggagaaaggtagtgaaaagaggagaggaaacaattatcccttttaaaaccatcctttttggtggcttgatagaaatactctgtcagaaatgctgtttggtattcgttgccagagctagacatcaagggcttagtctcgtttgaaatgtttaggctttagaaggagcaagataagtggggaaggaaaaaaaagaaaagaaacttttaggctgtattttgccaaaatgtatatcacagtgcctgccttcctgcctagcaatacaaatggaattatagatcccccactcccaccccac

SEQ ID NO: 10007 - DNA, 182 bp, Homo sapiens
gctcactgcaacctccacctcctgggttcaagcaattctcctgcctcagcctcccgggtagctgggattacaggcacgtgccaccacacccagctacttttttgtatctttagcagagatgtggtttcaccatgttggccaggctggtcttgaactcctgacctcgtgatccacccgcctct

SEQ ID NO: 10008 - DNA, 261 bp, Homo sapiens
tatctctgtatttgtctaggttttgtttactatctctcagcagtgttttgtagtttttggtatatcagtcttttccatcttttattgaacatatccttaaatagtacctatttttatgctattgtaaatgatactggtttttcctggtagtattggttttttatttttaaaaacttttaattgtggtaaaatatacataatatactgccattgtaaccatctgcagtggtggtaaatacattcatactgttgcacagcccc

SEQ ID NO: 10009 - DNA, 250 bp, Homo sapiens
  misc_feature 95: k=g or t
tccacgatagttttagtttgcatagcactttcactctgtcttcatcataataatgatcctttagggagggaggtcttatggtattttttattttktatttttagacacgattttgctctgttgcccagactggaatacagtagcaggaccacatagctcactgcaacctcaaactcctgggctccagtaatccacccccttcagcctcctgagtagctgggattgcaggcacactctaccataccaggcg

SEQ ID NO: 10010 - DNA, 228 bp, Homo sapiens
acaaaaggagagttttataattcactttaaaaggagatttgatggtaaagtttaaagattaaaatattttgttcttcaattacagagcgatgaccccacagtatctgcctcacggtggaaaataccaagttcttggagattactctttggcagtggtcttccccctgcacttttctgatctaatttctgttttataccttatacccaaaacacttactaccaacagcc

SEQ ID NO: 10011 - DNA, 263 bp, Homo sapiens
aagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctccatgtacaaggttttgcatgtatttatatggttcttagggaaaaaaaatgctataaactgcaaatctgaaattcaaatgtgttgttccactgagaccagaagaagaagagcct

SEQ ID NO: 10012 - DNA, 282 bp, Homo sapiens
  misc_feature 253: n=a, g, c or t
  misc_feature 260: s=g or c
  misc_feature 263: m=a or c
  misc_feature 265: m=a or c
tatctttttcaatttctttcatcaatgtttcatatcttaatagatttttaattattatttatcttctcttaatcttttttcctagtgcggtggtaccacagtggaaaaagccacaagtttctttaataacaactagttcaaagactctgggcagacttttgctctttttgcctccctgtaactatttcttgatcatttttcttctttaagtttacatttcacaaatgctgtatttacccctacctcccttccntccctcsctmcmttcctccctcccttcct

SEQ ID NO: 10013 - DNA, 389 bp, Homo sapiens
  misc_feature 102: r=a or g
ctcttccttggtgcttctttttcctgctcggtgagtttgtttgtttgtttgtttttgagacagagtctcactttgcttcccaggctggagtgcagtggtgcratctcagcttactgcagcctccgcttccggggttcaagcgattctcctgcctcagcctgccaagtagctgggactaccggcgcccaccaccacgcctggctaatttttgaatttttagtagagagtgggtttcactatgttggccaggctggtctggaacgcctgacctcaagtgatccgtccgcctcggccttccaaagttctgggattacaggcgtgaccaccgcgcccggcctgagtgagtcttaatccgtggccatctgcgttcctgcaggcttcatctggcc

SEQ ID NO: 10014 - DNA, 440 bp, Homo sapiens
  misc_feature 315: m=a or c
  misc_feature 319: h=a or c or t
  misc_feature 320: k=g or t
attcacaacattcctcccccgcctctcttgggctggactgcgcgccccaggcttctggggctgcgcccacacacggctttgtttactgagggtcgcttccgggcgccgcgaggggacaatcaacatagcccggccggtcagcgagacagagcagcgggatcccttggcagtggctcagcccctcgtccctcccagctgtgcgacccgagaaactcactgaacctctctgggcaccgggtcaagttttggttcttgtgggggcggaggggtcgcaggctcactgagggagctcatgcgggccgcggaccccctctmcaghkacaaagctcggttagggggttcataggtcatcccttgagcctcaaaactagtatagtaccccgcccctcctttccatgccctagatactatcttgggtcatatgaattgctaattttttt

SEQ ID NO: 10015 - DNA, 356 bp, Homo sapiens
  misc_feature 52: k=g or t
  misc_feature 89: m=a or c
  misc_feature 91: y=c or t
tttttggagggggggtggggggtgaagacagagtctctctctgttgctcaakcttcagtggcacagattaggttcactgcagcctcaamcytcctgggctcaaacaatccttccacctcagccttcttccaagtagctgggactacagggatgcaccacaacacctggctgatttttgtatttttcgtagagatggggttttgccatgttgcccaggctgatctcaaactcctgaggtcaagccatccccacccagcttggccttccaaagtgctgggattacaggtgtgaactgctgcaccctgccaagttctgttttcaacctactgatgagcctatcataggcattcttcatt

SEQ ID NO: 10016 - DNA, 261 bp, Homo sapiens
  misc_feature 94: m=a or c
  misc_feature 136: n=a, g, c or t
attttgtattgttagtagagacggggtttcgccatgttgatgaggctggtctcgagctcctgacctcaggtaatctgcccgcctctgccttccmaaagtgctcagattacaggcgtgagccacggtgcctggcctncaagacccttataagaaagctgtttttttctttctggaaacctttaggatcttctcttattcctggtgttctgaaattttataatgatatttcttaatgtgagtctttgtttaaaaaaaaaaaaa

SEQ ID NO: 10017 - DNA, 322 bp, Homo sapiens
ccaactgcctaatcgatctctctgcctgcatgtgttcagaaacctacactctgaatgtatagagtctcaaacttgatctccctcctgcaagttgcttccagccaactcaccttctcgtgtttctgtcatgtatgtttcggtttaaatcatgctctaagccttatatctctgacacaccccattaggaattgggtgatcaagctttttcaacatacatagtggatggggggtatatatgtgaaacttaaattttttatgattatgcttttttatatgattacaactttatagaagagttggaatagtacagagaagtcccaca

SEQ ID NO: 10018 - DNA, 234 bp, Homo sapiens
  misc_feature 163: d=a or g or t
cggcatgtactgactgaggaccatggccgtgacacggtccctcactcccagcgttgtgggtgccttctgtgtcacatggaaacaaagcacttgttttcccaaaaaattgtttccatctttggttccatctcctttttattggtgggtttcctcatctgcttgdtcggctttctgccatctgttcaaattatccacaaattgcccaccacagattgaagtgcttttttttttttt

SEQ ID NO: 10019 - DNA, 470 bp, Homo sapiens
  misc_feature 82: s=g or c
  misc_feature 111: k=g or t
  misc_feature 116: s=g or c
  misc_feature 121: m=a or c
  misc_feature 122: s=g or c
  misc_feature 134: k=g or t
  misc_feature 288: h=a or c or t
  misc_feature 289: k=g or t
  misc_feature 401: b=c or g or t
  misc_feature 402: n=a, g, c or t
  misc_feature 453: k=g or t
  misc_feature 470: v=a or c or g
ttgcacaggctagtcttaaactcctggcctcaaatgatcttctcaccttggcctcccagagtgctggggttacaggcgtgascacagtgcctgacctcctaggagtctgtktttasgtaamstccaggtgcttkgtgaagtggccagtcctgactcttgggcctgtgttcaggcaccattggtcaatccagttctacctagtgtgggatcctgtctccagcacccctgaaaggggacccttccctcttagcttagataccctcagtggtagggcaaccactcctgcahkaggcagccctgctgctgttagtaagtcttttccttacattgaactcatctgcctccctgacgctgatctttcatctgccctgtggggccacccacacgtaaaccctcctccbnaagaattgtgatgaataactgcttctatttaccaagcactcactatgtgckaagcatgatgcatactv

SEQ ID NO: 10020 - DNA, 436 bp, Homo sapiens
  misc_feature 222: n=a, g, c or t
  misc_feature 354: s=g or c
  misc_feature 364: r=a or g
  misc_feature 365: n=a, g, c or t
  misc_feature 387: m=a or c
  misc_feature 410: k=g or t
ctttggttgtggtcactcccccacacctgcctgcctccttcacggactcgaagtgaccttcctggaggaggtgggcagctcagactccacatgctggtggtgcctgaggtctgatggcctctaataaactgtgtcctatatgcccttgggtgcatctctgctaggggagaggccagcatgggtagcactccttgcccccattttacagattaggggaatcanggcctctttttctgctgctctgtttgtttgttttaggatggagtcttgcttcactggccaggctggagtgcagtggcacgatctcggctcactgcaatcccgcctcgcgttcaagcaattatggtgctcagsctcctgagtrngtgggattacaggtgtgtgcamcatgctggctaatttttgtattkttagtagagacggggttttgcatgtt

SEQ ID NO: 10021 - DNA, 449 bp, Homo sapiens
  misc_feature 274: b=c or g or t
agcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatgbagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctga

SEQ ID NO: 10022 - DNA, 335 bp, Homo sapiens
atgattttgctctcctcaatttgtctgcttcgatcacagtagctcttgcatttatctgttttagaccttcaactttcaaattagatttgacttcatcaaagaatttggccaaaaacaaacaaacaaacaaacaaaaaaaccaactggacaccactgtattaaacaagtaatttaagtctttgtgtgtatgcttaagtttgctaagagctcttacatttgtacatatacatgcatataaacagcatattacaaataatctagaaacatataggagcaccatggaccctcagtctgagatccgactaagcaacttctcattttacaattcaaatgca

SEQ ID NO: 10023 - DNA, 187 bp, Homo sapiens
  misc_feature 119: m=a or c
tgtatttaatacctcaaggtcattgtggctctggggatgccagggcaggaggacgagggtgcgctgtggacacagcagtccgcggaattccgttctgggaagccaatggtcgccggcamcccttgcttcctccctctgttgtctgcctgtgtgacacacatcaatggcaataacttcttccaactca

SEQ ID NO: 10024 - DNA, 349 bp, Homo sapiens
taaccttaattacttccttaatggccccatctccaaatatagccacattgagggttagaacttcaacatatgaatttctggggggacataaacactcattctatcacagttcctaagatggtatatttacaggttttggttgttggcaggaagcctcagttcctccccatgtgggcctccccttgggctgctttgtcattctcatgccatggtacctggcttcccgcagacagcaattcaagatagcaaaggagaagccataatatgttttatgactgagtctcggaagtcacacactatcatttctgcaaaatcctactggttacaaagctcagtcttattcaatata

SEQ ID NO: 10025 - DNA, 313 bp, Homo sapiens
  misc_feature 118: s=g or c
  misc_feature 120: d=a or g or t
  misc_feature 122: y=c or t
  misc_feature 185: k=g or t
  misc_feature 186: v=a or c or g
  misc_feature 298: w=a or t
taggaccagcttgtcagtttctgcaaaaagggctgctgggattctgattgtgattgtgttgaatctgcagattgtaagtttggggcacactattagattttactgttattttttaagscdayctcctacaagaaagatttctttttttagctaactgattaattttttggaggcaggttctcackvtgtcacccatgctggagtgcagtggctcaatcatagctcactgcagcctcaacctcccaggctcaagtgatgctcttatctcagcctcctgagtagctgggactacagctgwacacaaccatgccat

SEQ ID NO: 10026 - DNA, 281 bp, Homo sapiens
  misc_feature 117: k=g or t
taaagtcagttaatgggaggcctccaggtttattcattttgtataaagttgccgtggctattagggttcttttattattccatatagattttagaatagcttttttgttttgtttgkttgtttttgtttttctgagacggagtctcactctgtcacccaggctgtagtgcagtggcgcaatcttggttcactgcaacttccgcctcccaggttcaagcgattctcctgcctcagcgtcccgagtagctgggactacaggcgcatgccaccatgcccggctg

SEQ ID NO: 10027 - DNA, 228 bp, Homo sapiens
  misc_feature 113: s=g or c
taagttgttgaaggtggtgataattctagagtgtaggcacggagggggccagcaggcaagaggcaatgggactgtaacgaaacaatcccaagtctggtgggttggtttggggstgctgcagggaggcacgggggcagtgaggctggaactctgagaggcagccccggaggtaaacctccattcctgacggcactctttttttgagcatggaagaagtcagaacacgca

SEQ ID NO: 10028 - DNA, 335 bp, Homo sapiens
  misc_feature 38: r=a or g
  misc_feature 39: w=a or t
  misc_feature 324: s=g or c
  misc_feature 325: n=a, g, c or t
ttttcatttgcactttcctgatgtggtgagtcatgctrwgaatcttttcatgtgctatcaactatttttattttttctttttgagacagttctcactctgtcacccaggctggagtgcagtgacatgatcatagctcattgtaacctccgcctcctgggttcaagcaattctcatgactcagcctcctgagtagttgggattacaggagcacaccacgatggctggctaatttatttatttttattttttattttttagtagagatggggttttgccatgttggccaggctggtctcaaactcctgaccttatgatccacccasntcggcctctc

SEQ ID NO: 10029 - DNA, 219 bp, Homo sapiens
  misc_feature 94: s=g or c
  misc_feature 144: n=a, g, c or t
tatatatgtgtgtgtgtgtatatatatgtgtgtatatttatatgtgtgtgtgtgtatatatacatttttttgagagggagtcttgctttgtcgsctaggctggagtgcagtggcgcgatcttggcttaccgcaacctccacctnccaggttcaagcaactgtccacctcagcctccccagcagctgggatcacaggcgccagccaccacacccggcgtc

SEQ ID NO: 10030 - DNA, 338 bp, Homo sapiens
cacttgttttcttttggcttttgttgtttttgttttgttctgtttgttttgttttgtatttctttgttattttattgggaaggtaagcggaatgtgctcatagacccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctacttgtaggcctcagctatggcttgacgtaatcgcttttagacccaggttggcttcccttcattaagctatgatcctcca

SEQ ID NO: 10031 - DNA, 360 bp, Homo sapiens
  misc_feature 13: w=a or t
  misc_feature 15: y=c or t
  misc_feature 17: n=a, g, c or t
  misc_feature 178: w=a or t
  misc_feature 179: w=a or t
  misc_feature 279: v=a or c or g
  misc_feature 312: m=a or c
  misc_feature 342: m=a or c
cacacaacttttwcyanaattgtttggttataatgtattgctgtcctctctacacctggtataagggaggtttaagacaggttaagagccctgttttaaacactgacatttccccagccactaatacttactaaggtgaaagagacactcagtatttgtgagtaaatgtggacaaggwwagagaatgaattttgtagtaaccttttgtttaaagtaagcataaattgtcttattatctgtttaagtctggggtttggtgggattttccacttggtcttvcggttgttttcatgttctataattgccacaggmgttgtttaatatcagtcatcagccccttamcccacagtaaatggtgta

SEQ ID NO: 10032 - DNA, 198 bp, Homo sapiens
  misc_feature 81: w=a or t
tggcgcgatcttggctcactgtaaactctgcctcctgggttcaagcgattctcctggcctagcctccccaggagctgggawtacaaagtgtgcaccaccacacctggctaacttttgtatttttagtagagacgcggttttaccacgttggccaggctagtctcaaactcctgatctcaggtgatctgcccccccttt

SEQ ID NO: 10033 - DNA, 306 bp, Homo sapiens
  misc_feature 94: r=a or g
  misc_feature 135: w=a or t
actttaataatcgaacaaaaggtttttgtttttagacagtgtcttgctctgttacccaggacagacctctcgtgtcagcctcttaggtagctargatttacaggtaagcaccggcgtgccctgctttattttttwggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggccg

SEQ ID NO: 10034 - DNA, 166 bp, Homo sapiens
  misc_feature 83: r=a or g
  misc_feature 91: y=c or t
  misc_feature 98: m=a or c
taatctgtaactttagccccaaccatgtgctcgcagaaacgtgctgtatcaaatcaaggtttaatggatttagggctgtgcargctgtgcyttgttamcaatgtgtttgcaggcagtatgcctggtaaaagtcattgccattctccattctctattaaccagggca

SEQ ID NO: 10035 - DNA, 482 bp, Homo sapiens
  misc_feature 284: m=a or c
  misc_feature 310: m=a or c
  misc_feature 334: m=a or c
  misc_feature 437: y=c or t
atgagtgtggggaaggccatagaaaggaccggcgaatgctggcattgatgtgtgttattttaacatttctgaaatcctgttcttagtctgcacaccttgtccgaggctccgatgttatccaggtgattcatcatttaatgctgttggcttcaacatggatttaatggtaactaaaccaagtgcacactatgtgaagatctattcacttggaggtccttcatttcaggtcaccaggtatgcccctgggctcctgccgcagctgatcgggtgctaggtgctgaggmtacacgtctgggagaaagcaattggmagaaatgcaaagctcttcaaaggmgacctataaagtcatctttgttttgttcattcttctcatgtttctgcattctgggcattctcctaaattggggagaaaccaaaatgcccagaagtcaaattcygcactgtcaatcatgcaaaatgtcaaatgagagaccaaagtatgc

SEQ ID NO: 10036 - DNA, 173 bp, Homo sapiens
  misc_feature 70: k=g or t
agacgggggccattttgccagaggctgcctcccggagttgggggcggcctggcggcaggctgaagctgtkcttttgcctcttctgcagcttggggcttggagaggatctggaagtctgggctccatcgagccctttggagacggcaatggtttcttccaaccaccaccaccgc

SEQ ID NO: 10037 - DNA, 391 bp, Homo sapiens
  misc_feature 8: r=a or g
  misc_feature 64: r=a or g
  misc_feature 158: k=g or t
  misc_feature 164: k=g or t
  misc_feature 167: k=g or t
  misc_feature 290: n=a, g, c or t
  misc_feature 291: v=a or c or g
  misc_feature 292: k=g or t
tagaagaraaaagaaacttaaagatgagctgcacaacagtagctgttcatgggagggaaaaggrtcaatgacaaatgtgtgctccaaaaagtcaagagtcaaacaaatataaattcaaaacaagtaattaaaacaaatccttataaatgtttcatttktttttkctkcttagttagaggatttatatctccaagggactggttctctgactgggaaaccaaccccagacagagcagagaaagttcagaatcctagtcactaaactacaggccagagtgtcttttttgcanvktcctcaaaggctccaaagcagacagtttacatgtacaaaggattttaacattgttttagatctgatttctgccttttaaaaatcttgccaagggagttt

SEQ ID NO: 10038 - DNA, 304 bp, Homo sapiens
  misc_feature 89: s=g or c
  misc_feature 90: k=g or t
tttgattttagtcagggtgtaagaatatgtattattgttcccaaaaaaatctgtgtaaaaacttcatagtgtgaaacagtggcaactgsktgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctggc

SEQ ID NO: 10039 - DNA, 198 bp, Homo sapiens
  misc_feature 94: k=g or t
  misc_feature 95: b=c or g or t
  misc_feature 101: w=a or t
  misc_feature 112: r=a or g
attagggctactcgaatgggacacttgtggccacaccctggtcattctgactggctgtacaaatagctctcctggctccccaggggacaatggkbcatcawgatttaggccrcaaagtagggccgtttgttccccctcttgcccctctccccagtcagctgacgacagctccagtgttgcagcccagcaccccagcga

SEQ ID NO: 10040 - DNA, 203 bp, Homo sapiens
  misc_feature 197: b=c or g or t
actagtcaagggggcagcggcacgggagggaggggcgcctttctcttttctcctccccctgcagcccagctgcactgcgtgggggctctccatctccacgcaatcagcaggcggaatccctgccctggagcgccctggctctggactgcacccccctagggtttgtcctgcagattcccctccccatctttctctgbcacaac

SEQ ID NO: 10041 - DNA, 219 bp, Homo sapiens
aaaagaccttgtctttctcttggaatcccttaccctctggcaggaagtagaggaagagcaaactggctttgggaaccaggcatacctagtttgtgctgtcagccaaagcccaccaagttcatcctgtaaagtcacacgcctgaagaaacaaccaaaagtccattacttaaagacatgatatacagaacatattgatctacaaaagacccaacgacccca

SEQ ID NO: 10042 - DNA, 178 bp, Homo sapiens
  misc_feature 46: k=g or t
  misc_feature 99: k=g or t
  misc_feature 111: r=a or g
  misc_feature 112: r=a or g
  misc_feature 169: m=a or c
agcaacctgctctggttcccttccacgctgtggaagctttgttctkttggtcttcatgataaatcttgctgctgctcactcgttgggtccgtgccagckttaagagctgtrrcactcaccacgaaggtctgcaacttcactcctggggccagcaagaccacgaatgcgmcgagaggaa

SEQ ID NO: 10043 - DNA, 253 bp, Homo sapiens
tattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacag

SEQ ID NO: 10044 - DNA, 335 bp, Homo sapiens
  misc_feature 42: s=g or c
  misc_feature 44: s=g or c
  misc_feature 229: m=a or c
  misc_feature 297: b=c or g or t
caatagatgttgtcattatcattatactcctcatctggattsasggggtcctattctttaagagcagtgtttcttcaccaggggcaatttgccctccgcgcacagagcagtgtatagagacactttcagttgttaaaactggatgtagggtgatactggcatctagtgggtaaagggacagggattctgctaaacatcctgcagccacaggacaccaccccacccccgmcccagcaaataattatctggcccaaaatgtcattggtgctgaggttgagaaactgtattccaaaagabagtcacatggggtgcagcaagaggaagaaaatgaactt

SEQ ID NO: 10045 - DNA, 245 bp, Homo sapiens
tagacagctttttctgtgaccttccccttgtgattaaacttgcctgcaaggacacctacatcctacagctcctggtcattgctgacagtgggctcctgtcactggtctgcttcctcctcttgcttgtctcctatggagtcataatattctcagttaggtaccgtgctgctagtcgatcctctaaggctttctccactctctcagctcacatcacagttgtgactctgttctttgctccatgtgtc

SEQ ID NO: 10046 - DNA, 303 bp, Homo sapiens
  misc_feature 2: r=a or g
  misc_feature 60: k=g or t
  misc_feature 65: k=g or t
  misc_feature 88: v=a or c or g
  misc_feature 185: k=g or t
  misc_feature 191: k=g or t
  misc_feature 250: n=a, g, c or t
argcttcctactcctgtttcagagacaccactgaatacagagcagcgagcactgaaggcktccckctttccttaaacctgtcgggttvtgggctctctcttttcccctcttgctcctttcttttctttttttctgtttttttaaaccttccaaggcaagttcatggatactaagctgatgtgttkgttgtkctttttctccctgcctccgctcctagtgagtaaccacactggccgcatcaaggtggtcnttactccgagcatctgtaaagtgacctgcaccaagggcagctgtcagaacagc

SEQ ID NO: 10047 - DNA, 138 bp, Homo sapiens
gcctttggctgggtgcaacttccattttaggtgttggatctgagggggaaaaaaaagagagagggagagagagagaaagaagagcaggaaagatcccgaaaggaggaagaggtggcgaaaaatcaactgccctgcttc

SEQ ID NO: 10048 - DNA, 369 bp, Homo sapiens
  misc_feature 15: r=a or g
  misc_feature 97: s=g or c
  misc_feature 150: v=a or c or g
  misc_feature 325: w=a or t
catacttgcagctaraactaaatattgctgcttggggacctccttctagccttaaatttcagctcatcaccttcacctgccttggtcatggctctgsctattctccttgatccttgccatttgcaccagacctggattcctagcgtctcvatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtawgagcaccagcagaaaaagagcaaaaggtctcatccaatcagtca

SEQ ID NO: 10049 - DNA, 291 bp, Homo sapiens
  misc_feature 97: s=g or c
attttcggagaagacgggggtagaaaaggctggtgggagattcagagtccactggtgctttcgatttgacttaagtgaagtatcttggaacctagasccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggat

SEQ ID NO: 10050 - DNA, 190 bp, Homo sapiens
gccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagcatgcaggaaaaagacgcctcctcacaaggtttcctgccacca

SEQ ID NO: 10051 - DNA, 378 bp, Homo sapiens
  misc_feature 234: d=a or g or t
gctatctgtttctctctgtttattctctgcctgctttccttgtgtctctcgttgtttctctctaaaatctccatctttccctctctgtccctctccccctccctcctttcctctctgtctttgtaactctccctcaattttactcattttagtggttcactctttggatctaggaccttggtcagcatgagcattgcactcacagagagggtgacacgtttcctgatgcctgadagagagaaataagatggcccaggagactccagggcactctgcccactaagcatctttttgtgagtgagaggccatttctccagctgtccattgcagcattccacaacccagactgctgctgtccatgctgattggtgtttgaga

SEQ ID NO: 10052 - DNA, 193 bp, Homo sapiens
  misc_feature 187: k=g or t
taatttattttaaaacccagcttaagcaacacatccttttggatgtgttacttccctgatcgttattcacctccatgccgtctttcgctcaactcattgaagttaggtgcccctcttctgggctgccacggctctccatgttcacctatgtactgtactttgtattgtaatcagtttaattgacccktccctt

SEQ ID NO: 10053 - DNA, 380 bp, Homo sapiens
  misc_feature 123: y=c or t
  misc_feature 158: d=a or g or t
  misc_feature 208: n=a, g, c or t
  misc_feature 209: m=a or c
ttctaaaagctctgaacacttgtttgaaagactttgagaaatcatatttgggatttctattgcctgagttacaaggctagaactcattcccatgttgcttccctatggcagtttatttattayttatttttaatttaaaattgttttaaagagatgtdgtcttgctctgttgcccaggctgatctcaaactcctgggctcaagcagtnmtcccacttcagcctcccaaagttctgggattacaggcatgaaccactactcctctggcaatttagactacactaaatattatattgttacataaatcatgagaaattactatgtagtagtcacgtttttgtaatcatttgtatatcctatataatgagtctaccaggccca

SEQ ID NO: 10054 - DNA, 351 bp, Homo sapiens
  misc_feature 28: k=g or t
  misc_feature 130: r=a or g
  misc_feature 131: r=a or g
  misc_feature 134: k=g or t
  misc_feature 165: k=g or t
  misc_feature 170: s=g or c
  misc_feature 312: b=c or g or t
  misc_feature 313: w=a or t
attgcgcatgcgcgcttccttgcgcgakccgggctgtcgggtgtgttttgctctccagcctccgtcgtctctgcagcactccgggttctcctccagagcgctagtcccaggagctcggaatgttcgtggrrctkaataacctgcttaacaccacccccgacaggkcggasaggggaaactgactctactctgtgatgccaagacagatgggagtttccttgtacaccactttctctccttctatctcaaagctaattgtaaagtctgctttgtggcactcatccagtccttcagccactacagtatcgtggbwcagaagctgggtgtcagcctgaccatggcgcgggagct

SEQ ID NO: 10055 - DNA, 404 bp, Homo sapiens
  misc_feature 72: n=a, g, c or t
  misc_feature 73: w=a or t
  misc_feature 122: m=a or c
  misc_feature 284: s=g or c
  misc_feature 285: s=g or c
ttttaaatagaagtgtttacaatgccttttttcccccagtattggttttcaatacctgttttcatatacaanwacaaacctttcaaacctgtattccttctttatactcaggaaaatgtcamcaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagcsstttctacatgctagaaggaaatacatccaaaaagttagcattggagtgttagaaactagaatagacctctccgccaccgagctgctgtgtcacgccctcagcctgctagggagtgacaa

SEQ ID NO: 10056 - DNA, 349 bp, Homo sapiens
  misc_feature 91: s=g or c
  misc_feature 94: k=g or t
caattccagcttatgtgtcccttttataaacttgtgatacattttaactgtgtatacacatctcttgcctctattggtagagagtatctgscakgcctagcatgtgctggatgtcatatcagatactcagtgttatttattgggcttacagtgataaccaaagctcacatgttttagcactcccacttccataaagtggaagatgtcccctctgcctcttctctcatccctcctcaaagcagcaggagtgacttacctgattgaccagtttaagactatatctgagcaggcatgccacagtactgtctcagcatcttctctcttgtgctgcctgtctgcaggatgcaca

SEQ ID NO: 10057 - DNA, 382 bp, Homo sapiens
  misc_feature 297: s=g or c
  misc_feature 298: n=a, g, c or t
  misc_feature 299: n=a, g, c or t
  misc_feature 300: n=a, g, c or t
caagatagagatccaccagcttaaatatttgaattactttgttgtttttgtttgtttgtttgttttgagacaactctgtggcccaggttggagtgcagtgacatcatctcagttcactgcagcctttgcctcctgggttcgggtggttctcctgcttcagcctcccaagtagctgggattacatgcatgtgccaccgcacatggctaatttttgtatttttagtgaacacggggttttaccacgttggccaggctggtctccaactcctgtcctcaggtggtccgcccgccttggcsnnntgaagtggtgggattacaggtataagccagctttcctggcctgacttaggtagaaattttctagttatgtaatcagaggtaa

SEQ ID NO: 10058 - DNA, 204 bp, Homo sapiens
ctcaaaccatgacagtgtataatctcagcccaaggcccccagatagaatagtcttgctctgtcgcccaggctggagtgcaatggcacgatctcggctcattgcaacctccacctcctgggttcaagcgattctcctgcctcagcctcctgagtagctgggactacaggcacacgctgccacacctggctaattttttttttttt

SEQ ID NO: 10059 - DNA, 170 bp, Homo sapiens
ttataagccccggctcccggcgctcggacgcccgcgccggctgtgctgcacagggggaggagagggaaccccaggcgcgagcgggaagaggggacctgcagccacaacttctctggtcctctgcatcccttctgtccctccacccgtccccttccccaccctctgaccta

SEQ ID NO: 10060 - DNA, 450 bp, Homo sapiens
  misc_feature 377: d=a or g or t
  misc_feature 378: n=a, g, c or t
  misc_feature 379: r=a or g
aaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgdnrcaaacaagcttacttccattgcaaaatagaagaagaggaagttagagataattctgatcaatcattttgga

SEQ ID NO: 10061 - DNA, 172 bp, Homo sapiens
actggctcccagcttctgatcaattctctgcatgcagggaggcacctgcccctgaggggacattgcagttattgacctgtgctagggatgaagtattagctttggttacagacttaaggccatgtcctccaattagcttagcagcaatatagccgaacactgaatctctacc

SEQ ID NO: 10062 - DNA, 182 bp, Homo sapiens
tcaagattatgtaccaattggtctctttcttatagcacttgtttttttaattttttaattatttatttatttacagacagagtctcactctgttgcccaggctggagtgcagtggcatcatcttggttcactgcaacctccgccttcctgggttctagcaattctcctgcctcagcctccgc

SEQ ID NO: 10063 - DNA, 448 bp, Homo sapiens
  misc_feature 348: n=a, g, c or t
  misc_feature 349: s=g or c
  misc_feature 408: k=g or t
acccatctcttctctgagcacactgaacctcttggggttacctggagagatcatgctatgtgtcctctacctagaacctttgtccctccctctcctgtcccctccaggtacagtcacgatatccgtgctgctccccacatggttctctgctctggagcacttacctttttatttatgtagagacagtttctcactatgttgatcctcccaccttgccctcccaaagtgctaggattataggcataagcctccacacctagccctggtaacacttaccttaccatgttaaaatgatttttttacccacatcctacactgtactgtgagctgcctcagcgtggagtgganstgtgtttgtgttggtcactgttgtttttccagtgctcagccaaatgcctgattcatgakcagcatcagtgtatacttggataaatgaaagaatgaatgt

SEQ ID NO: 10064 - DNA, 132 bp, Homo sapiens
  misc_feature 110: s=g or c
tcgtgtcttttgtatttgtctgcttctcccagtctctccccttcttgttcccctcctctccgtcttccttttctgtctaggcttcacattctctctcccctcccctcctstcccctcccctccccccccagc

SEQ ID NO: 10065 - DNA, 211 bp, Homo sapiens
aatagaggcagggtctcattatgttgcccaggctggtctggaactcctggcctcaggtgatcctcccaccttggcctccccagagtgctgggattacacacgtgagtcaccatgcccagccccaaagccttttcttgaagaatttctcgcaaactcacaaccctcatgaaaaattaatcctcagttccacgagactgcccacccacagaca

SEQ ID NO: 10066 - DNA, 258 bp, Homo sapiens
  misc_feature 129: r=a or g
  misc_feature 144: s=g or c
  misc_feature 155: n=a, g, c or t
  misc_feature 227: n=a, g, c or t
tttttttttttgagacagagtctcgctctgtcgcccagtctggagtgcagtggtgcgatctcggctcactgcaggctctgcctcccaggttcacgccattcttctgcctcagcctcctgagtagctggrctacaggtgcccgcsaccatgcccgnctaattttttgtatttttagtagagatggggtttcaccatgttagccaggatggtcttgatctcctgacctngtgatctgcccgccctggcctcccaaagtgc

SEQ ID NO: 10067 - DNA, 204 bp, Homo sapiens
tttttcctatttagcaccccatccctaagaaagccccatttatagcagtttttgacaccatggcttcgtgtatatcaaagcagggccttggagtatttgttaccagctgggctagcccagtgcaggccgttagcctagtgcaggccgtgagacagatgggatgtgggggcccaagtcactgcaggagcctccccagctgagccc

SEQ ID NO: 10068 - DNA, 186 bp, Homo sapiens
  misc_feature 131: k=g or t
gtattctgcacggactgctgggcagcactagcactctggagaaggtctgccgctgtctgcactttcctggtgagaatccccaatgacagtcccacttttcagtggaggagaacaaaatatctgtctactckcttgaagaaggacacggctttgatcatatttgttcaggcttgacttggccggatt

SEQ ID NO: 10069 - DNA, 301 bp, Homo sapiens
  misc_feature 113: r=a or g
agagcgagtcgggaaacgattttaaactgaagaggcggcggagggccgaattcccttttctcaacggcttgatttcagagctgggctggtctctgacaggctcagctggagargggacgggttgggacgcactgtccttttgcccttccccctccgcgagcagaagctgactccgcaggagcgagggtcgcagagctgggggatttcagtctccacatagttttggagccggacttttgaagaatgattcgtgaatccggaatgggtgacagcgtcatcacggcattttattgacagacct

SEQ ID NO: 10070 - DNA, 144 bp, Homo sapiens
ctagtattgtaccacagaaaaaagacgttacaaaaatagaaattgtgtcagtaatttgcttttactgctatgaacaatcatatgcaattcctacaagtcatgctgtgtctagcctcacagccccctcactctccaggcctgcta

SEQ ID NO: 10071 - DNA, 343 bp, Homo sapiens
  misc_feature 2: n=a, g, c or t
  misc_feature 223: d=a or g or t
  misc_feature 256: n=a, g, c or t
  misc_feature 329: n=a, g, c or t
cntccattatcctcgatatatttaactatttactcattcttcttttatgtaaccaatctcctgacctcacaggccacctccttggccccaattcttcctcagattcaggcctgcttatcccaccagtctcttcccgacataaattaaacaactagaaggttgtggagcagaaattcaaacctcagtgctgtaattacttgatagagagccctttattaggtcdtcaacaccaatggagttgatttgtgaaacagcntctgtgaaaatgctcatggaaaaaaggcccttgggctaatgagatgaagatttatccacacagagtgtcagcnccagagatgtgcct

SEQ ID NO: 10072 - DNA, 415 bp, Homo sapiens
  misc_feature 279: y=c or t
  misc_feature 280: s=g or c
agggtttcgccatgttgcctaggctggtctccaacctggtctcctgggctcaagcgatccgcccgcctcggcctcccacagtgctgggattccaggcgtgagctaccgcgcccggcctatttacttttcttactaagctggggatcaccgtcgccctcggcttggcaggaaggcgggggtgcaagaagaaaagaggtacagaacacccagaggtgccctcgattccgtcttgcacttgcccttctcccaccgtccagcaataaagcgagagaaacaagyscaggaaactggccggcagtcatgggagaagccaaaaagacagccttggggagccggcgggatccagagcggggctcctctccgcactttgtagctgcgttgctccgctccatgccctgcctcagccactcctcct

SEQ ID NO: 10073 - DNA, 259 bp, Homo sapiens
actctctcgtaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaact

SEQ ID NO: 10074 - DNA, 271 bp, Homo sapiens
cttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggccctgacggtggtatccagttaactcaaaaccaacacacagagtgcaggaaaagacaattagaaactatttttcttattaactggtaaca

SEQ ID NO: 10075 - DNA, 229 bp, Homo sapiens
  misc_feature 42: k=g or t
  misc_feature 47: k=g or t
  misc_feature 76: k=g or t
  misc_feature 79: k=g or t
  misc_feature 91: k=g or t
cttcatctctctctccagtttcacccaccccaccctttgctktcatktcaggtgtgttggtctatatgacagggakgakagtaaaggagakcaggagcaattggctgcctgcaaagccagctggaggtgaagtgcaggaaaggaaaggtcaccccattctactccatggcctctctgctcccagctgtggtaggctcacatagccagtgtgatcggtttttaagaggca

SEQ ID NO: 10076 - DNA, 338 bp, Homo sapiens
  misc_feature 87: r=a or g
  misc_feature 94: v=a or c or g
  misc_feature 95: w=a or t
  misc_feature 97: k=g or t
  misc_feature 137: m=a or c
ctcccaggctgggccagcacacccggcaggctctgtcctggaaacaggcttcaacgggcttccccgaaaaccttccccgcttctggrtatgaavwtkcaagctgcttgctgagtcctattgccggctgctgggagcmaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaagga

SEQ ID NO: 10077 - DNA, 302 bp, Homo sapiens
  misc_feature 134: v=a or c or g
  misc_feature 263: m=a or c
  misc_feature 290: m=a or c
caagtaagccagccaaagataggtcctaaattgctagtcccagtagaaccacctgatcctaaaccagtgcgaaacaaacagtaacaatgtccccagctgacttcagctaagaaccaatggctcctacccccgcvccgcttttttttgttgttttttgttttgttttgagacggagtcttgctctgtcccccaggctggagtgcactggcgcaatctcgggctcactgcaacctcctcctcctcccacaattgaggcgattctmctgcctcagcctcccaagtagctgggmttacaggcaccc

SEQ ID NO: 10078 - DNA, 400 bp, Homo sapiens
  misc_feature 44: k=g or t
  misc_feature 391: k=g or t
gcaacccgctcaggcccccttccacactgtggaagctttgttckttcactctttgcaataaatcttgctgctgctcactctttaggttcacactgcttttattgagctgtaacactcaccgcgaaagtctgcagcttcactcctgagccagcgagaccacgaacccacaagaaggaagaaactccgaacacatctgaacatcagaaagaacaaactccagacgcgccaccttaagagctgtaacactcaccgcgagggtccgcgtcttcattcttgaagtcagtgagaccaagaacccaccaattccggacacaccattgtctgagtaagtttgggtgccaggactatgaggtcgtgtgaagacttccagcccatacctgcagaacagtckgcagctcac

SEQ ID NO: 10079 - DNA, 184 bp, Homo sapiens
  misc_feature 96: r=a or g
gttctttttctgtgtttctgtttgtttttaggtttgttttgttgtcgttttctttggtgtttgaagaggctctgggatagatggttaagaagtagraaatttagtttagggaaagccctcccacaggtgggaaattgctctcccctctgtggcttggacttacgtttattgtcaaggggaggta

SEQ ID NO: 10080 - DNA, 417 bp, Homo sapiens
  misc_feature 2: n=a, g, c or t
  misc_feature 3: h=a or c or t
  misc_feature 137: h=a or c or t
  misc_feature 138: n=a, g, c or t
cnhaagtcgttagcctcctccctccgctttcagcagtggtctttcagctctcttcttgtgcgctgttgtcgaccccgaccagccccttccaacccagtcatcatgtcccagccgggaataccggcctccggcggcghncagccagcctccaggcccagaacggagccgccttggcctcggggtctccctacaccaacggtcctgtccaaaatgcattgctgtcttcacaagagtcagtgagccaaggatacaatttccagcttccaggatcctaccctcatccaataccagcaaagactttgaatccagtctctggacagtctaactatggtggttctcagggatctgggcagactcttaatagaccacctgtggcctctaatccagtgacaccttcgcttccatagtggtcctgct

SEQ ID NO: 10081 - DNA, 199 bp, Homo sapiens
  misc_feature 14: h=a or c or t
  misc_feature 68: v=a or c or g
tttcactggttgchtgcatctttggctctgctgtgatctgattggaggagggacagtttctggtaccvatcctctgatttatacatatgcattttttcccctctggcctttagatggcctcagccccagccaccatatacccctgcagtttgcactttaattgatggtagttcagttggggtacttgttttatggaagt

SEQ ID NO: 10082 - DNA, 391 bp, Homo sapiens
atctcctgagaagcactctcccttgtcgtggaggtgggcaaatctttatcagccactgcctgctgccaggaagccagctagagtggtgtaagtactcatccttatttctattcatttccaactattcatcatttggggcttgtcttcacagttctaagttttgctctttttcttaatgaagaaaatgttttatatcaccggaattgatcagaagtagcaaaatcagagttctggtagactagaaagcaatttaccaaagccacaggcttcttcctggaagctcaaaggcatgcctttattcgtgatttctgaagcaaggtgcatgcagcacctgagctgatgtggaagagggtttgcagggaggtgtccacccaatgtgctcaatgattct

SEQ ID NO: 10083 - DNA, 272 bp, Homo sapiens
  misc_feature 4: r=a or g
  misc_feature 174: r=a or g
  misc_feature 190: m=a or c
  misc_feature 197: r=a or g
  misc_feature 251: r=a or g
caaraattagctgggcatggtggtgcatgcctgtcatcccagctactcgggaggctgaggcaggagaatcgcttgaacctaggaggcggaggttgcagtgagtcgagattgcgcctttgcactccagtccgggcaacagagtgacactccatctcaaaaaaataaataaataaratagtacaaatttgtmaaataaracataagtcatttatggtgcagtacattctgtgaaatactatataaccattaaraaatgtataaatgtggccagc

SEQ ID NO: 10084 - DNA, 280 bp, Homo sapiens
  misc_feature 46: y=c or t
cagggctggtgtggcatttatgtgtgtgtgtgtgtgtgtgtgtttytcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctcccagaa

SEQ ID NO: 10085 - DNA, 170 bp, Homo sapiens
  misc_feature 169: s=g or c
  misc_feature 170: s=g or c
actgaccgctcggcgagccagcgggagaggattagggctcccgaggcaacttgctcggggctcaggccgttctcccccgaagctcgggctgccgggctgttctggctctggcctccctctcctcctcttcctcttccttctgtcccctcccgcgttccttcccggcctss

SEQ ID NO: 10086 - DNA, 294 bp, Homo sapiens
  misc_feature 172: b=c or g or t
ctcttacagcgcacccgttggtgcgcgggaataggtgtgcatgccccggcctgggcctttttctgttgacccacggcatcaccttagcaagggtgttgtccttttcagtccattccctgaagcgcagaaccggaggccttgtgagaacctggctttttgtccagtcctgtcbtcagaactcaaggaggcatcacggggggagtcatttacctccctggtctcaggtgtctctcacaggtaggataagccgtggggcctattaatggatcgcagccggtgtcgtgcataaaaaca

SEQ ID NO: 10087 - DNA, 290 bp, Homo sapiens
  misc_feature 123: s=g or c
  misc_feature 255: b=c or g or t
tattgctggattcctatataccattttaatcttagctgtcttctatccatttgtggacctgattgacaacttcaaccaaactcacaaatatgctccattcatcatcatcgggcttcatttagstttgggggatcttttctttcactcttgacacctggagcacatcccgaggagacacagccgagatactaggaagtggtgctggaattgcatgtggatctcatgttacttataacatgggtctagtattagatbcttctctagatacattacctttagctgggcgccga

SEQ ID NO: 10088 - DNA, 335 bp, Homo sapiens
  misc_feature 219: m=a or c
acactctgcctccctacttagaatgcctgtgggtccttatttattttttaacaacactcatctcgctacccagaagttgcttctcccctgttcctgccatgagctgtaaccatttgggacatcttttcctgaccacaaggtctttgatggcagggacagagtctcaggtcccttagcgccttgcagctgtgagcgcagagccttgctccatcatttgamagatcccgaagcatggaagcactctgtcctcttcgccattagtctcatccactgtcaagatttgcatacctgcccccagaccccagcattccatctgtagccctgactgcacttca

SEQ ID NO: 10089 - DNA, 346 bp, Homo sapiens
  misc_feature 264: b=c or g or t
aatcaagcctgggcaatggcgggcgcccctaccccagcctggctgccgccttgcagtttgatctcagactgctgtgctagcaatcagcgagactccgtgggcgtaggaccctccgagccagacagggcctcattatgttgccccaggctggttttgaactcctgggctcaagtgatcctcccacgtaggcctcccaaagtgctgagattatagacatgacccaccacacctggcaggtgttaccgtgagaaaatatcttgaacbtctactctatgcatttgctatgcgccagccattgtgctagatgctgaagacagaaaggttaaaattaaatagcaccagcgcc

SEQ ID NO: 10090 - DNA, 308 bp, Homo sapiens
  misc_feature 10: m=a or c
  misc_feature 21: s=g or c
  misc_feature 171: n=a, g, c or t
  misc_feature 249: k=g or t
  misc_feature 289: w=a or t
tcatataggmatgtataccasatgtagccggcgctactgtggctgttgtctgtattgtatgtgtatttgtatgctctgtcagtctctctgtactccttctctatgtacaagtgtgttaatgtgtatgctctctgcagccttctgctgtctgtctctgtgtgtaattaaccntgtaccaatgttcacaatgtaataaaagcagaactaaaataacacaatgccttctggcgatttttaaacctaggggakatgctcacttatctgggatggatgcatgagttattaccawaaagcagtgggttgtatat

SEQ ID NO: 10091 - DNA, 339 bp, Homo sapiens
  misc_feature 96: m=a or c
  misc_feature 141: s=g or c
  misc_feature 143: s=g or c
aaaagttaccaaagtcaagacagatgcttacattataatttcaatgttcttttggttttttgttttgagactgaatttagctcttgttatccaggmtggagtgcaaatggcgtgatctcagctcactgcaacatctgcctscsaggttccagcaattctcctgcctctgcctcccaagaagctgggattacaggtgcccgccaccatgcccagctaattgttgtatttttagtagagatggggtttcaccatattggccaggctggtctcaaactcctgaccttagatgatccacccgcctcggcctcccaaagtgctgggattacaggcatgagtcac

SEQ ID NO: 10092 - DNA, 149 bp, Homo sapiens
  misc_feature 131: d=a or g or t
cggccatggcccagaagccgaagtggacccccacgtcgggcggctgggatacctgcaggcgctggtcacggaattccaggagacccaaagccaagacgccaaggagcaagtcctcgccaacctcgccaacdtcgcttatgacccctatc

SEQ ID NO: 10093 - DNA, 192 bp, Homo sapiens
  misc_feature 98: r=a or g
agtttctccaggacccagcagtgccctctgtccactgctctgggccattccccaatcccccctcccacttgagcccctaactcagaatctgggaccarggggcccctccctaccccagctaacctcttctggaccaggagagccaacccagatcccactacctccatgagtgctacagacaggatggggccc

SEQ ID NO: 10094 - DNA, 374 bp, Homo sapiens
  misc_feature 36: y=c or t
  misc_feature 87: m=a or c
  misc_feature 186: m=a or c
  misc_feature 206: y=c or t
  misc_feature 211: m=a or c
  misc_feature 273: m=a or c
  misc_feature 274: r=a or g
  misc_feature 356: v=a or c or g
  misc_feature 357: r=a or g
cattttatgttttattcataaagggggttaattatytgctacaaagaagcacgatctattttcatcatcgatttgaaaatatctgtmactcctatagatcctataggcagagagttttcctttctgactttttccctttgctttcgcgtgaccacatgttttctgtaccagtcactggggaaagamgtgagtttatctcgtttgtyttaamagttttgcttgtctatttagcattcctttttgggtctcaagatttatggaacaataaatgtmrtctaatgctgtgtgcttattttgaattcctcatcaggttttagaagcggggtaaaaatacttagatgcttatcagacttgavrttatactgagtggcatt

SEQ ID NO: 10095 - DNA, 234 bp, Homo sapiens
tcttttttaatctgtatttattatacagtcttgtttctttaagcccatactctgtctcttcccccgtcttcctctcaggtgacagtatcagtgagtgccatacagaattgtgtattcaccagcatcatgaaacagttgtggtcttttgagttgatcttggcagagtaaagggacgtgtcctggagccattcctgaatctccccttctttgtgacagctcctcccacccccccta

SEQ ID NO: 10096 - DNA, 370 bp, Homo sapiens
  misc_feature 233: r=a or g
ccagaacctggatgctattacacatgcttttaagaaacgtcaatgtatatccttttataactctaccactttggggcaagctattccagcactggttttgaatgctgtatgcaaccagtctgaataccacatacgctgcactgttcttagagggtttccatacttaccaccgatctacaagggttgatccctgtttttaccatcaatcatcaccctgtggtgcaacacttgaragacccggctagaggcactatggacttcaggatccactagacagttttcagtttgcttggaggtagctgggtaatcaaaaatgtttagtcattgattcaatgtgaacgattacggtctttatgaccaagagtctgaa

SEQ ID NO: 10097 - DNA, 274 bp, Homo sapiens
  misc_feature 45: h=a or c or t
  misc_feature 46: y=c or t
  misc_feature 65: w=a or t
  misc_feature 66: s=g or c
  misc_feature 217: y=c or t
  misc_feature 230: y=c or t
  misc_feature 231: m=a or c
  misc_feature 236: m=a or c
ccatggaagcaacaaattccctttatgagatatatgtcaaattthyccatctttcatccagggcwsactgaaaacgtggctaagaattgggagactctcttgtttcaagccaatttaacatcatttaccagatcatttgtcatgtccagtaacacagaagcaaccaactacagtatagcctgataacatgatttcttagctgacattaatatttctytcttccttgtgtymccacmcttggcattgacacccacccctcaattaagccaacaat

SEQ ID NO: 10098 - DNA, 175 bp, Homo sapiens
  misc_feature 71: r=a or g
  misc_feature 74: w=a or t
catataaatggaatcgtgcaatatttagccttttgattctggctttctttagtcagcataatgcctctgargawtcattcactttgttgcatgtgttaatatttagttgcttttcgttgctgagtaatataccactgtatggatggaccacactgtgtttatcccttcccctgtt

SEQ ID NO: 10099 - DNA, 209 bp, Homo sapiens
cttccttcgaaaccaccccagcctgcgaattcccattggttgcagggtcctctgtgtgttcttgcccctcctgcttaatttaacccagtcccttctgcctccctccgacaacctttttcccatccgtagccttgaattcccgagctgcccgggcggatcgtagtgttgattggagggatgagaatacccgccgggtccgattggccact

SEQ ID NO: 10100 - DNA, 249 bp, Homo sapiens
ccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgagaaga

SEQ ID NO: 10101 - DNA, 379 bp, Homo sapiens
  misc_feature 238: r=a or g
  misc_feature 247: r=a or g
  misc_feature 336: s=g or c
  misc_feature 350: r=a or g
  misc_feature 357: w=a or t
cctttctggacgttgcaaactgtgacatataaaagctgttagctgctcctctagccagcagcattcaaaccttgcagagctttgctctcagagagtttgtaaaaagacacactcctcttacaagagttcatgctaccacatagcaaagaaccttaaatttttggaagaacaatatattcattttggcattgtgcagagcaaagtaaactcggtggcctcttcttctccacccctcaaratgatagcratctctgccgtcagcagtgcactcctgttctcccttctctgtgaagcaagtaccgtcgtcctactcaattccactgactcatccccgcsaaccaataatttcrctgatawtgaagcagctctgaaagcacat

SEQ ID NO: 10102 - DNA, 359 bp, Homo sapiens
  misc_feature 52: y=c or t
  misc_feature 280: k=g or t
  misc_feature 341: k=g or t
taggcttctgtattacatattcccttgtttcctactgtatttacttaacccytttagatttcccaagatgatgatagtggtgctttgtttgcctcattactagaactgaagaattattttccaactttgacttggactataattctggaaagatgatctatatacacaccagagtattcatgaaattaggatatatatctggtataacactatcgtaggataaatatgcttttgttttttttttctgagacggagtctaggtgtgttccccgggctggaktgcagtggcgcgatctcggctcactgcaagctgtgccttcctgggttcacaccattctcckgcctcagcctcccgggct

SEQ ID NO: 10103 - DNA, 341 bp, Homo sapiens
  misc_feature 45: m=a or c
  misc_feature 53: r=a or g
  misc_feature 291: w=a or t
  misc_feature 317: d=a or g or t
  misc_feature 318: b=c or g or t
  misc_feature 320: w=a or t
agagggacccaactccattaaaccaccaccagctccccaagccamccctttcrgccatgaagttcctgctcctggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagawacacacaaaggaaagacaagaagcadbtwacgaccgtaacatcataataa

SEQ ID NO: 10104 - DNA, 346 bp, Homo sapiens
cctgttgcttcagagagacacaaagtgaacacactggtgtgaatgtcgctctctgtgtgcttgtgttttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgctatctgaacagagctatgggtttctaccataagtcaggttgtttgttccctaacctgtctctcgtagcaaagtcacttttataacagtttaccactatgcttgattataatgtgaaaggcggaattctgagtgtata

SEQ ID NO: 10105 - DNA, 166 bp, Homo sapiens
agcattccccttcaggggagtttccacagctcagcccaggctccagtctggctagagagcatccagcccattccttgcctcagtgccacctttttctgggcaagtagccaagaagtgactttatatgcagtgagtacttcagataaacttacagctacagctaccc

SEQ ID NO: 10106 - DNA, 200 bp, Homo sapiens
  misc_feature 108: n=a, g, c or t
ttaggaaaacaactttccttttactcctttggtataataggaatcatcatgttggttggctggttactgggaaaagatatcctggaaatgtttactattagtgtaagnttggctgtagcagcaattcctgaaggtctccccattgtggtcacagtgacgctagctcttggtgttatgagaatggtgaagaaaagggccga

SEQ ID NO: 10107 - DNA, 357 bp, Homo sapiens
  misc_feature 2: k=g or t
tktcttttttcttttttttcttgctttagtagccaaacctcttcttagccacctcactgtctcaaacatgacctggggcagtgtgtccatctcgtgggaagctcaggagtctgcctttgatagctttcttatagaagttagtaattccgatcacccccatgagaccatggtgctgtctgtgcctggggtgtctcgcagctctgtcatcaccaacctcaaagcttcttctaattacactgcccaccttcatgggctgattggcgggcagcgtgctcagaccctgatggtccaagcaaccacaggtatttcctattatggcttcttcactcttcattgaatttcctctgaatagctttc

SEQ ID NO: 10108 - DNA, 353 bp, Homo sapiens
  misc_feature 16: r=a or g
  misc_feature 17: y=c or t
  misc_feature 112: y=c or t
  misc_feature 277: h=a or c or t
ttaagttttaacttcrytatatcatttcagttcatttctctattcatctttgatcctcagcacccggcacggtgtttagagcataacagacctgatatatattgggtttttytgttttgttttgtttttgagatggagtttcgctcttgttgcccaggctggagtgcagtggcatgatcttggctcactgcagcctccgcctcctgggttcaagctgttctcctgccccagcctcccaagtagctggattacaggcatgcaccaccacacccggcthattttgtatttttagtagagatggagtttctccgtgttggtcaggtgagtctcgaacttccgacctcaggtgatcc

SEQ ID NO: 10109 - DNA, 420 bp, Homo sapiens
atttttaatacagaaaagtatgcctcggcctcccaaggtgctggaattgcagacatgagccactgtgcctggcctgctcactttctgatgctgcttttttgttgtttgtttgtttatttgtttgttttgagacggagtctcgctctgtcaccaggctggagtgcagtggcgcaatctcggctcattgcaacctccgcctcccaggttcaagcgattctcctgcctcagcctgcggagtagctgggactataggtgcgtgccaccacgtccagccactgatgctgttttgccactgatgctgttttgaaattgatattttgtctcataaaaactaggccaggcatggtggctcattcctgtgatcccagcactttgggaggcaaggtgggtggatcacctgaggtcaggagttggagatga

SEQ ID NO: 10110 - DNA, 333 bp, Homo sapiens
  misc_feature 71: s=g or c
tagccgcaggagggacgcccccgccgacaggagaattggttcccgggcccgcggcgatgcccccccggtasctcgggcccgtggtcgggtgtttgtgagtgtttctatgtgggagaaggaggaggaggaggaagaagaagcaacgatttgtcttctcggctggtctccccccggctctacatgttccccgcactgaggagacggaagaggagccgtagccaccccccctcccggcccggattatagtctctcgccacagcggcctcggcctccccttggattcagacgccgattcgcccagtgtttgggaaatgggaagtaatgacaactggc

SEQ ID NO: 10111 - DNA, 347 bp, Homo sapiens
acaaaggacatgaactcatccttttttatggctgcatagtattccatggtgtatatgtgccacattttcttaatccagtctatcattgttggacatttggattagttccaagtctttgctattgtgaatactgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtccctccaacagtgtaaaagtgttcctatttctccacatcctgtccagcacca

SEQ ID NO: 10112 - DNA, 229 bp, Homo sapiens
  misc_feature 120: s=g or c
actctagtggcaaaactgctggctagtgtacctgttctgccaaaagtaaaatgggcttactgaggaaattaaatttatgttcaagtgctatttctttatgcaccggggaacaagcatttstaacaacctggtcctacgtggctgaaactggatcccagaagccccgtccttcccgaagctcgtagcggaagtgacatcagcccgccgccactatcttttcccgcgcctc

SEQ ID NO: 10113 - DNA, 319 bp, Homo sapiens
taactccttggggaaagggcaatcccccgagccggttcccaggccgggtggagaccaactctggggtctcttggtgggagagtggggagcccgtcttctgctgagtgctgccgccccttccaggacagcggaggtggaacttcgtcgcgctgcaacccccggctcgggatcctggggcgtcctttggcagttgattgcaccctgcactagagagaagtccaggaatgatatattcttgggctgtatttctctaccctggagttcatccagttcatcccagaaacactgacctgattactgtgacaaagtctggatggac

SEQ ID NO: 10114 - DNA, 400 bp, Homo sapiens
actctttgtgacttactgtttgactttacaagctccttggcttttatgagggttatttataaagctctgggctttgatcctcagcatgaaaaaagccaactcctgtgtctgaaaatgtcacagggattaggggagcctttgaagtcccctcctggcagtcggcgcctgcccagcttcccctccaaaggggctccaagcctggaagccctggccagggcctaggggccttcctctggggtggaagtgtcctcagtccagagatggggtcttgctatattgcccaggctggtcttgaactcctggcctcaactgatcctcttgccttggcctgtcaaactgtcgggattacaggctttctggtgaagacaatttgattgatctgctgttcctgctgctggta

SEQ ID NO: 10115 - DNA, 446 bp, Homo sapiens
aatctaattctagcctctcattaggaaatcaaaatgcattctttcttcgcctctcttggaaagttgatctccctgcttttcttctcctctgtttcatgccatgaatttcgcactaacagtcctcccccatccagggtccagccagcctcttgcttgctaaggcagaggaatctccctggctttcctccttgactgcattgcagccccttagcctgtgtatctgccatagagctccattcttctctcatttgctccaattatggtgctttttgtctgcctttcttttctcctagctctgcaatactgctcggaagccccaccggccctttcagtgctaccttcttcctcctagtgcctccccactccccactcccagtcctggtaacacttaatggtcagggaggatttcatcactgacctgagtaataaggctatgactgctctgt

SEQ ID NO: 10116 - DNA, 360 bp, Homo sapiens
  misc_feature 104: k=g or t
  misc_feature 263: s=g or c
caggatgtgctctttgtcctccaggccattggtatcccaggttggggattcagtggctggatctctgctctggtggtgccgaaggcaacacagcagtatccgtkctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaacscagctgccaatgcagccgctggggctgctgaaaatgccttccgggccccgtgacccctgactgggatgccctggccctgctacttgagggagctgac

SEQ ID NO: 10117 - DNA, 455 bp, Homo sapiens
  misc_feature 96: w=a or t
  misc_feature 99: k=g or t
  misc_feature 102: k=g or t
  misc_feature 395: r=a or g
  misc_feature 411: n=a, g, c or t
cactttttattatttgtaccaaatgtatgtgtgtgttgtgtatgttggtgtaaatgtggagaggtggtagcaatacatactgatgctgcttggaawttkgtkgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagrttttaaaatgaaaatnttcatccgtagaatggcccaatgtatagttatagctactgagct

SEQ ID NO: 10118 - DNA, 356 bp, Homo sapiens
  misc_feature 86: k=g or t
  misc_feature 88: y=c or t
  misc_feature 92: k=g or t
  misc_feature 93: d=a or g or t
  misc_feature 98: w=a or t
  misc_feature 102: k=g or t
  misc_feature 108: k=g or t
  misc_feature 112: n=a, g, c or t
ttagggggatgttcttactggcaaaggaggaaaacagctgtaaagtgagcagtttttttttcccccgtgtgttaagggaatttatktycctkdtcatwcttkgttcckcctnggctcacccctgctcaggacataacttttgcagaaatgaggattttgctgcagcctgaatctcctgggttggatctcttagagcaattaataacttgtattcatgtgttcggggcacagccctttgtactcagtggtgcgtccgtcatgctgtttgtgctattggggaccactaagagtgctctagaaagttggtgtgggcagtgctgagctttggagtcatggagtggctcaggtgtcagcct

SEQ ID NO: 10119 - DNA, 284 bp, Homo sapiens
acctccaccctacaaaccatgtgtgctcttggccctttgatttcctttctttcctttcttctctctctctctctttctctctttctttcatcttcctttcttttcagacagagtctcactctatcgcccaggctggagtgcagtggcgtgatctcggctcactgcaacctctgcctccccagttcaagcaattctcctgcctcaacctcccgagtagttgagactacaggtgccactacgcccagctaattttcatatttttagtaaagatggggtgtcaccat

SEQ ID NO: 10120 - DNA, 383 bp, Homo sapiens
  misc_feature 234: v=a or c or g
  misc_feature 303: n=a, g, c or t
attctttcctcagctggagatcattgaatccaccataagctgctgatcatgagaccacgtggctgggagccacctgatgcagcagcagcccccgcactactctggggctctgctgggggaagcctgcagctcctggaatcctcacaaccactgggagcgaggtgccgtaaggaggcggagtctcagacagagtctcagatggtcaaggaccctgctccagggtggaggagaccvtggaaacacatccagctcatgccagggtccagtatccatccgggacagaaagctgcctccctccttccnggacagaaagctgcgtcctcagcaacaggcagaaagtgacagcctcctcccatcgccgtcactcctgctctcgtcagaca

SEQ ID NO: 10121 - DNA, 135 bp, Homo sapiens
ttttacccgacccgacgccggcgtgatgtggcttccgctggtgctgctcctggctgtgctgctgctggccgtcctctgcaaagtttacttgggactattctctggcagctccccgaatcctttctccgaagaaag

SEQ ID NO: 10122 - DNA, 184 bp, Homo sapiens
  misc_feature 129: k=g or t
  misc_feature 139: y=c or t
tactgtttataagcaaccttggttttacatagtatgttggaagagtgtggggctggggttgatttaggatttggaggtgtaaagtttgccagtgagacaccaaaccttctctggctgcttttaaaactkgtaagtaccycttgggctgtaagagtgactttgatcatatttaacaaccaggcaa

SEQ ID NO: 10123 - DNA, 417 bp, Homo sapiens
  misc_feature 256: w=a or t
  misc_feature 339: k=g or t
  misc_feature 340: k=g or t
  misc_feature 415: m=a or c
tctgtgggaactgctctgtggcgacaaggacgtccctcatcctctgctcctgctcacagtgaccctgatctggtaaagctcccatcctgccctgaccctgccatgggcaccagcctcctctgctggatgggcctgtgtctcctgggggcagatcacgcagatactggagtctcccaggaccccagacacaagatcacaaagaggggacagaattaactttcaggtgtgatccaatttctgaacacaaccgcctttwtggtaccgacagaccctggggcagggcccagagtttctgacttacttccagaatgaagctcaactagaaaaatcaaggctgckkagtgatcggttctctgcagagaggcctaagggatctttctccaccttggagatccagcgcacagagcagggggamtc

SEQ ID NO: 10124 - DNA, 133 bp, Homo sapiens
  misc_feature 133: s=g or c
agcgactcggaggttcgcctccagcttgcgcatcatctgcggccgggtcccgatgagcctcctgttgcctccgctggcgctgctgctgcttctcgcggcgcttgtggccccagccacagccgccactgcctcs

SEQ ID NO: 10125 - DNA, 309 bp, Homo sapiens
  misc_feature 129: k=g or t
  misc_feature 132: s=g or c
  misc_feature 133: s=g or c
  misc_feature 283: m=a or c
tttatgtgcagtataactgctgatgcctcgttgtttttaattttattattttttaaattttttaaaattttttattttattttattttcgagacagagtctagctctgttgcccaggctagagtgcagkggssgcaatctcggctcactgccagctccgcctcctgagttcacgccattctcttgcctcagcctcccgaatagccaggactacaggcgcctgccaccacgcccggctaattttttgtatttttagtagagacggggtttcaccatgttaggcmggatggtcttgatctcctgacctcgt

SEQ ID NO: 10126 - DNA, 221 bp, Homo sapiens
tgtacgtttatttatttatttttcttgagatggagtctcgctctgtcacccagactggagtgcagtggcatgatctccgcccactgcaacctccaactcctgggttcaagcaattttcctggctcagcctcccaagtagctgagactccaggcctgcggaggcgctagtccaccagagcccctccccgcccctctccccactccgcatccctcgcccctct

SEQ ID NO: 10127 - DNA, 166 bp, Homo sapiens
  misc_feature 146: k=g or t
  misc_feature 147: k=g or t
  misc_feature 150: m=a or c
  misc_feature 156: m=a or c
agttaggtttaaagtttcctcattaatgcaggaaaatgctcataacctgaggcttttcaagtgtttattaatttactttctggggctggctgctgatacttatttcagatcaaagagaaagcctgtgtctttcgtagttactgtgkkgcmaggaamctatgccaca

SEQ ID NO: 10128 - DNA, 153 bp, Homo sapiens
  misc_feature 128: s=g or c
ctgttcagacggtcctgcttcaccggcgtgtttggaggagacgtcaatcctccttttgatcagctctgctctgctgggacgacgacacgtggtgtccccgattggtttccctttctgtgtgtgcagtsccccccttgccaacacacccttcct

SEQ ID NO: 10129 - DNA, 458 bp, Homo sapiens
  misc_feature 332: r=a or g
  misc_feature 333: r=a or g
  misc_feature 335: v=a or c or g
cactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttrrcvtatcaaagtgttgggattacaggcttgagccaccgcacccggccgagaatatgtgttgttatttatgactggattatgaagaatcaggagaatgcatttcatgtctgattctgctgctaatta

SEQ ID NO: 10130 - DNA, 263 bp, Homo sapiens
  misc_feature 138: s=g or c
  misc_feature 141: y=c or t
  misc_feature 143: y=c or t
  misc_feature 144: y=c or t
  misc_feature 148: w=a or t
  misc_feature 151: d=a or g or t
tttccagcttctaggggatgcctgctttgcttggttcttggtgtctttctccatcttcaaagccagcagtataacgtcgtcacatctcttcatctgacctgttctgtcatcaaatctcctctgactgtggcttttggsctycyycctwaadaagtacccttgtctttaaaaggattcccccttataaggacccttcaagtaaatccacacatatatagtcaactaatttttgacaaagacaccaagaatacacaatggggcaa

SEQ ID NO: 10131 - DNA, 263 bp, Homo sapiens
  misc_feature 142: r=a or g
atatattttaaaagtttgaattgtttgcaaagttaaaatttgaagagatttcacataaaaacttggatttccagcttttctggtacccctgtgccctagtttccgatgagtttgaaaatcactgctgtcccctttaaacaargccctgagctctctccagttttccagtcagaacccaacccttttcctgttacctgtcttacccctcaggcattaagtttgcaatctcagttcatataaaggacagataaagtggcacatca

SEQ ID NO: 10132 - DNA, 379 bp, Homo sapiens
  misc_feature 127: s=g or c
  misc_feature 137: s=g or c
  misc_feature 138: y=c or t
  misc_feature 145: s=g or c
  misc_feature 152: y=c or t
  misc_feature 155: w=a or t
taatatttctttaaatagaaaaagaatttggttttgctcgtttaagagcaatgagaaaatgatggaatgttgactgtgtttggcacacaggacacggaccttcatggaagtccttgctctgcgtggsatctgtcagsytttcacsttccatyctwattcttcacttttgctgctgagcctagctgtacaaacttgcactttcatttgctaatataaattcagttttattttaccattttagagactactaatgattaaatgtagaaggagagggtgcacatgtttttatgtggagtgtttaaaagataaatttataccactgtaatgtgcagcttttattaaaagagaaattggttgaactgctaggttgaatgagagc

SEQ ID NO: 10133 - DNA, 258 bp, Homo sapiens
  misc_feature 143: y=c or t
  misc_feature 148: m=a or c
  misc_feature 149: s=g or c
  misc_feature 165: v=a or c or g
  misc_feature 166: s=g or c
  misc_feature 182: k=g or t
  misc_feature 200: v=a or c or g
gtttttgttttgttttgttttgttttttgagacagagtctcactctatcgcccacgctggagtgcagtggcgcggtctcagctcactgcaagctctacctcccgggttcacgccattctcctgcctcggcctcccgagtagcygggamstacaggcgcccaccavsacgcccagctgatttktttgtatttttagtagavgtggggtttcaccatgttagccaggatggtctcgatctcctgacctcgtgatccgccc

SEQ ID NO: 10134 - DNA, 458 bp, Homo sapiens
  misc_feature 368: s=g or c
  misc_feature 436: s=g or c
ttcattgaacgaaaagaagctgctggaattgagaacagaaatagtggcattgcatgcccagcaagatcgggcccttacccagacagacaggaagatcgaaactgaggttgctggcctcaaaaccatgcttgagtcacacaagcttgataatattaaatatttagcagggtctatatttacgtgcctaacagtagctctgggattttatcgcctgtggatctaataaagtgtctatttaaagtgatttctactgttttgccttaagaataccagattgttggctgggtgcggtggctcacacctgtaattccagcactttgggaggctgaggcaggtggattacctgaggtcaggagttcgagaccagsctggccaacacggtgaaacccgtctctactaaaaaattaaaacattaggcgggcgtggtggcgggcgsctgtagtcccagctactcggga

SEQ ID NO: 10135 - DNA, 134 bp, Homo sapiens
ccttctcaagaactgtgttcacccacttccccacatggcccttccacccaagggatgtggtagtctccctttgactactgggtcttcctggagcctttcttctcaaataggaagccctgctatttccaacccta

SEQ ID NO: 10136 - DNA, 202 bp, Homo sapiens
gccgtgtctcctggcattggggctgcaggaaagacgagctcctaggccacagtgccagtggccagtgctgctgccttgcagggtcgcacaggcagtgctggctgtttggactggcttggcagaaggatttgaagtattgttcctagccaactggactcaaacctgttcctccaaccctctagggattctcttatcacccagc

SEQ ID NO: 10137 - DNA, 384 bp, Homo sapiens
  misc_feature 82: r=a or g
  misc_feature 135: s=g or c
  misc_feature 136: m=a or c
  misc_feature 165: r=a or g
  misc_feature 267: w=a or t
  misc_feature 289: k=g or t
  misc_feature 382: r=a or g
tttcccatttaatttaattttcagacttcagttgaccatgagtaaccgaaaccacagaaagtgaagctggggatatttcagraattcttttctaatcagaaattctaatcaaacataagtttccaactatatgtsmtcttggtcctcagaagtgtttgaatagaraagtaacaactaacttcccatctttctggtggaagagttaattctgcctggagggttctgcctgggagacatgacagcatgtgtgtgactcctgtgtctgtwtctgtggggtcatccctttcgkttcattttgccagggcctggctcaggattttttatggcagtgcctgtgaagacaagcctggccctccatccagtcacacaggaaatccacagrga

SEQ ID NO: 10138 - DNA, 304 bp, Homo sapiens
aatacatcaaacatgagcaagaggagctgcacaggaaatttttattgtttacagacactttcctaaggaaaatacatgcactatgtgaagagcacttctcacctgcctcacttgacctgaaatttgtaactcctaaagtaatcaaactgctcgaaatcttacgcaaatataaaccatatgagcgacagcagtttgaaagcgttgagtggtataataatagaaatcaggataattatgtgtcatggagtgattctgaggatgatgatgaggatgaagaaattgaagaaaaagagaagccagagtt

SEQ ID NO: 10139 - DNA, 279 bp, Homo sapiens
attaaacaaatgggctttctacttggccagtaccatcttgtctgctccttactatacacgcgggtggcaaagacaggagaagatggagccaccgttttgaacgtgtctattcccagctcggaaggcacaatcccacaataggtctgcatggtccaccgagctgcatacccacggggccagcgggaggtgggcagctgctgggctctcttctgaagcagacaggatctcactctgttgctgaggctggatcacagctccctgcaaccttgaactctccct

SEQ ID NO: 10140 - DNA, 284 bp, Homo sapiens
ccttcctagcttttgttttttggggtcttgcatggagccagagtctacttagtgcaaccagtctgtgcagtgtctcatgagcactctgctcctttccctttggcttttgaagacacagttgttccttagtaagtcccgtggctttaatgctgacagccctcatggttgggtctccagcacagacctccagactcacttatccagccgcaagtcaggatagccggtcagcatttcagtttggccataatcaaccttttgattttatctcttgaatctgcgcccct

SEQ ID NO: 10141 - DNA, 464 bp, Homo sapiens
  misc_feature 245: n=a, g, c or t
ccttttgatggtcctaattctcaaaggtaaccttaaggggagtgtattttgctgttggttctgtggatgacaggtgacaaaacaggctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacgnagcccatctgccgccaaccctactcttatgacttccctgaggacgtggcccctgccctgggcacttccttctcccacatgcttggggccaccaatcccacccagaagacaaaggaaagcctgggccgtaaaatccaaatccagcgctctggtcatctgaacctctacctgctcctggactgttcgcagagtgtgtcggaaaatgactttctcatcttca

SEQ ID NO: 10142 - DNA, 245 bp, Homo sapiens
  misc_feature 130: m=a or c
  misc_feature 153: w=a or t
  misc_feature 193: n=a, g, c or t
gccttgctgctgcctcccagctgggagcctctgccggagccgccgcctccgtcgcacagtcgggaggctttgcagtgaacttcgaccacttccagatccttcgggccattgggaagggcagctttgggcmaagtttttagaagatgcaactcwcatggtatagaggaggaacactgtgaccccccacaagcanccgggtccggcctcatcagggaccgacgcgacaccaatcctgttacagccac

SEQ ID NO: 10143 - DNA, 468 bp, Homo sapiens
  misc_feature 129: r=a or g
  misc_feature 132: y=c or t
  misc_feature 134: k=g or t
  misc_feature 233: s=g or c
  misc_feature 276: n=a, g, c or t
  misc_feature 315: r=a or g
  misc_feature 328: k=g or t
  misc_feature 394: k=g or t
ttaaaagtaaatatataaatcactaacatagtcatttataatgaagtattatgtactgtacataattgtatgtgctatacttttatacaactggcagtgcagtaagttggtttacaccataagttttarggyckcagatgatggtcatttgcatggtttttttttgagacggagttttgctcttgttgcccaggctggagtgcaatggcacgatctttgcttaccgtaacctscacctcccgggttcaagcgattctcctgcctctgcctccccangtagctgggattacaggcatgcaccaccgcgcccagctrattttgtattttkagtttctccatgttggtcaggctggtcttgaactcccagcctcgggtaatccacccacctcaccckcccaaagtgctggcattacaggcgtgaccaccgtgccctgccatcatttgcatatttaatggatttttcagatc

SEQ ID NO: 10144 - DNA, 205 bp, Homo sapiens
  misc_feature 127: r=a or g
  misc_feature 129: w=a or t
  misc_feature 134: w=a or t
ttgggagcagcagcatctacttcacagaccagtgtccagttaattgtgtttgtggcaatcatcctacataaggcaccagctgcttttggactggtttccttcttgatgcatgctggcttagagcggrawtcgawtcagaaagcacttgctggtctttgcattggcagcaccagttatgtccatggtgacatacttaggactgagc

SEQ ID NO: 10145 - DNA, 193 bp, Homo sapiens
aattaatcccctggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatc

SEQ ID NO: 10146 - DNA, 233 bp, Homo sapiens
catttctgtttatgcctggggtggggagaaaaatcccaaaccagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgccccgtcct

SEQ ID NO: 10147 - DNA, 267 bp, Homo sapiens
taacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacc

SEQ ID NO: 10148 - DNA, 255 bp, Homo sapiens
  misc_feature 167: h=a or c or t
  misc_feature 168: y=c or t
  misc_feature 169: s=g or c
taaacacattcaagttgggtgttcattcattcaactccctctttccctcatccctcctctttctgtcctcttccttcctcctttccccccgacttccctccctctccttgtacctttgctctttcttctacctttcttcctttgttctctctcctgagctctgtcthysttacagtcaatgctcttgtgcaaatgtagtagagaataaaacacctgtaccctatgcattgcagcttacattgtagtgggagaggt

SEQ ID NO: 10149 - DNA, 149 bp, Homo sapiens
cttcgcttctcggggcttgtctccgtgtcctccgtctcagttgtttctccctctctatcctcctctgtctcagtctccccagccttgggggccggtgcctcttccgggcttcggcgaatgagacctgcggacctgcccccgcgccccat

SEQ ID NO: 10150 - DNA, 353 bp, Homo sapiens
  misc_feature 86: k=g or t
  misc_feature 334: d=a or g or t
  misc_feature 335: w=a or t
  misc_feature 337: s=g or c
  misc_feature 353: r=a or g
ttttattttgagcaattctcctgcctcagcctcccaaatagctgggattacaggtgcatgccaccacacccagctaatttttgtaktttttagtagagacaggttttcaccatgttagccaggctggtctcaaactcctgacctcagatgatccgcctgccttggcctcccaaagtgctgggattacagctgtgggagccaccatgcctgacccacacactttttacttgtatagatgatttttggcttggacataaaagccaagccacccatttgcttttaatccaaagaacatgtatagtttttgtacccagagactatgatttatattgadwgsacttgcctgccgctar

SEQ ID NO: 10151 - DNA, 393 bp, Homo sapiens
  misc_feature 305: n=a, g, c or t
tatttcttaaatgaagctgctttcttgtcttttatttctaaaagcccccttataccccactttgtgcagcaaagatccccgtgcaggtcacagcctgatttgtggccaggctggacaaattcctgaggcacaacttggcttcagttcagatttcaagctgtgttggtgttgggaccagcagaaggcaaacgtccagccaacacacaggactgtaagaggactctgagctacgtgccctgtgaagacccccaggctttgtcataggaggtcgttcagcttccccaaagtcagaggtcatttgattnggggaagactgaatattcacacctaagtcgtgagcatatcctgagttttacttccttatggcttgccctccaagttctctctctcata

SEQ ID NO: 10152 - DNA, 282 bp, Homo sapiens
acaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagctact

SEQ ID NO: 10153 - DNA, 315 bp, Homo sapiens
agtttccttctcgaaccggccgaagcctgccctgcgggaaagcccggagcctggggcgctcacctctcctcttggagtccctccctgggggcctcccccagccctggggaaagactgggagagcctggcctggcaaagattttccccaattcctctgtccaggcggaaaggaactttacagatttaggaaaatgccccgctcatcttaaagatgtgtaagggagcatcggtgagaaaaaaatgttcttgcccaaggtcacaccgccatcccatggctgctggaagtcatagtgagggttcagcttttgcctttca

SEQ ID NO: 10154 - DNA, 190 bp, Homo sapiens
  misc_feature 15: k=g or t
  misc_feature 77: k=g or t
  misc_feature 132: k=g or t
  misc_feature 152: k=g or t
agagctcagggtgckgagcgtgtgaccagcagtgagcagaggccggccatggccagcctggggctgctgctcctgckcttactgacagcactgccaccgctgtggtcctcctcactgcctgggctggacackgctgaaagtaaagccaccaktgcagacctgatcctgtctgcgctggagagagccaccg

SEQ ID NO: 10155 - DNA, 171 bp, Homo sapiens
acggaacactgacgccatcgcgaaggaagcatttcgagcacgactgacgctccccttattatttgctaagccgctgcgctcgggtctggctacgatttgctttcagaataacgggaaggtgcaacaagatcgcttccctagaggcgcgtcgcccgcgtggcccggaccccc

SEQ ID NO: 10156 - DNA, 316 bp, Homo sapiens
  misc_feature 52: w=a or t
  misc_feature 53: w=a or t
  misc_feature 251: k=g or t
  misc_feature 252: v=a or c or g
  misc_feature 294: h=a or c or t
  misc_feature 295: n=a, g, c or t
tctaaggtatgggattaatttcatggcttttgttgttgggtttttgttttgwwttgtttttttgagacagagcctcgctctgtcgcccatgctggagtgcagtggtgccatctcggctcactgcaagctccgcctcccgggttcacgccattgtcctgcctcagcctcccaagtggctgggactgcaggcatctgccaccatgcctggctaatttttttttgtatttttggtggagatggggtttcaccakvgttggccgggatggtctcgatctcctgacctcgtgatccgchntcctcggcctcccaaggtgct

SEQ ID NO: 10157 - DNA, 194 bp, Homo sapiens
acatttctattttttgagatggagtctcgctctgttgcccaggctggagtgcagtggcgtggtctcggctcactgcagcctctgcctcctgggttcgggcgattctccctgcctcaccctccttagtggctgggattaggtgcctgccaccacgcccagctaattttttgtatttttagtagagaagggatatc

SEQ ID NO: 10158 - DNA, 218 bp, Homo sapiens
  misc_feature 146: w=a or t
  misc_feature 154: n=a, g, c or t
tgctatgttcaatcttgtacaggtcttttgtggacatatggtctcactcctcttaggtatataccgagtagtgaaactgccaggtcatgggagtatacacgtgtccaatttttgtgcattactacgagaaccatggaccaaccccwagtttccntgcctttatttcctttcatctatttactttgggctttctttgttccctatgcccccacccccac

SEQ ID NO: 10159 - DNA, 154 bp, Homo sapiens
agtctctgggtgttcccgggtcccagcctctgcctggctgaagtgcctctccttcctctccaggtccatattcaagcctttcatctttgttgatgacgtaaaacttgtccccaaaacacagtctccctgttttggggatgacgaccctgcccct

SEQ ID NO: 10160 - DNA, 168 bp, Homo sapiens
  misc_feature 105: s=g or c
  misc_feature 108: k=g or t
  misc_feature 111: r=a or g
  misc_feature 115: k=g or t
  misc_feature 130: m=a or c
  misc_feature 134: w=a or t
attttgaaagtggagtcgcctgcccctgccgctgccgccgccgccgtcgctgtcgtagtcgccgccgccgctgccggagaaagagcacgagcggggaagccccasagkgaratckaggcatcctgccggmtggwctgcccgcccctccttccttttccccccggccct

SEQ ID NO: 10161 - DNA, 395 bp, Homo sapiens
  misc_feature 121: y=c or t
  misc_feature 318: v=a or c or g
  misc_feature 319: n=a, g, c or t
  misc_feature 392: r=a or g
taacaatacaattttggacttttaaattttttttttggagcctcgctctgtcgcctaggctggagtgcagtggcaggatctcggctcatggcaacctccacctcctgggttcaagcagttyctccctgcctcagcctcctgagtaggtaggattacaggtgcctgccaccacccctggctaatttttgtatttttagtagggacagggtttcaccatgttggccaggctggtctcgaactccttacctcaggtgatgcacctgcctcggcctcctaaagtactgggattacaggcatgagccactacgcccagcctavngatttttttaatacaggggaaattattagaaatttctgggtttccaacattcgaaaagctttttgaaagggtratg

SEQ ID NO: 10162 - DNA, 379 bp, Homo sapiens
  misc_feature 351: m=a or c
catttggaaacgtgtattaaaaatctcaagagtgggccaggcgtggtggctcacgccttaatctcaacactttgggaggccagggtgggcggatcacctgaggtcgggtgggcggatcacctggaggtcaggagttcgagatcagcctgaccaacatggtgaaaccctgtctctactaaaaatacaaaaattgggcgggtatggtggcacatgtctgtaatcccggctggtccaggaggctgaggcagggagaatcacttaaacccaggagatgaaggttgcagtgagccgagattgccccattgcactccagcctgggcaacagagcgaggctcggtctcataaaataamataaaataaaatctcaagaatgtgcacc

SEQ ID NO: 10163 - DNA, 235 bp, Homo sapiens
  misc_feature 110: r=a or g
  misc_feature 154: k=g or t
  misc_feature 161: k=g or t
  misc_feature 177: k=g or t
  misc_feature 178: k=g or t
  misc_feature 196: s=g or c
  misc_feature 204: r=a or g
ttgcatttgtgtctggcggagaactagccatcagcctcctgaagcctgccatcattgttaatttgaggactgggctgtcttggggctcagaaggtaaagaactattttgrgcagatgtgtgtgggtggcactggattccacccaactgccaagktagtatkgttagagatttcattkkacaacacaaaaataagcstgtgtcaragattttaaaatcatggaaagttaaaatcta

SEQ ID NO: 10164 - DNA, 198 bp, Homo sapiens
  misc_feature 16: k=g or t
  misc_feature 42: m=a or c
  misc_feature 43: m=a or c
  misc_feature 114: s=g or c
  misc_feature 119: k=g or t
  misc_feature 121: s=g or c
  misc_feature 132: m=a or c
  misc_feature 136: s=g or c
  misc_feature 137: s=g or c
  misc_feature 162: k=g or t
  misc_feature 169: s=g or c
  misc_feature 189: s=g or c
ctttccttacttcctkcccttccctcggcttcccgctcttgmmtcactctcagcggctgccttcgcccctgtctgcagacagcgccgctggatgctcccagctggacttcaacsccackcsctctcagtccmtctssccactgccttccagacgcgcctctkccccgcsccgcgcccctctctcctctsccaccccta

SEQ ID NO: 10165 - DNA, 298 bp, Homo sapiens
  misc_feature 154: y=c or t
  misc_feature 159: b=c or g or t
  misc_feature 160: h=a or c or t
  misc_feature 171: n=a, g, c or t
  misc_feature 295: s=g or c
ttgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaayatggbhaacaaacacgncagacttgagattcagttgccgatcaaggctctggcattcagagaacccttgcaactcgagaagctgtttttatttcgtttttgttttgatccagtgctctcccatctaacaactaaacaggascct

SEQ ID NO: 10166 - DNA, 204 bp, Homo sapiens
  misc_feature 77: y=c or t
  misc_feature 120: m=a or c
cctttcttttctttttctttctttctatttatttattttttgtttgtttgttttggagacagagtttcgttcttgtygcccaggctggagtgcaatggcacgatctcggctcaccacaamctccacctcctaggttcaagcaattctcctgtctcagccgccccagtagctggaattacaagcacctgccaccatgcccggccg

SEQ ID NO: 10167 - DNA, 451 bp, Homo sapiens
  misc_feature 101: r=a or g
  misc_feature 107: r=a or g
  misc_feature 143: b=c or g or t
  misc_feature 144: h=a or c or t
  misc_feature 352: n=a, g, c or t
  misc_feature 353: n=a, g, c or t
  misc_feature 354: k=g or t
  misc_feature 355: y=c or t
  misc_feature 451: w=a or t
tgactatgaactagttttactagttattaacattttatttatttatttatttttgagatggagtctcactctgtcacccaggctggagtgtagtggtgtgrtctcarctcactgcaacctccgcctcccaggttcaagtgatbhtcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataannkycacagtatttaaaatgaatatggtactgttaccaaaatgagtcagtgggacaaaatagaaaaaatccaaaaatagatctaagtcccatgatgattw

SEQ ID NO: 10168 - DNA, 319 bp, Homo sapiens
  misc_feature 119: r=a or g
  misc_feature 129: s=g or c
  misc_feature 132: m=a or c
  misc_feature 194: r=a or g
  misc_feature 195: r=a or g
tcttaatatggagggttttgtgtgtgtgtgtatgtttgagacggagtctcgctgtgtcaccaggctggagtgcagaggcgccatcttggctcactgtaacctctacctcctgggttcargtgattctcstgmgtcgacctcctgggtggctgggataacaggcacgcaccaccacgcctggatgattttttgtrrttttagtaaagatggggtttcatcatgttggccaggctggtctggaactcctgacctcagatgaatccgcccacctcggcctcccacagtgtagggattacaggcatgagtcactgcgcccaat

SEQ ID NO: 10169 - DNA, 313 bp, Homo sapiens
  misc_feature 138: m=a or c
  misc_feature 149: b=c or g or t
  misc_feature 235: m=a or c
  misc_feature 307: w=a or t
tatgttctctggcaagggctgtccatggtcttgctccatctccttggctgggagaaagcactgcagttcccacccttccctgagagcctggaattaaagacagttactggggtttgcggcgaagaaatgacaacctgmttttgcaatgbagagggagaccagggtccggtaattagatgccgttcagcgtctgagtcacgggctgtggccagggtctcctgacagcctgccgagmagctcttcccagtgggaaaatgagggatctcccaagtctgctgggtaggagccagaccatgacccggagacwagggca

SEQ ID NO: 10170 - DNA, 239 bp, Homo sapiens
  misc_feature 239: y=c or t
cttttgttttgcaatgccctgcccccagaggtggagtctacagaggcaggcaggcctccttgagctgaggtgggctccacccagttcgagcttcccagctgctttgtttacctactcaagcctgggcaatggtgggcgcccttcccccagcctcgcttctgccttgcagtttgatctcagactgctgtgctagcaatgagcgaggctccatgggcgtaggaccctctgagccacggcgy

SEQ ID NO: 10171 - DNA, 247 bp, Homo sapiens
acgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgtagaacaaaatgaaaagtctcccatgtctacttctttccacacagacacggcaaccatccgatttctcaatcttttccccacctct

SEQ ID NO: 10172 - DNA, 157 bp, Homo sapiens
tcttggcactaccggcagtcctgttcagaatgagcaaggctttgtggagttcaaaatttctgggcctctgcagtacatgtggtggtaccatgtggtgggcctgatttggatcagtgaatttattctagcatgtccagcagatgacagtggcaggagc

SEQ ID NO: 10173 - DNA, 197 bp, Homo sapiens
tccaatcacccaagctaacaaaaaaataacaataatgaaaagggagaatcagcttttactcctctttcaccattcctatccagcctgtaggcaggtcctgttggttctacctgtgcctccttcctctacccccaaactcctttccctttgagtgagacctgcctaatttaggttgtcatcctctctgactagcaata

SEQ ID NO: 10174 - DNA, 317 bp, Homo sapiens
  misc_feature 104: y=c or t
  misc_feature 123: k=g or t
  misc_feature 133: k=g or t
  misc_feature 134: s=g or c
  misc_feature 140: d=a or g or t
  misc_feature 145: w=a or t
  misc_feature 146: w=a or t
  misc_feature 161: k=g or t
  misc_feature 232: k=g or t
  misc_feature 256: m=a or c
  misc_feature 273: d=a or g or t
  misc_feature 274: d=a or g or t
catacatttgtatttgttgttggagaagtaattctttataggtaatctgccttaactctgataactttacagattttctcattttccttgatgctttgtagttytattacaatatgtcctgtkgtattatttkstttgtdttgtwwtgttttcagtttgtkccttggttgtgagtgttcaatctggggagtcaagactttactttgggaaaatagtcattatgtctttgccktcctactgatacctctttctctgmttctgaaatgcctaatddtatagttgtggagcttctcaattaaccacatcacctaacctct

SEQ ID NO: 10175 - DNA, 431 bp, Homo sapiens
  misc_feature 22: w=a or t
  misc_feature 68: w=a or t
  misc_feature 392: v=a or c or g
caaagaaattttagtggtttawcagatcccaaaaagtacaattttggtgcatggcaagggcttgtgtwgccatcctggcttttaaaggtgatggcatgagggctcccatatccctccatggtgtactgccaggcctttcagggagtagttgattgtgccatgggtggatgggaggggcagctggatgcgatccgttcatctcatcacttggttgggttggacagtctggttttctagactgtttccttcttccatcatggctttctcccaaagaggcgcactcagtctcagagtatagtcatcttgtgccaagaatatttgagtagcggggctctcccaccagatcctccaatcaattattgctgctgaatatcctagtctgtgtctgtggvccatgcttatcttgtccttggttttgaaattctttattt

SEQ ID NO: 10176 - DNA, 193 bp, Homo sapiens
  misc_feature 107: y=c or t
  misc_feature 109: w=a or t
  misc_feature 128: n=a, g, c or t
gataatgttgcttcaattggggccctttaaagtcttttttttttctttctcttttagttctttattttcttttgtctattccctttctttccaccttcttcctttaycwatatatgtgtataattttncttcttcttttttctaactatctcctcccagtgtcaggaatcattttgtaagcatttccaggaca

SEQ ID NO: 10177 - DNA, 418 bp, Homo sapiens
  misc_feature 123: s=g or c
  misc_feature 127: y=c or t
  misc_feature 132: m=a or c
  misc_feature 221: k=g or t
  misc_feature 222: k=g or t
  misc_feature 354: w=a or t
  misc_feature 361: m=a or c
  misc_feature 381: k=g or t
  misc_feature 397: h=a or c or t
tggatttgttgtttggggtttttttttgttttttttgtttgtttgtttgtttgtttgttttgagaaggagtcttggctctgtcacccaggctagagtgcagtggcgtgatctcagctcacggsagcytccamctcctgggttccagtgattctcctgcctcagcctcccgagtagctgggattacaggcatgcgccaccctgcccagctaaattttttgtkkgtttttttgagatggagtgtcgctcttgttgcccagggctggagtgcaatggcgcgatcttggcttactgcaacctccgccccctgggttcaagtgattctcctgtctcagccttctgagtagctgggatgwcaggcamacaccgccccagctaatttkgtatttttagtagaghcagatggggtttcaccatgtt

SEQ ID NO: 10178 - DNA, 215 bp, Homo sapiens
  misc_feature 188: r=a or g
ccttctagaaatattttaaacatatataagcaagtaacagtagtaatagcaggctgggcgttgtgcctcgcacctgtagtcccagcaccttgggaggcagaggcagaggcggaggcaggaggatcgcttgagcccaggagtccgtgagcagcctggacaacatagggagaccccattgctactaaaartaatttaaaaataataacagcagccta

SEQ ID NO: 10179 - DNA, 211 bp, Homo sapiens
  misc_feature 114: m=a or c
  misc_feature 116: m=a or c
  misc_feature 119: h=a or c or t
  misc_feature 121: h=a or c or t
  misc_feature 125: w=a or t
  misc_feature 129: w=a or t
  misc_feature 132: k=g or t
  misc_feature 134: w=a or t
  misc_feature 141: m=a or c
  misc_feature 152: b=c or g or t
  misc_feature 153: n=a, g, c or t
  misc_feature 154: n=a, g, c or t
  misc_feature 178: k=g or t
  misc_feature 181: m=a or c
  misc_feature 187: r=a or g
accatgccccttgcccgtctcgcaccttgctgctgtctctaaccccccagcacctcccgcaggcctggacgtcttatccctctccttagccccaggagcgtgtttcaggaactmtmcthahctcwgtgwctkgwgttttgmagtgatcaggbnnaaagcgtcagtgaagaaggaagtkgamtctggraacgacaatttatggcaaccctat

SEQ ID NO: 10180 - DNA, 388 bp, Homo sapiens
  misc_feature 341: m=a or c
ttagttcctttacactcaccaccctagcaagtgccatgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaaagttctggaaatgcagaatggcgttagatttatatttggtttgttaattttatatcactgtttttcactgtttctgtggacaaataatggttgctttgctgaagtgttcttcctcaatcttgattgccctgtacctacccaaaagctgtagtcamacgtcctaaaggccaagcaacccactgggatggtggggggtcttgga

SEQ ID NO: 10181 - DNA, 204 bp, Homo sapiens
  misc_feature 71: w=a or t
  misc_feature 131: w=a or t
cctttcttttctttttctttctttctatttatttattttttgtttgtttgttttggagacagagtttcgtwcttgttgcccaggctggagtgcaatggcacgatctcggctcaccacaacctccacctccwaggttcaagcaattctcctgtctcagccgccccagtagctggaattacaagcacctgccaccatgcccggccg

SEQ ID NO: 10182 - DNA, 294 bp, Homo sapiens
  misc_feature 26: w=a or t
  misc_feature 92: w=a or t
  misc_feature 108: w=a or t
  misc_feature 109: r=a or g
  misc_feature 116: m=a or c
  misc_feature 117: m=a or c
  misc_feature 166: r=a or g
  misc_feature 177: k=g or t
  misc_feature 268: m=a or c
  misc_feature 285: r=a or g
attttggataacagtcctttatcggwtatgtcttttgcacatattttctcccagcctgtggcttgtgttctcattcttttgatgttgctatwttttttccccaatttwrttgattmmtcttatgatagatgaggatttaacacatggccctgcaaccctctcctartgtcataatakcactgtttttagtttctttcttggttattgcttttagtaatgtatttcatctttatttcttgtcttgtcaactgtatatagtatctttgamaccctgtttgtaaggtragggtggat

SEQ ID NO: 10183 - DNA, 299 bp, Homo sapiens
  misc_feature 133: w=a or t
  misc_feature 188: n=a, g, c or t
  misc_feature 268: r=a or g
ccagcactgtgaatatgtcttctcattgtgttttagctagtacagcttctaatgagaagtctgtgatgtcttatctttgttcctctgtgtgcaatgtgtctttttccctctggcaaacttaagatgttttctwtatcactggtttgcaggaatttgattatgatggccttggtgtggttttcttttgntttaacctgcttggtgttcattgatcttcttggaactttgggatcatatttttcatgaaatttggaattttttctgctcrtcctctgtctctctcctttcccctgggaccc

SEQ ID NO: 10184 - DNA, 145 bp, Homo sapiens
  misc_feature 14: k=g or t
  misc_feature 46: k=g or t
  misc_feature 117: d=a or g or t
tattttttttctgkcaaggtgttctttatttcagagagagggcagkacagggggctcagtctttcttggcatcagctttcctcatgatggctgggacattgctcagctcctcctgcdtcctcttagtgcggatgtgtgtcccctt

SEQ ID NO: 10185 - DNA, 172 bp, Homo sapiens
  misc_feature 121: w=a or t
  misc_feature 124: b=c or g or t
  misc_feature 129: s=g or c
  misc_feature 132: r=a or g
  misc_feature 133: n=a, g, c or t
caaaaaggtagcattgttttttgctgttggatgtttctttcaaccttgtgttttgttactgctcctaaagaatcagttatgcggccaggcgcggtggctcacgcctataatccagcacttwggbagcgscgrngtgggtggatcacctgagatcaggagatcaagaccaacc

SEQ ID NO: 10186 - DNA, 281 bp, Homo sapiens
  misc_feature 173: k=g or t
gcgcttggttcgtccctcgcccgaggagcgcggtggcggcgtgggagggagcctctgacggcgtctggaactctattttaagaacctctcaaaacgaaacaagcaaatcatgggagaagaattggaaataaccgaaagctgcgggtttgtgttgctacttgtaaccgtgcagkttattctaaacttgccccgatcatgtttggcattaaaaccgaacctgagttctttgaacttgatgttgtggtacttggctctcacctgatagatgactatggaaatac

SEQ ID NO: 10187 - DNA, 181 bp, Homo sapiens
  misc_feature 106: r=a or g
taaagtcctgtgtatgacatgacatagtatttgcgtaatttaaatgtacataaagatggagtctgtcaccttgtcaccagccccagtcttccccgtccctgcacarctccttttactgacatcccattttctaggcgagtcccttggtggaggcacactgcttgtcccactcctcccccca

SEQ ID NO: 10188 - DNA, 157 bp, Homo sapiens
tatttattttatttttttgagacagtcttgctctgtcactcaggctggggtgcggtggtatggtctcggttcactgcaacctccgcccccaggttcgggcgatcctcctgccctcagcctcccgggtagctgggattacaggtgcctgccacccagc

SEQ ID NO: 10189 - DNA, 257 bp, Homo sapiens
  misc_feature 106: r=a or g
  misc_feature 110: w=a or t
actgcggaaggttgcccgggctggcgccgctgggcagagccggtgcgacgtttccctttccagctttgttcttccggccctgctgtctgcctccccgggctgattrgatwcgttactgctttgcaacgcgcacctaactccagacggggtctcactctgtcgcccaggctggagtgcagtggcacaatctcagcttgctgtgacctcagctctctgcgacctctgcttgctggactcaagcgatcctcccaccacat

SEQ ID NO: 10190 - DNA, 227 bp, Homo sapiens
  misc_feature 16: d=a or g or t
  misc_feature 113: r=a or g
  misc_feature 227: d=a or g or t
cgcgaaaaatgagggdaaagaaaccatcaggaaagactctcagaggccaggcgcggtggctcatccctgtaatcccagcactttgggaggctgaggcggccagatcacttgargtcaggagttcgagattagcctggccaacatggcgaagtccgtctctactaaaaatacaaattagccgggcgtggtgacacacgcctgcaatcgtagctactcaggatggcggd

SEQ ID NO: 10191 - DNA, 186 bp, Homo sapiens
  misc_feature 139: n=a, g, c or t
cgcacagagcctcacagaggctgcctttcctcttccccttcccctttcttcacctctttccatttcacttctttgtggctcttcttgggcctggtttcctgtttcctgacctccctgttcaacccccaaacggccaagncattgggagaccctctgccctatacagcggccaaggcctgaaccacc

SEQ ID NO: 10192 - DNA, 286 bp, Homo sapiens
  misc_feature 196: n=a, g, c or t
  misc_feature 200: s=g or c
  misc_feature 201: s=g or c
aaacttggtctcaaaaaacaaaaagacaaacaaaaaaacctcttgatggtttttcccttgtttactatttgatttatgtatattccttaagctctaaatactttttgccccaacttgccttggcattgactcttagtagtaatgctgagttcccttagttcccttttacttttaccctcaaagctcactcagatcncccsstccatgaaacttttaccctttacttctaagctccctgtttgttctgaaagcactgtgcttacatctgagttcatatagccccccc

SEQ ID NO: 10193 - DNA, 205 bp, Homo sapiens
ttaagcatttatcatttctttgtgtttggagcatgtcagattttcccttcttgctattttgaaatatacaataaattcttattaactattgttgccctgttgtgctgccaaacactaaaacttaatttttgtaactgtattttagttcccattagccaagctctctttccccgttctccagtacctttcctggcctctggtaacc

SEQ ID NO: 10194 - DNA, 139 bp, Homo sapiens
ctgtggggtttttcactttcttgctggtgtttagttgaagcacagaagttcttaattttgacaaaatccccattttatttattttttcttttgttgtgtgttcttggtattatatctagtaacactttgcctgacccaa

SEQ ID NO: 10195 - DNA, 320 bp, Homo sapiens
  misc_feature 236: s=g or c
  misc_feature 316: m=a or c
ttttccagggagaggctagtggtaacaggccgagctggatggatgggtatggggagaggggcaggacgttcagccctgggattctggccgaccctcgccttccttctctgcagcttccccgcagccacctccccgtgcaagatcctcaagtgcaactctgagttctggagcgccacgtcgggcagccacgccccagcctcagacgacacccccgagttctgtgcagccttgcgcastacgccctgtgcacgcggcggacggcccgcacctgccggggtgacctggcctaccactcggccgtccatggcatagaggmcctc

SEQ ID NO: 10196 - DNA, 197 bp, Homo sapiens
  misc_feature 138: n=a, g, c or t
caaaataaatcatctacattatttttttcttcttttttttcttttttggacatgtacagagctcagccatcagccctactccggaaatttcttcagagactcctggatagtaagtttgccattttattttgtttacantgcttactatgttaaatgtcagaaatgggaagagagaagtttatattttggacccggta

SEQ ID NO: 10197 - DNA, 143 bp, Homo sapiens
  misc_feature 57: h=a or c or t
acccgctgagcattgtggggcccgcttggatctccttgtccaaagggtctgggcgchggggctgcagtctctgggtgaggaggcggacgcgggaaacctgcttcggtctccatggttacgagccgctcagcgcgcagaagggg

SEQ ID NO: 10198 - DNA, 171 bp, Homo sapiens
aggtgtgtcagtctcttcaaatgtgtcttcagcctccctttgtttctccttctgtctgctctctgttcttctcctgtagatgggatctacaggtgtgggagagtcattcaggactccaggttccttccatcttctggctccttcacctcctacagcacgtcctccgcacaa

SEQ ID NO: 10199 - DNA, 222 bp, Homo sapiens
  misc_feature 68: k=g or t
  misc_feature 72: k=g or t
  misc_feature 95: m=a or c
  misc_feature 126: s=g or c
  misc_feature 127: k=g or t
  misc_feature 133: m=a or c
  misc_feature 151: w=a or t
ttatcatatatagaattatctattatatgtagtcttttatgaattactttaacatttgcttttttgtktgtkttttgagacagagtctcgctcamccaggctggagtgcagtggcacaatcttggskcactgmaacctccgcctcctgggwtcaggcgattctcctgcatcagcctcctgagtaactgggattacaggcacccaccaccatacccggacaat

SEQ ID NO: 10200 - DNA, 228 bp, Homo sapiens
  misc_feature 15: m=a or c
  misc_feature 139: v=a or c or g
ttatcatatatagamttatctattatatgtagtcttttatgaattactttaacatttgcttttttgtttgttttttgagacagagtctcgctcacccaggctggagtgcagtggcacaatcttggctcactggcaaccvtccccgccctcctgggttcaggcgattcttcctgcatcagcctcctgagtaactgggattacaggcacccaccaccatacccggacaat

SEQ ID NO: 10201 - DNA, 216 bp, Homo sapiens
  misc_feature 116: s=g or c
  misc_feature 120: w=a or t
  misc_feature 126: w=a or t
  misc_feature 135: y=c or t
  misc_feature 137: d=a or g or t
  misc_feature 143: r=a or g
  misc_feature 151: w=a or t
  misc_feature 170: w=a or t
  misc_feature 191: n=a, g, c or t
  misc_feature 202: k=g or t
tataatgttctgttatgtttgctgtcatctggctaatgtctgcccctcacatatgactgtaaacttcagagaagaggccctagcttggcttgtcccatcctttgttcttgccgtasccgwcctccwgatgcatgygdaatgartgaatgawcaacctcacacatagctgwtgctttcagagtgctgcaganctgccactttkaaaattagatgcct

SEQ ID NO: 10202 - DNA, 376 bp, Homo sapiens
  misc_feature 321: m=a or c
tcctgggtccaagcgatcctcccacctcagcctccttagtagctgagattacaagtaggtgccaccatgcccagcttttgtgctttttgtttgtttgagacagagtcttgctgttgtcgcccgtgctggagtgcagtggcacaatctcagctcactgcaacctctgcctcccaggttcaagtgattctcccgcctcagcctcctgagtagctgggattacaggcatgcccccaccacacccagctaatatttttagtagagacgggctttcaccatgttgaccaggctgatcttgaactcttgacctcaggtgatccaccmgccttggcctctcagagggctaggattataggtgtgagccaccgtgcccagccgc

SEQ ID NO: 10203 - DNA, 177 bp, Homo sapiens
tcattttgaactatttgtatgcattttagttctagcagatttaactaccctaaaacttttgtagactttttaatggttttatttggggctcattccatgttcccaaagccatatccaaaagtttttcaagagaatcttctgctttctaagaagttctctgtgacaataccctaaaaa

SEQ ID NO: 10204 - DNA, 185 bp, Homo sapiens
aagttcagagccacgcgcagtgctcttggccgggaggaggctgtgctgcaccagcacctcttgctccacatctccagagagcccagggccctgtggccgagtgtgtccagcccagtgtcatggggagcttccatatctcatggctccttgctgggccaagccctccagaaccccaaacccccttt

SEQ ID NO: 10205 - DNA, 248 bp, Homo sapiens
  misc_feature 70: s=g or c
  misc_feature 180: s=g or c
  misc_feature 183: b=c or g or t
  misc_feature 184: d=a or g or t
  misc_feature 207: n=a, g, c or t
  misc_feature 208: r=a or g
cttctaatcctagtcttcgtttggtccggttgcactcttcctatagcccagagggcgagagggcctgtgsctgggggaaggaggacgaggttctgcctggatcccagcagtaggacgctgtgccatttgggaacaaaggaatagtctgcctggaatccctgcagatcttggggccggagsaabdtcccaacccttggagcaggaagnracgcaaagttgtcaagaaccaagtcgagctgcctcagagc

SEQ ID NO: 10206 - DNA, 436 bp, Homo sapiens
  misc_feature 273: w=a or t
  misc_feature 274: n=a, g, c or t
  misc_feature 275: b=c or g or t
  misc_feature 286: h=a or c or t
  misc_feature 328: n=a, g, c or t
  misc_feature 329: n=a, g, c or t
  misc_feature 330: b=c or g or t
  misc_feature 331: k=g or t
caaacctgctttccctgttccctttcaaactgctcctgtggttcctgttatgtgagtttaatcatttgttgtgtttgctatttctcagacaggcaaagagttgtttcttctttgttttgtaatctttcttttactctgagcttatctctagtagtaattgtctaacacatgccctaagctgtaaatacatctgtattgagaggttttgagtttgtctttgctcagtgccctaaagacttcaaggatgcatttttaggtttgtttctcagttcwnbatttctacgghgtgtgaactgtgtgcatttggacttgatgcccatgcacagannbkggcctgggcgtctaacttctcggaggtgacttattccaaagtggttgtctggcttactccctgcatccctcgggcagtggcagtgtttattctgggacccgaatt

SEQ ID NO: 10207 - DNA, 400 bp, Homo sapiens
  misc_feature 280: n=a, g, c or t
  misc_feature 281: n=a, g, c or t
  misc_feature 347: w=a or t
  misc_feature 348: n=a, g, c or t
  misc_feature 349: n=a, g, c or t
ccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagttcacagtcccaccaactgtgtaaaagtgttcctatttctccacatcctctccagcacctgttgtgnntcactttttaatgattgccattctaactggtgtgagatggtatctcattgtggttttgatttgcawnnctctgatggccagtgatgatgagcattttttcatgtgttttttggctgcaa

SEQ ID NO: 10208 - DNA, 152 bp, Homo sapiens
tacttttctgcagatggagttgcacttttgttgcccaagcaggagtgcaatggaatgatctcagctcactgcaacctttgcctcctgggttcaagtgattctcctggctcagcctccctgggactgcaggcacgccaccaccacgctctgca

SEQ ID NO: 10209 - DNA, 272 bp, Homo sapiens
  misc_feature 108: w=a or t
  misc_feature 111: k=g or t
  misc_feature 121: w=a or t
  misc_feature 123: r=a or g
  misc_feature 124: r=a or g
  misc_feature 125: r=a or g
  misc_feature 134: w=a or t
cttggctcactgcaagctccacctcctgggttcacgccattctcctgcctcagcctcccaagtagctgggactacaggagcccgccatcacacccggctaattttttwtgkatttttagtwgrrracggggttwcacatgttagccaggatggtctcgatctcctgacctcgtgatccacatgccttggcctcccaaagtgctgggattacaggcgtgagctaccacgcctggcctttcataacatttttaaatggaacatttaccagtaca

SEQ ID NO: 10210 - DNA, 170 bp, Homo sapiens
  misc_feature 15: w=a or t
  misc_feature 16: y=c or t
agcaacctgcttggwycccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccacc

SEQ ID NO: 10211 - DNA, 440 bp, Homo sapiens
  misc_feature 383: r=a or g
  misc_feature 389: h=a or c or t
  misc_feature 397: r=a or g
  misc_feature 398: r=a or g
  misc_feature 408: m=a or c
  misc_feature 409: w=a or t
  misc_feature 412: r=a or g
  misc_feature 425: r=a or g
ccatttgttcttttataagtgttatctccttccatgtcggtaacaaaagtatggggtcgtagttaagtacagagcctctgaggtcagacttggttctgtcacccgctccctactagatgacttgaggcaaggctcttaaccattttctccccttgagagacagggtctggctcttgctcaggctggagtacagtggcgtaatcatggctcactgcagcctccaattcctgggctcaagcgatccttgtgcctcagcctctggagtaactgggactacagatgcatgccactgcacccagttaaaggctcttaacccttctgaggctcagtttcctcaatctgtaaaatggatggatgtcctcatgagttattgaaggggctcraatgahacatacarrccttagatgmwtgraatggcatctagrcatggcgggtgttca

SEQ ID NO: 10212 - DNA, 290 bp, Homo sapiens
  misc_feature 144: w=a or t
  misc_feature 153: w=a or t
  misc_feature 209: m=a or c
  misc_feature 233: y=c or t
tcgcaggccagtgctgctggtgccggagtccggaagctgacggcggtgcgtggaaatcgtcgcggagttcagtgttttgcttttggggatcacaaactcaggggcacactggcccggcgggcatccagccggttggcttgcctwaggctggawtgcagcggtgcgatcaggactcattgcatcctcaacctccccgactcaagcagtcmtcccacctcagcctcctgagtagyaaggctacagtagagacggggtttcaccgtgttagccaagaatggtctcgatctcct

SEQ ID NO: 10213 - DNA, 340 bp, Homo sapiens
atcagccactgcagctccctgagcactctctacagagacgcggcaccccagacatgaggaggctcctcctggtcaccagcctggtggttgtgctgctgtgggaggcaggtgcagtcccagcacccaagggcctggggcgcccgtgtggtggagcctccggagaaggacgaccagctggtggtgctgttccctgtccagaagccgaaactcttgaccaccgaggagaagccacgaggtcagggcaggggccccatccttccaggcaccaaggcctggatggagaccgaggacaccctgggccgtgtcctgagtcccgagcccgaccatgacagcctgtacc

SEQ ID NO: 10214 - DNA, 146 bp, Homo sapiens
  misc_feature 138: b=c or g or t
tcaagacagggtctcactctgtcacccagactggagtgcagtggtgtaatcacagttcactgcaacttctgcctcctgggcttaagcgatccttcaacctcagcctcccaaatagttgaaactacaggtgcccaccabcactccta

SEQ ID NO: 10215 - DNA, 213 bp, Homo sapiens
ttttccctcctgtgtgggctcgaagccgtacttttccaggttgtcagggtcgaaggtaccgtccttgaagtccttttcgatggcaggcgccacggcttcgctgaagagctgcgcggccgtcaggggcgtctcctcggctctcaggggcgaggtagctcacgtagggcttgagcttgaagccggtcagatccgggacgacgaactccgggacca

SEQ ID NO: 10216 - DNA, 201 bp, Homo sapiens
  misc_feature 16: s=g or c
  misc_feature 55: k=g or t
  misc_feature 98: k=g or t
  misc_feature 112: d=a or g or t
  misc_feature 113: m=a or c
  misc_feature 131: w=a or t
  misc_feature 134: w=a or t
  misc_feature 155: w=a or t
  misc_feature 156: w=a or t
  misc_feature 178: k=g or t
  misc_feature 198: v=a or c or g
ctctttttctttctcsttccttgcttttcttctttttcttccttttttccttccktcctttcttctttctttctttttccttttctttctcctttccktacctttccccttdmctttcccatgccctaccwggwttcatactcacatcagcccawwcaggcgggtggtgccatgtcckcccccttcccctcccccgcvccc

SEQ ID NO: 10217 - DNA, 162 bp, Homo sapiens
agtgcaggccttgcccggaccagcccctcctccactctcctctcccctgtgagctccacctgccccagttctcctggctttaacccctccttggccaaggccagggttgcctgcgggagccaggtgtccgctctccacacctttcacagccccagccctccg

SEQ ID NO: 10218 - DNA, 219 bp, Homo sapiens
  misc_feature 104: k=g or t
  misc_feature 142: d=a or g or t
  misc_feature 218: s=g or c
tgtgtgtagaattgtttataacattctcttattatttgttagatgtctgcaggctatgtggtgatgtctcctgtttcatttcagttattgtttttctttctttktttcgagacggagttttgctcttgttgcccaaggctgdagtacagtggcgcgatctcggctcactgcaacctctgcccaccgggttaagcgattctcttgcctcagcctcctgsc

SEQ ID NO: 10219 - DNA, 397 bp, Homo sapiens
gttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctgggtaagtgtctgtggtttgtgggcttaataatttagaaaggtataatatatggagattatgga

SEQ ID NO: 10220 - DNA, 251 bp, Homo sapiens
caatagaaccaagaagcagttaagcaccttttacattaggaacaaggacataaaacaagataccacataaaggctatgattcaaactcaaaaagagcaaggactcttgggtctccttcaggtcaataaagaggttatcataagatcaaagcactgtgccagatacctcagtgttgtaacagtactgtgatacctggcacagtgctttgatcttatgataacctctttattgacctgaaggagacccaagag

SEQ ID NO: 10221 - DNA, 177 bp, Homo sapiens
gaaaacgctttctccacagaggaaaaagagcaatcgcaccctgagtcatataccgcgaaaacgcatctagctacatgtggaggacaagaggaagatttttgaggaccaaaagggtgtggagaggcaatcgaggtacgaggatattgttcaccccgtcaacggaaagtgaaaaaacag

SEQ ID NO: 10222 - DNA, 92 bp, Homo sapiens
taaaatcttactctttgaagaggcaccatgcaatagtatagaggcacatcacaaaaagagctcctgttaataatgcaggaatccagttacca

SEQ ID NO: 10223 - DNA, 416 bp, Homo sapiens
  misc_feature 28: r=a or g
agccccggccccgccccgcgagcgccgrgacttgttggccgcggagactgcgaccctcttctctcagtctgccttactaccatgccgctctacgagggcctggggagcggcggggagaagacggcggtcgtgatcgacctgggagaggcctttaccaacctgtcagagttgttcagtataatatcaatacagaagaattatattcctacctaaaggaattcatccacatactatatttcaggcatctattggtgaatcccagagaccgccgagttgtgattatcgaatcggtattatgtccttctcacttcagagagacactcactcgtgttcttttcaaatattttgaggttccatctgtcttgcttgctccaagtcatctaatggctcttctgacgcttggaattaattctgcc

SEQ ID NO: 10224 - DNA, 217 bp, Homo sapiens
  misc_feature 28: r=a or g
agccccggccccgccccgcgagcgccgrgacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtcctaagcctctgtgtcacacgtagtctttcccgc

SEQ ID NO: 10225 - DNA, 453 bp, Homo sapiens
  misc_feature 36: s=g or c
  misc_feature 221: k=g or t
atgatcagtagctgcaccactagaaagatggcggasaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtktactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggg

SEQ ID NO: 10226 - DNA, 477 bp, Homo sapiens
  misc_feature 36: s=g or c
  misc_feature 362: w=a or t
atgatcagtagctgcaccactagaaagatggcggasaagagcaaagaaaaatccctttggttccagaaaatctcctgaaaaagaggaaggcttatcaagccctcaaagccacccaggcaaagcaggcacttttggcaaagaaggagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctwaagaaaatttttagtggtgtctttgtaaaagtcaccccccagaatctaaaaatgctgcgtatagtggaaccttatgtgacctggggggaagtttggcgtcatttgcttggaagac

SEQ ID NO: 10227 - DNA, 675 bp, Homo sapiens
  misc_feature 36: s=g or c
  misc_feature 443: k=g or t
atgatcagtagctgcaccactagaaagatggcggasaagagcaaagaaaaatccctttggttccagaaaatctcctgaaaaagaggaaggcttatcaagccctcaaagccacccaggcaaagcaggcacttttggcaaagaaggaggtaatggtggggaaccaagagaaagtaattagaatttttatttggtgagttttatcccgcatgtgttggactacatttggtattgacgagctccccccaacggtttgacagaccagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtktactggtgcagagaaccattgcaagacttcgcctaaagaaaatttttagtggtgtctttgtaaaagtcaccccccagaatctaaaaatgctgcgtatagtggaaccttatgtgacctggggatttccaaatctgaagtctgtccgagaactcattttgaaacgtggacaagccaaggtcaagaataagaccatccctctgacagacaatacagtgattgaggagcacctggg

SEQ ID NO: 10228 - DNA, 593 bp, Homo sapiens
  misc_feature 36: s=g or c
  misc_feature 478: w=a or t
atgatcagtagctgcaccactagaaagatggcggasaagagcaaagaaaaatccctttggttccagaaaatctcctgaaaaagaggaaggcttatcaagccctcaaagccacccaggcaaagcaggcacttttggcaaagaaggaggtaatggtggggaaccaagagaaagtaattagaatttttatttggtgagttttatcccgcatgtgttggactacatttggtattgacgagctccccccaacggtttgacagaccagcagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgacggcgtgagtttactggtgcagagaaccattgcaagacttcgcctwaagaaaatttttagtggtgtctttgtaaaagtcaccccccagaatctaaaaatgctgcgtatagtggaaccttatgtgacctggggggaagtttggcgtcatttgcttggaagac

SEQ ID NO: 10229 - DNA, 152 bp, Homo sapiens
accactagaaagatggcggacaagagtgagtgtttggggctttgaatatctggagtggggtcttgagtatccggtgccatccacggtgtttatgccttggtggcggattcctgtgggctctaggaatagaaaaggccacagtttacaaaggg

SEQ ID NO: 10230 - DNA, 348 bp, Homo sapiens
ctattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgc

SEQ ID NO: 10231 - DNA, 326 bp, Homo sapiens
aaaagggtggggcagacgctccgtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgc

SEQ ID NO: 10232 - DNA, 408 bp, Homo sapiens
aaaagggtggggcagacgctccgtttccggtggcagggtctggggaagcggcggcaggcgccatgtccggccgcgaaggtggcaagaagaagccactgaaacagcccaagaagcaggccaaggagatggacgaggtgagggcgggcgcggaggcactggcgggtgcgggggcgctgggagacaggcctgagttgaacacgctctgcctctccccaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgc

SEQ ID NO: 10233 - DNA, 345 bp, Homo sapiens
  misc_feature 31: w=a or t
cgcgaaggtaagtgttccggaaccgtgaggwctgcggggacggcggggtggggaccgggcggcaggggcaggccgaacgtgctcgtgtcgcccacaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgc

SEQ ID NO: 10234 - DNA, 427 bp, Homo sapiens
  misc_feature 31: w=a or t
cgcgaaggtaagtgttccggaaccgtgaggwctgcggggacggcggggtggggaccgggcggcaggggcaggccgaacgtgctcgtgtcgcccacaggtggcaagaagaagccactgaaacagcccaagaagcaggccaaggagatggacgaggtgagggcgggcgcggaggcactggcgggtgcgggggcgctgggagacaggcctgagttgaacacgctctgcctctccccaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgc

SEQ ID NO: 10235 - DNA, 288 bp, Homo sapiens
  misc_feature 286: r=a or g
  misc_feature 287: n=a, g, c or t
attgtttgttgtaacctcagccaacgttttttagctgagaaaggggaaaaagagggagagtgggaaaaaaagaaaggcctccagaaacattgcatctggaaagtccagaacaagttgttaatttcccagcaagcactggagcggatttggaaggaactatgcaatgtagtgggttctttgtgaaagaacagcaatgagcaaagccacaggaacctccgctggggtgcccagaacactggccctgggctagcgacttgcctcagccccatttcccggagaggctgcrng

SEQ ID NO: 10236 - DNA, 282 bp, Homo sapiens
catcctgctgggaaacacatggcaacaggtagaggccacttgataggcagctgtgctaagggtagcataattgaagagcaaaggggcacatctctaggtggagaatctctgcccttattagccactgttacggataggaggtgtaagagggtgcctgatctgtcatgtgggtcagagtgaaaaagaggttgagaaccactgatgataacggaaatatttatatgttctaggcattgggctattgtatttcctatatataatccttacagcaatcctatgaag

SEQ ID NO: 10237 - DNA, 368 bp, Homo sapiens
tcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttc

SEQ ID NO: 10238 - DNA, 192 bp, Homo sapiens
  misc_feature 57: r=a or g
  misc_feature 60: s=g or c
  misc_feature 91: k=g or t
ctttttctcggaaacgcggcgcggccggctgccggaaaacagggcagacctgtatgrttsgtttattcctggggttgtcatatcatggctkataatgacacagacagaaaccagactgagaagctcctaaaaagagtacgagaactggagcaagaggtgcaaagacttaaaaaggaacaggccaaaaataag

SEQ ID NO: 10239 - DNA, 143 bp, Homo sapiens
gcttcagcaggtagtgccgcttccgccgcagcccggttcagccgccgccgctggcgcgcactgtacagctgcatcagctgttcgtaggacatgtccagcagctggtccaggtccacgccgcgcttcatcgcagtaggaatggc

SEQ ID NO: 10240 - DNA, 471 bp, Homo sapiens
caaaattatccaggtaggctcaatgtaatcaggaagggcctttaaagtgagagagggaggcagaagaggaagtcagagcgatgtgctgtgaaatctactaccgtttgctggttttgaaaatggagaaaaagagtgaggaactgagaaacatggatggccttgggaacgtggaaaagggtcactgaaatgggacgacatgaactcaaggaggctatttatgaccatgtcatttgcaacatgaagaaagcttatctggagtgaaagtaaatgagaccaacagagataagagacccggagaaatcctggttacactgcttgaatcctgtcagtcctatactggagtcctgttaatacaaaataatagtaataatccctctgtttcttatgtttatgccaacttcaacaaaaagaaacttgactaagagacaatataagaacttaatgtgtaattaagaaagaactctccaccac

SEQ ID NO: 10241 - DNA, 220 bp, Homo sapiens
  misc_feature 104: r=a or g
  misc_feature 124: m=a or c
agagcgatgtgctgtgaaatctactaccgtttgctggttttgaaaatggagaaaaagagtgaggaactgagaaacatggatggccttgggaacgtggaaaaggracttcctatgtcatgaagamactcaaggaactctatcgagaaattcatgtatcaagaaactgaggcctactgccaatagccatatgagcgaatcatctcaaaagtgattttatagc

SEQ ID NO: 10242 - DNA, 180 bp, Homo sapiens
  misc_feature 122: n=a, g, c or t
  misc_feature 138: n=a, g, c or t
aaaaagagtgtagtataatgaatccccacatacccatcactcagcttcagccatgatcaacacttggccagtcttgtttcatccagcggattcttctctttgatctgcgggatcctcccaantcatgtggtagcagtnggtgtgttttggaagagggtaggagagtcggcagatctgggc

SEQ ID NO: 10243 - DNA, 223 bp, Homo sapiens
  misc_feature 211: y=c or t
agaatcacaggaacacacacttggaaacctcagccctgcattcctcgctccaaggggcagacaggacaggctgaaaatagcaactggttccaaaaagataaaggggatgactccagcagagcacctcactcctttgaagagcacagaggaagatgtcagcccagtcccttcctgcagcaacaccccccacgcagaagccccctcggatcayccgcccccgccc

SEQ ID NO: 10244 - DNA, 417 bp, Homo sapiens
ctgtattcaataattttcacagagcttttaaattagctttcctgttgatcaagtttgtgtcaattaagatatatttgtaatggcatttctgcaaatttcatactctaatgtgaaataattacaattctctgtgttcagtatggtgaaaaagatatgtgaaggactcaaaataaacatgacgtactctttggacctcttgtttccacatctacaaaatgaggatttacagtttagatctcttcgaggattaaaaactgcattttatagctggacgtggtggcatgtgcctgtagtcccagctactcgggaggctggggtaggagaattgcttgaacctgggaggcggaggttgcagtgagccaagatcatgccattgcactccagcctgggcagcagagcaagactccatctcaaaaa

SEQ ID NO: 10245 - DNA, 549 bp, Homo sapiens
  misc_feature 57: s=g or c
gacagtgacccggaagtagaagtggcccttgcaggcaagagtgctggagggcggcascggcgaccggagcggtaggagcagcaatttatccgtgtgcagccccaaactggaaagaagatgctaattaaagtgaagacgctgaccggaaaggagattgagattgacattgaacctacagacaaggtggaggccaatactttgcaaaaccacgaaaccaaggtggctatggcggttccagcagcagcagtagctatggcagtggcagaagattttaattaggaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagattttttttttgcacccca

SEQ ID NO: 10246 - DNA, 347 bp, Homo sapiens
  misc_feature 41: k=g or t
  misc_feature 57: n=a, g, c or t
  misc_feature 131: k=g or t
  misc_feature 144: y=c or t
  misc_feature 211: k=g or t
  misc_feature 230: k=g or t
  misc_feature 231: r=a or g
  misc_feature 269: n=a, g, c or t
gacagtgacccggaagtagaagtggcccttgcaggcaagaktgctggagggcggcanggcgaccggagcggtaggagcagcaatttatccgtgtgcagccccaaactggaaagaagatgctaattaaagtkaaggtgggagcaycttccagccttgccaagacgcagtagtactgggctggcagcagtgccttacgggagacgtggggaakgaaaaccacgcctttccckrgcctggaggacgctgactgcctcagggctccgcgcgangggtggtgggaaatagggggacccagaagggctttgagagcggggcccaggtcccacctgacgaccctggggtatttt

SEQ ID NO: 10247 - DNA, 164 bp, Homo sapiens
  misc_feature 57: s=g or c
gacagtgacccggaagtagaagtggcccttgcaggcaagagtgctggagggcggcasggcgaccggagcggtaggagcagcaatttatccgtgtgcagccccaaactggaaagaagatgctaattaaagtgaagacgctgaccggagtctcctctctaccacca

SEQ ID NO: 10248 - DNA, 325 bp, Homo sapiens
  misc_feature 263: s=g or c
  misc_feature 264: s=g or c
agagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggttcttctgcttacataaaatgtttctgtactaaatttgctgagcagssaacacattcataaaagcacagaggcaagctaaactcaattcctaagcctatcttcaccaac

SEQ ID NO: 10249 - DNA, 321 bp, Homo sapiens
  misc_feature 62: n=a, g, c or t
  misc_feature 236: k=g or t
acagaaccggaagcagcgtgtagttctcttcccttttgcggccatcaccgaagcgggagcgnccaaaatgaagtttaatccctttgtgacttccgaccgaagcaagaatcgcaaaaggcatttcaatgcaccttcccacattcgaaggaaggattatgtcttcccctctttccaaagagctgagacagaagtacaacgtgcgatccatgcccatctctggattaagccctgaggakgaactccagactaagcatcctgagacttgagtttgaatcctgcctctgccaccaaccagccttgtgcccgcgggcaactctcgcc

SEQ ID NO: 10250 - DNA, 330 bp, Homo sapiens
  misc_feature 60: s=g or c
  misc_feature 140: s=g or c
  misc_feature 143: k=g or t
  misc_feature 155: w=a or t
  misc_feature 158: w=a or t
gccatgggctgcctcgggaacagtaagaccgaggaccagcgcaacgaggagaaggcgcasgtgaggccaacaaaaagatcgagaagcagctgcagaaggacaagcaggtctaccgggccacgcaccgcctgctgctgctsggkgctggagaatcwggwaaaagcaccattgtgaagcagatgaagatcatccatgaagatggcttctccggagaagacgtgaaacagtacaagcctgttgtctacagcaacactatccagtccctggcagccatcgtccgggccatggacactttgggcatcgaatatggtgataaggagagaaaggctg

SEQ ID NO: 10251 - DNA, 327 bp, Homo sapiens
cattgagaattgaaagcttcattttgaaattttttctctatattatctctatttccaccaaatttttcttctctgcttattttgtttaaggtatttatatatacttttcatactgaagcttccctctaatagttattgacctttgggcatatattcagttttaaacatgagtctctaagaaaaaaaggtgcctggttagggcttatcaataagtgagtttgctgcaggtttattgggcaagacctgcccttttcaatggggattttcctcaaatgtcagaaatgtgatacttttttctctaggtccatccaccttctctagcataga

SEQ ID NO: 10252 - DNA, 182 bp, Homo sapiens
ctttctctctttttccgcgaggcctacacgacgccaggggtttgggtgctggagaatctggtaaaagcaccattgtgaagcagatgaggatcctgcatgttaatgggtttaatggagagggcggcgaagaggacccgcaggctgcaaggagcaacagcgatggcagtgagaaggcaaccaaa

SEQ ID NO: 10253 - DNA, 407 bp, Homo sapiens
  misc_feature 389: w=a or t
caggctgactggattacattcctacccctaaaagtggttaaaaataagaccagataatttactcttctgttgtgtactacttgatctagttatttggaaggttctttgctttgtttgcaaaggactgtctaattaaaaagatctaattaatggctagttggcaactaataaaacttagagatattattcctactaaatttttaaatcaaacctaagtgttctatttatttatttataaaactaacctttcttcaagagatttaagactcaaatattagttttttcagaaatagccaggaagatttagaatctttaggagagaggtaatatttaactttcttggctactggaatcaaaattactattatgaacctcagtgggaactagawgaactcagtacatagttt

SEQ ID NO: 10254 - DNA, 346 bp, Homo sapiens
  misc_feature 125: n=a, g, c or t
ttaatgatggaataaaaattgggcttgagagcaggctgaaatgtcactgagtgtgtgttttactctctcataataggttgcaatgaggtgtcgctgcagcagcatgcacttcttggagcagaatngaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctatttagaataaattcccaacttctcttgctttctatgctgtttgtagtgaaataatagaatgagcacc

SEQ ID NO: 10255 - DNA, 457 bp, Homo sapiens
  misc_feature 55: k=g or t
gacaacagccacacgtgatcggccaacactgagtcttacctcgttgtggcgtcakaaccgccgtcgctcgctcccttctcggcagtggtacctgttcccggtgtccctgaggacgtgcgggccaggtacggccccgaaagtaggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcacacagtattagaggcaccgctgcccagtgacacatgt

SEQ ID NO: 10256 - DNA, 279 bp, Homo sapiens
agctgcagagctacgcagccttcggtgcagtcgtcactcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaagg

SEQ ID NO: 10257 - DNA, 298 bp, Homo sapiens
  misc_feature 107: s=g or c
agctgcagagcgacgcagccttcggtgcagtcgtcactcgcatctggctaccagctccccgctgccctgcgctcggcgggctggcatcgggcccggggaaagcggasagtagttcggtgtagcactgtttgcggcgaggagaaaggaaggagaggagaaaactgcactggatcaaggaggtcttcccataggcctgcagtagggctgtttaccattggaagcaagggaaagaggaggagatcaatctagaagcatggagatctgcctgcatgtctgctgcagggcttaagatcacggg

SEQ ID NO: 10258 - DNA, 421 bp, Homo sapiens
  misc_feature 55: k=g or t
  misc_feature 186: r=a or g
gacaacagccacacgtgatcggccaacactgagtcttacctcgttgtggcgtcakaaccgccgtcgctcgctcccttctcggcagtggtacctgttcccggtgtccctgaggacgtgcgggccaggtttgcggggccaagtgttgcggcgacgcacctcacgtcgagaatcgggaggaggagactrcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcacacagtattagaggcaccgctgcccagtgacacatgt

SEQ ID NO: 10259 - DNA, 451 bp, Homo sapiens
  misc_feature 55: k=g or t
  misc_feature 217: r=a or g
gacaacagccacacgtgatcggccaacactgagtcttacctcgttgtggcgtcakaaccgccgtcgctcgctcccttctcggcagtggtacctgttcccggtgtccctgaggacgtgcgggccaggtacggccccttcttgatgcagaaaatggttgtttgcggggccaagtgttgcggcgacgcacctcacgtcgagaatcgggaggaggagactrcaaggataggcccaggagtaatggagtccaaagagaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtagcggttccgcgttaggcacacagtattagaggcaccgctgcccagtgacacatgt

SEQ ID NO: 10260 - DNA, 118 bp, Homo sapiens
tgtttatacttggcctcttctgcaagaggaatctcttgaaaacaggggcacacagaaatttgatttgtggccaaattggatgaaaaagatgaggctctaaggaaatggtggcatgaag

SEQ ID NO: 10261 - DNA, 429 bp, Homo sapiens
  misc_feature 412: r=a or g
aacaaaaggtggagctatgagcacagataaagactcaagtctggggacctcctggtcactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggactggcagagaagaggctgctgatgctgaggctgaggtggcctccttgaacgtagrtccagctggttgaagaa

SEQ ID NO: 10262 - DNA, 497 bp, Homo sapiens
  misc_feature 256: y=c or t
  misc_feature 258: y=c or t
atagcgtggagtgacggtgccaccgcggcgcatgccctgtacagacttttggggaactgggtactgatgaacccgaacaggagttgcttctggttttaattctactactactggtgcatgatttacagctaaaccagaatctcatgcagtcacccaggctggagtgtagaagcatgatgtcggttcactgcaacctctgcctcctggtttcagagaggagtctgcaatgccgagtggaggaaggaggaaccggagygygagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaagatggaactccaggaaatccaactcaaagaagctaagcaca

SEQ ID NO: 10263 - DNA, 631 bp, Homo sapiens
  misc_feature 221: k=g or t
  misc_feature 228: y=c or t
  misc_feature 541: k=g or t
atagcgtggagtgacggtgccaccgcggcgcatgccctgtacagacttttggggaactgggtactgatgaacccgaacaggagttgcttctggttttaattctactactactggtgcatgatttacagctaaaccagaatctcatgcagtcacccaggctggagtgtagaagcatgatgtcggttcactgcaacctctgcctcctggtttcagagaggagkctgcaaygccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtagatccagctggttgaagaagagctggaccgtgctcaggagcgcctggccactgccctgcaaaagctggaagaagctgaaaaagctgctgatgagagtkagagaggtatgaaggttattgaaaaccgggccttaaaagatgaagaaaagatggaactccaggaaatccaactcaaagaagctaagcaca

SEQ ID NO: 10264 - DNA, 542 bp, Homo sapiens
  misc_feature 272: m=a or c
  misc_feature 325: k=g or t
  misc_feature 447: r=a or g
agtttcttccgggtcattgacagaagcgtcaattcctgggagtagttcgttggttttctttcccctcatccttttgcctgctcccggcgaggggtggctttgatttcggcgatgagctcccagaaaggcaacgtggctcgttccagacctcagaagcaccagaatacgtttagcttcaaaaatgacaagttcgataaaagtgtgcagaccaagaaaattaatgcaaaacttcatgatggagtatgtcagcgctgtaaagaagttcttgagtmggcgtgtaaaatacagcaaatacaaaccattatcaaaacctaaaaagtgtgtkaaatgtttacaaaagacagtgaaggattcttatcacataatgtgcaggccatgtgcctgtgaacttgaagtttgcgcaaaatgtggaaagaaagaagacattgttattccgttgaataaagraacagaaaaaatagaacatactgaaaataatctaagttccaaccatagaagaagctgcagaagaaatgaagaaagtgatgatgatttagattttg

SEQ ID NO: 10265 - DNA, 230 bp, Homo sapiens
acatgtactttgttaaagctttatccttgaacagtttttgtagggtataatccctgtcaaagagggcaaaggaatagaagtcaatggccttaatcaagtcagtcaaaagatgaactgaaaaggggattaggatacctctagtctaattctgttctgcctcacttgattgaaaaaaaggtttacactttaaagaacctgacccagcaagtcgttatgagaccatcagagac

SEQ ID NO: 10266 - DNA, 306 bp, Homo sapiens
ctttcaacagacgctcagtgagaaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatgcagcgtgcagggtcaaagacagccggccccccatgtcagtggtctaggatggccagtgaaggcaccaacatcccaagt

SEQ ID NO: 10267 - DNA, 332 bp, Homo sapiens
  misc_feature 330: n=a, g, c or t
tgagatgacattattgtctccataattgagtgatagctttaaaaaaaagattagttttgcttaagaagttacgttacaactgatcagccctatatgaattaactgatcagccctatatgaaacataagttgtgttataacttatcagccgtatatggaacataaatagtttctacctgcttgttaagaggaagctttaatttggttctaataaatacagtatggtagtgattataggaatccaggatgttgaagaaatggcataatgtctatattttggaaacagaaaggaaaagtcacttaagatagtattaagtaattaaattcctangt

SEQ ID NO: 10268 - DNA, 218 bp, Homo sapiens
  misc_feature 112: n=a, g, c or t
  misc_feature 115: w=a or t
  misc_feature 124: n=a, g, c or t
  misc_feature 152: k=g or t
acataaacccttaaacaccgaaattttgtttcaccaaaacttttcaaaaagattataatactattctagaacttgaaatcatattctctgctcttaaaaatatataagaatncawtaataaggncccaggattgttaggaaatcagttatgkgccactggattatatagcagtttttgtgccttctctcctgtgttggcagcagccattgcagttttc

SEQ ID NO: 10269 - DNA, 275 bp, Homo sapiens
gcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccacc

SEQ ID NO: 10270 - DNA, 138 bp, Homo sapiens
agacatttgtttcaaacggctgattgagggagttcaggggttgggggttggcggttcttgcccagtttagcttgggatcaacagctccaacaacgtgtccaatcaacaacagcttgattgtaaaaagattcctatagg

SEQ ID NO: 10271 - DNA, 407 bp, Homo sapiens
  misc_feature 229: w=a or t
  misc_feature 247: y=c or t
ttattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagwcattgccggtgacctggycccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttc

SEQ ID NO: 10272 - DNA, 939 bp, Homo sapiens
  misc_feature 718: r=a or g
  misc_feature 771: w=a or t
ggggactgcgatgaaagggaggcgtccagggaagacctccatgagaaggtgaccttggcataaagaggcaaacgtgggagcgtgctcaggcagaccacggtggtcagaagttgaattcgggccggaggaggaggagtatcaagaatagaaagaaggctgtcattttttgtctcagtgcagacaaaaagtgcatcattgtagaagaaggcaaagagatcttggttggagatgttggtgtaaccataactgatcctttcaagcattttgtgggaatgcttcctgaaaaagattgtcgctatgctttgtatgatgcaagctttgaaacaaaagaatccagaaaagaagagttgatgttttttttgtgggcaccagaactagcacctctgaaaagtaaaatgatctatgcaagctccaaggatgcaattaaaaagaaatttcaaggcataaaacatgaatgtcaagcaaatggaccagaagatctcaatcgggcttgtattgctgaaaagttaggtggatccttaattgtagcctttgaaggatgccctgtgtagattattcagtgccacaaattgaaagcttccatgtttaatgttatcctcttgctatataaataaagcaaatatatttaggccagggtctcactgagggggagctgtcttgtcatcttttagagtaaactattctataaacatatgcaaacagccctaaataaatctaragtctaaagttttattgatgtgaaattaaattcttattggccaaatgcctgtwttgatgagttgatttataaagatttttgttaagctcaggattttaaattacacagttcacaaacagtaaaggccatgtgaagagaattattacatctttattaacctcagcatttactttgtttcttttgcttaggaaattgctcataatctggttataattttggtc

SEQ ID NO: 10273 - DNA, 188 bp, Homo sapiens
gcgtcactcagcgctgggtctctcggtcccgcagccgtgaagaggacggtctgcatactcgctgcccgccggctccctcccccgcgtccctgcgaccgccgcggcgaagatgattttcagttcacccactagaggcaaagacgtaagagagctaccagcgtattgagaggagatacacaggcactacg

SEQ ID NO: 10274 - DNA, 426 bp, Homo sapiens
agatagtccctgttttctgcctaatgtgaataaatgaagtttaatgcgttaggtatatagacatgacattctgccatctgtttttataatacataattacttaacagcttacaggtgatactcaaatatagttggattcgctgtcttactgcacccttctgcatccgctagtcccataggtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacgg

SEQ ID NO: 10275 - DNA, 638 bp, Homo sapiens
  misc_feature 588: r=a or g
  misc_feature 589: n=a, g, c or t
aagtaccaggaatttacttgaccattccccttatttttcatctagaggaatctcggattcagccctttcattgctaagacaccttttcactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccacacagtcattgccttcaacacagagccacgtgtccccaaacagcaatagtcatgcccttgtccaggctgggatctaattgatacaataggtcgttgactccctcctarnagagctatctaggtttgtctggaaagtttccgaccctggcttataggca

SEQ ID NO: 10276 - DNA, 349 bp, Homo sapiens
  misc_feature 136: k=g or t
tttgaacatttttctaatgatttggagagaaaactatttacaaaaattccacatatcagtgatacaatttcttgctgtcaccaattttttataatagcagagtggcctgttctaagaaggccatattttttaagtkatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatggttacaac

SEQ ID NO: 10277 - DNA, 412 bp, Homo sapiens
agaaaggaaagttgatagtcctggtaaaaagcaacttgaatggaacattaagggtaaaagcaaaattatagttgaatgatttggaggagcaaataggccattcgtttctagtcttccttacaaaattgggtgcttctaacgcacagagaccgcgtcttacatacctttcactctgcagtgctgtgcttgacttgtatttatttgatattgtgtttctattcatatagctccaatcacttgtttattttagcttttgagcagccacttcacactgatgactattaaactttgaagtctttttcacatatatttttgttgagctttgtcatcctccaatcctatctttgtgtgatttgagtttgagaccctagtacattgccttaaatattcatattaaacatgttaaattcag

SEQ ID NO: 10278 - DNA, 251 bp, Homo sapiens
agagcagtatctcgtttctgaacacctggattgtagctttccctggactgactgtcaaaggaggtggttttaaaaagcaagccaaacaggtttccatcctttaggaagaccctggaacgtgccagttgattctgacaatttctcatgaacagaaacacctaggaagggagaactgatactgtacaggacaacctgcttttcatattctctgtgaatttcaaagacgactgggattttcttcctcctctaac

SEQ ID NO: 10279 - DNA, 189 bp, Homo sapiens
acaagcccatgaggaagctgagctggtttgtaatgatagggcggcagagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgcag

SEQ ID NO: 10280 - DNA, 289 bp, Homo sapiens
  misc_feature 93: y=c or t
  misc_feature 226: r=a or g
gacgacgtagcagccatcttttccctggctttggtgattcagccctgacttctcaaaaagcactgcacagaggaggaggcagcagaaccccayttcagcttcttaggactctgcacttccccagaaggaagaattaaaaatgaatatgttcaaggaagcagtgaccttcaaggacgtggctgtggccttcacggaggaggaattggggctgctgggccctgcccaraggaagctgtaccgagatgtgatggtggagaactttaggaacctgctgtcagtggggcatcca

SEQ ID NO: 10281 - DNA, 475 bp, Homo sapiens
  misc_feature 327: w=a or t
tagacgacgtagcagccatcttttccctggctttggtgattcagaaactcccgttctgtggcgaaattctgtgagtccatgaagctggattgtccctgacctcttttgaggaaggagagggttgcttctaactggtcctgggagatgccactgtgatgtatccgggatgaagacacaatcctggttacttcatagcctgtttttcttccccagccctgacttctcaaaaagcactgcacagaggaggaggcagcagaaccccacttcagcttcttaggactctgcacttccccagaaggaagaattaaaaatgaatatgttcaaggwagcagtgaccttcaaggacgtggctgtggccttcacggaggaggaattggggctgctgggccctgccagaggaagctgtaccgagatgtgatggtggagaactttaggaacctgctgtcagtggggcatccacccttcaaacaagatg

SEQ ID NO: 10282 - DNA, 497 bp, Homo sapiens
  misc_feature 106: r=a or g
  misc_feature 315: n=a, g, c or t
  misc_feature 316: n=a, g, c or t
ctccatctgtgttttttgaaaaaaggttaacatctagacatagttaactgagcatacatagctttccactcgtttttgctttaaaatacactcaaaaagcagaaarcctgcaggatgcttcttgggctcttgttgcggacgaataggctcggctattcttgttgctgaagaatagcctctgctggtgtggaggagggaagctgcccccggattagacagcaggatgacaaggcagaaaagacggtgtcacagctgtaccctgggatcggcagaaaagggtccccccggggcctgtaagggtgcctgcgtaacagnngacttgaatttcaagtgattatcatataaatggaggattagaaaagagacaccaactctggaaccagttcaatggaattcttcaagagactgtaacttagtgcttacaaagacttggaatgatctacactgcatggtgtacctgttagaggaggtgacatcaaagctttaggtactgaaag

SEQ ID NO: 10283 - DNA, 207 bp, Homo sapiens
acagtacctcacaggtctcttcccccgagcagtgcattgctggagcgaggagaagctcacgaatcagctgcaggtctctgttttgaaaaagcagagatacagaggcagaggaaaagggtggactcctatgtgacctgttcttagagcaagacaatcaccatctgaattccagaagccctgttcatggttggggatattttctcgact

SEQ ID NO: 10284 - DNA, 436 bp, Homo sapiens
  misc_feature 105: s=g or c
  misc_feature 410: m=a or c
  misc_feature 411: w=a or t
gttgccagaaggggcgggacctgcaacgtccgacagaacgaggggacgtaacggaggcaggttggagccgctgccgtcgccatgacccgcggtaaccagcgtgastcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagacttggtgtgagtgtgtctgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaaggmwtgcaaggggctgtcccccttctctt

SEQ ID NO: 10285 - DNA, 643 bp, Homo sapiens
  misc_feature 274: w=a or t
atgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcgtaaccagcgtgagctcgcccgccagaagaatatgawaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggtaccccttcccagtgttttttattcctgtggg

SEQ ID NO: 10286 - DNA, 583 bp, Homo sapiens
  misc_feature 274: w=a or t
  misc_feature 557: m=a or c
  misc_feature 558: w=a or t
atgacccgtgagcaccgagcccccttctccttgcccttttctttccgttcaccctaaacaccaccggcgaggcgccggctttgaccttccgtagcttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcgtaaccagcgtgagctcgcccgccagaagaatatgawaaagcagagcgactcggttaagggaaagcgccgagatgacgggctttctgctgccgcccgcaagcagagggactcggagatcatgcagcagaagcagaaaaaggcaaacgagaagacttggtgtgagtgtgtctgcatgtgagagaaatgcagaagcagtaattgggcgtcatgggggaggcacagaggaggagagggaagtctgggtagtgtgcaatgtgcaaggaatgcagcatttagtgtgcaatgggggcagcttcaggacagagtcagtgggaaaggmwtgcaaggggctgtcccccttctctt

SEQ ID NO: 10287 - DNA, 251 bp, Homo sapiens
cctagtaaaagacagtcactgattcctagtcatctttgaggaaaaaaaaagatgttgataaagtgatacagatggaattcaaaatcagtttttttaagaaggcatggaaaagcaatttcctgaaaactattgtaactacaaaaaaagtgaataccctttccctgcgtctgcctggtatcctgtgcatatctctatcataatgtttattacataacatatttatcagtttgactcatctgtcccctcccccc

SEQ ID NO: 10288 - DNA, 367 bp, Homo sapiens
ggactcctgacctcaagcgatcctcttgcttggcctcccaaagtgttgggattacaggcgtgagcaccgcacctggccggggacttgtttctaatggaaaattgtgtatgtgctgtattgttaagagcattggtttggggtcagactaggctgtgattcgggtctctccacttcttattatcgtctttggtaaattatttaacctctttgtgccttcgttttctgtaaaaagcagataattatagctacttcatgaggtcgtgtgaagatttaatgagatagtgtgtgtgaaatgttcacagctaccagacacatactcactcgtgttcccaattgctatactcacaagggctcactcccatcgcca

SEQ ID NO: 10289 - DNA, 216 bp, Homo sapiens
  misc_feature 4: y=c or t
cttytttagactgccacgaggaaaaagcagatgtgagaactcaaggttcagggctgctcttctaagaaacaagtctgccataatctccatctgtgttggaatctgttaactaatgaactggtctctgtgcaaatcctgagtgctaaagcttccaacaagactgatgctagctcgtgtcaccaggaagatgctacgtcatgccaagtgttttcagcg

SEQ ID NO: 10290 - DNA, 417 bp, Homo sapiens
  misc_feature 6: n=a, g, c or t
  misc_feature 200: m=a or c
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttmaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgg

SEQ ID NO: 10291 - DNA, 267 bp, Homo sapiens
  misc_feature 6: n=a, g, c or t
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgatcatgtcgtcgccaagtcccgcttctggtctactgtgggcaggtgtttgagaagtcccccctgcgggtgaagaacttcgggatctggctgcgctatgactcccggagcggcaccgcgcccgagcccact

SEQ ID NO: 10292 - DNA, 316 bp, Homo sapiens
ataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcggacgg

SEQ ID NO: 10293 - DNA, 488 bp, Homo sapiens
  misc_feature 6: n=a, g, c or t
  misc_feature 271: m=a or c
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgcgaatctttgcgcctaatcatgtcgtcgccaagtcccgcttctggtactttgtatctcagttmaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgg

SEQ ID NO: 10294 - DNA, 612 bp, Homo sapiens
  misc_feature 6: n=a, g, c or t
  misc_feature 547: y=c or t
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatctggctgcgctatgactcccggagcggcacccacaacatgtaccgggaataccgggacctgaccaccgcagcgctgtcacccagtgctaccgagacatgggtgcccggcaccgcgcccgagcccactccattcagatcatgaaggtggaggagatcgcggccagcaagtgccgccggccggctgtcaagyagttccacgactccaagatcaagttcccgctgccccaccgggtcctgcgccgtcagcacaagcca

SEQ ID NO: 10295 - DNA, 361 bp, Homo sapiens
  misc_feature 6: n=a, g, c or t
  misc_feature 12: h=a or c or t
  misc_feature 296: y=c or t
agaggncactthcttttgcgggtggcggcgaacgcggagagcacgccatgaaggcctcgggcacggtgtttgagaagtcccccctgcgggtgaagaacttcgggatctggctgcgctatgactcccggagcggcacccacaacatgtaccgggaataccgggacctgaccaccgcagcgctgtcacccagtgctaccgagacatgggtgcccggcaccgcgcccgagcccactccattcagatcatgaaggtggaggagatcgcggccagcaagtgccgccggccggctgtcaagyagttccacgactccaagatcaagttcccgctgccccaccgggtcctgcgccgtcagcacaagcca

SEQ ID NO: 10296 - DNA, 338 bp, Homo sapiens
  misc_feature 6: n=a, g, c or t
agaggncacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgctgcctgcccacccccaaatgccacacgccgcccctctaccgcatgatcatgtcgtcgccaagtcccgcttctggtctactgtgggcaggtgtttgagaagtcccccctgcgggtgaagaacttcgggatctggctgcgctatgactcccggagcggcaccgcgcccgagcccact

SEQ ID NO: 10297 - DNA, 335 bp, Homo sapiens
gaatccacttgccggaagtgcctttccagtggacctgggctgttgttgcggttgttttccttctctccgtgcaagctggcaagtctcaaagtcgccacagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgaca

SEQ ID NO: 10298 - DNA, 160 bp, Homo sapiens
  misc_feature 41: s=g or c
gcctgtaactcacatccgaggctgggcgaggaatccggagsggagattttcctcatgctcacggttgttggaaactggaagagtgagaggaaggaggatggggtctgcctcctgagtagctgggactacaggcccgtgcctctgcgcccagctaattttt

SEQ ID NO: 10299 - DNA, 255 bp, Homo sapiens
gagggatgaatagtgggagtatctatttgaatttagatggttaattgagaagccaaccatttttgttcatcttgttttacattgttgatttttgttttccaacaactctgggtgtcggttgctggtactctagtcatcttgctttgttctcaacttttttggacccaagaccttatttctgaagaatgctctatgaattattttttaaaaagcattctgtcattttgggtctataaaagataacgtgaataagat

SEQ ID NO: 10300 - DNA, 122 bp, Homo sapiens
catctcaaaaagcattcttgtaattaatcatggccattctatatcttcctaccaggtaatagtaacttgcatagaactccctaaaattatacacacacacacacacacacacacacacacac

SEQ ID NO: 10301 - DNA, 255 bp, Homo sapiens
gagtaacaataaagaaaaaaaaatacaaaggaagaaaagaaagaaaaacaagtgttcagggcataacaacagtgattctgaagagaaggacaagtctaagaagagaaagcttcatgaagaactttctagcagtcaccataaccgggaaaaagccaaggaaaagcccaggttcttaaaacacgagagttctagggaggacagcaaatggagccattctgattctgacaaaaagtccagaacccataaacatagccc

SEQ ID NO: 10302 - DNA, 201 bp, Homo sapiens
  misc_feature 31: r=a or g
  misc_feature 63: s=g or c
aggctcggcagaaataggagcgcgcaggcgracgtgcggctcgcagaacggcgagtagcggasgtgacccgctggaatcatcatccagggacgtgccagaaaccacaagaaaacatggggagggttttcctcacgggagaaaaagccaattccatattaaaacgctacccaagagctaatgggttttttgaagaaataaga

SEQ ID NO: 10303 - DNA, 294 bp, Homo sapiens
gatttggctccaagagctattcgcagagaaacagcctcgcacaaaaagccaccgcccccgaaacccgcgggaaatctgtttcctgtgaaaggcctggcctccgggcattggcggtttccctgatcctctctcccaaattttccggcaggggattgatcgaggcgacatttaggactggggtgggcgagggagtggcggttctcgtcccaagttacaggtgaggacgttcaggccaaggcgtagcaagatcgcgccgccctgtagcttgaggaggcgccgggattcgaaccaagg

SEQ ID NO: 10304 - DNA, 575 bp, Homo sapiens
  misc_feature 440: r=a or g
  misc_feature 445: k=g or t
  misc_feature 449: r=a or g
attggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcraacckccartgcatgtacagaaacctgtgatatttatacccttgtaggaaggtatagacaatggaattgtgagtagcttaatctctatgtttctctccattttcattcctcctgcactattttccttgatgttgt

SEQ ID NO: 10305 - DNA, 312 bp, Homo sapiens
  misc_feature 203: m=a or c
  misc_feature 291: m=a or c
  misc_feature 292: m=a or c
atatctggcttgtccgcgcgatttccggcctctcggctttcggctcggaggaggccaaggtgcaacttccttcggtcgtcccgaatccgggttcatccgacaccagccgcctccaccatgccgccgaagttcgaccccaacgagatcaaagtcggtgcgtgctctggttgtggccggggctgcgggatggagcatccctcggmcccgccgcgcgtgcaaagctttccccgtatggggctcttaaagccgctgcctcccagagaccttcccggtgttgcgccgcccccggcmmagcctcagcctttctgggcc

SEQ ID NO: 10306 - DNA, 70 bp, Homo sapiens
accctgctttctgcattcttctctccacatccctctctgtacttacagcccccaatggcccccagctttt

SEQ ID NO: 10307 - DNA, 571 bp, Homo sapiens
  misc_feature 501: y=c or t
cattaattgacaagaatgctgctcaagttggctgatcaagagataggcagtgcaaaggaacaggatttgagacagcccagggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccytcaaaaaggaaccattgtgttaaaggaaggttctgaatatagagtcaaaattcacttcaaagtgaacagg

SEQ ID NO: 10308 - DNA, 404 bp, Homo sapiens
cttgcaaagcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaag

SEQ ID NO: 10309 - DNA, 365 bp, Homo sapiens
  misc_feature 268: k=g or t
cttgcaaagcccctcattttggcagaacttaccatgtcgaccagccgcaaattaaagagtcatggcatgaggaggagcaagagccgatctcctcacaagggagtcaagagaggtggcagcaaaagaaaataccccaatcgcaattaccgctcccacttgtgagcccccagcgggctctgccctggtgcgcttcacacagcaccaagcagcaacaagaacagcagaaggggaactgccaaggagacctgatgttagatcaaagccagakaggagcctatggaatgtggatcaaatgccagttgtgacgaaatgaggaatgtatatgttggctgtttttccccaacatctcaataaaactttgaaag

SEQ ID NO: 10310 - DNA, 154 bp, Homo sapiens
  misc_feature 5: r=a or g
agcaraaagccgcgcacctcctcccgccaggcgctttctcggacgccttgcccagcgggcgcccgaacccccgctcgctctcttcactcctgttttaaacttcatcgaaagcacttgtggatttgctacagacagttgggacagaccaggcggg

SEQ ID NO: 10311 - DNA, 146 bp, Homo sapiens
  misc_feature 10: w=a or t
  misc_feature 145: n=a, g, c or t
tgaactaaawatatttaacttcataaatatgttactacagcttccagatttaaagaaaaaaagtttcccccactctcaattaaaagttagaaccctccacttttaaaattatacaaatatttcttttttacattacacagaagcnt

SEQ ID NO: 10312 - DNA, 139 bp, Homo sapiens
acttatgatccgtttgagaatccatcagggatccttgtgagtccccgacctgcagttctagattcatcatttgaaaaagcctctggccctggatgcatttcctgttttcaggattcctcgccttctgactgctctccca

SEQ ID NO: 10313 - DNA, 238 bp, Homo sapiens
tgatcttactttcataattctttgattctagcttgcagagtcaagacgaactctaactcatgggatggacaaactggaagatgtaaaataagtaaggctttctgggccaaaaagcctcttcttacagaaaatcaaattttaaaagaacattgacctcaaaacaataaaactgtcctggttatgcaatagaaatagctatataaatggaatcatatccttaatgaacacctcctgtggc

SEQ ID NO: 10314 - DNA, 381 bp, Homo sapiens
  misc_feature 120: n=a, g, c or t
aaaaaagcctgccgggagcttggtgcgctatggcgacacccagcctgcggggtcgtctggcgcggtttgggaacccgcggaagcctgtgctgaagcccaataaacctctcattctagctnaaccgcgtcggggagcggcgccgggagaagggcgaggcgacttgcatcacggagatgtcggtgatgatggcttgctggaagcagaatgaattccgcgacgatgcgtgcagaaaagagatccagggcttcctcgattgtgccgcgagggctcaggaagcccgaaagatgagatcaatacaggaaaccctgggagagtctgggagtttacttccaaataaattgaataagttgttacagaggtttcctaacaaaccttacctc

SEQ ID NO: 10315 - DNA, 614 bp, Homo sapiens
  misc_feature 148: s=g or c
  misc_feature 279: s=g or c
  misc_feature 442: s=g or c
agatctttcctggacagtgcgtctcagcagttcagatccgggggcccccagctgacagagggcgtggggggttaaggcattaacccctcccagcctcttcctgaagaaaccacccagccttggcgcggcgctgggtgacttcgcgtasaaggcagggaactggccgcggcgagcgggactggccattggagtgctccgctgcggagggaggggaccccgactcgagtaagtttgcgagagcactacgcagtcagtcgggggcagcagcaagatgcgaasgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctascgttcgtctggagtagcgccaccccggcttcctggggacacagggttggcaccatggggcccaccagcgtcccgctgtcaaggcccaccgcagctcggtctctgactacgtcaactatgatatcatcgtccggcattacaactacacgggaaagctgaatatcagcgcggac

SEQ ID NO: 10316 - DNA, 447 bp, Homo sapiens
gagtttgggggtagcggtgagctggtaaaaagcctgttggcaacgaagactgatactttgaaaatgctcgtttttatttttcccgtcttttagaatcctctttgccaagagtatgtacaaagtacttagaacagctggcatctaacaaagactagctgtgtcagcgtgttatgatgccgtcccgtaccaacctggctactggaatccccagtagtaaagtgaaatattcaaggctctccagcacagacgatggctacattgaccttcaggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactagcc

SEQ ID NO: 10317 - DNA, 432 bp, Homo sapiens
  misc_feature 304: s=g or c
acttaagcgggccatgccatgcaaccttgggcgctgccaaccgtgggcgagctctgggtgtgcgggcggcctggcgcggcgctccggtaaggcgtgtgtgcggcagggcggggacagaaccgtcctctcgggctctgggcgtgtccgagaccgcgctccccgccgaaatcaagctccgagtcatccgtgtggggcattcgtcccccctggcacagttggcctctttccagaagcccgttttgtttgttttacgtctaaattcgcgtcggttcttatttctctccctggcaaggtctgaagacgsctgtgtcagcgtgttatgatgccgtcccgtaccaacctggctactggaatccccagtagtaaagtgaaatattcaaggctctccagcacagacgatggctacattgaccttcagtttaagaaaacccc

SEQ ID NO: 10318 - DNA, 241 bp, Homo sapiens
aaacaatggcaaccaggacatactcatcccacttagttgagagaagagatttctagtttgggttacagttgcccaaccttccctttaaagagaatccagtcatgttttcaatggtaaaaagccttaaaaagctgcccttcgaagatctcctatgactgcatgtcaaggtattttgtacctacaatcccagaacttggttccttccccatgaggactaacaaatgttcacaacaatcacgat

SEQ ID NO: 10319 - DNA, 225 bp, Homo sapiens
  misc_feature 120: s=g or c
aaaaagcgactataaacgccggcgcctccgtccccagccgcggctcgggaatccacccgaagagtggctataaacgtccgcgcctccattgcgctctcctcttcacttaggtaggtcctsccgcgttgaccactggcgtctcgctggtggtcttcgagaccggcgttggttgaaaatcgcccccggctttggccgtggccgcgggtgagattcggcgcccagagc

SEQ ID NO: 10320 - DNA, 430 bp, Homo sapiens
  misc_feature 134: y=c or t
  misc_feature 137: m=a or c
tattcctattactaatgatgtaagtacgaggataaatccaagaaactttcaactctttgcctttcctggcctttactggatcccaaaagcatttaaggtacatgttccaaaaactttgaaaagctaaatgtttyccmatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcag

SEQ ID NO: 10321 - DNA, 301 bp, Homo sapiens
  misc_feature 123: v=a or c or g
gcctgcgccgccttccggcccgagttctggagactcaacatgaagctaccggccagggttttctttactctggggtcccggctgccctgtggcctcgctcctcggaggtctgaaaaatgagtvaagatggaagccaaagtatcacttttattgtggtttgtgagaggaagctgggcccatcagctggatctcccgaagtaggcggacttacataactctggaggagggcagaacattgtcctctgaaggcagctggctcccaaaaggaagaagaccaaggagaactgttcatacccaacga

SEQ ID NO: 10322 - DNA, 278 bp, Homo sapiens
gtgggggggtattatatgttttacatatatatgaaacaattttttatccactcattaattgatgggcatttgggctcattccatatttttacaattgcgaattgtgctgctataaacatgcgtatgccaaagaggtgctgaaaaaatatttggagtccaaggaggatgtggctgatgcacttctacagactgatcagtcactctcagaaaaggaaaaagcgattgaagtggaacgtataaaggctgaatctgcagaagctgcaaagaaaatgttggag

SEQ ID NO: 10323 - DNA, 253 bp, Homo sapiens
aacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcggg

SEQ ID NO: 10324 - DNA, 398 bp, Homo sapiens
agtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagcacatgtggacattgcagtgcagtgagctgtaatcatgacactgcactccagcctgggctacatagtgagaccctgtctcaaaaaa

SEQ ID NO: 10325 - DNA, 179 bp, Homo sapiens
  misc_feature 103: n=a, g, c or t
  misc_feature 106: w=a or t
  misc_feature 167: w=a or t
agtagctctctcgagtcactccggcgcagtgttgggactgtctgggtatcggaaagcaagcctacgttgctcactattacgtataatccttttcttttcaagntawggctgagatctccgctaggcttctttccctttagtgctgtattcgtgttgtttttgttttwttctgtccttta

SEQ ID NO: 10326 - DNA, 198 bp, Homo sapiens
aaaaagcgctcaccctggctcctgcagctgcccttctgtgtgctccccctcccataaggggtttgagcatggtggccgaacagatgagccacacccattgcacatcctgcgaggggggtcagagaactctcccattccaattttaaaattttacatacatgcagcaacagtataatgtatgcctagacctacatcggg

SEQ ID NO: 10327 - DNA, 469 bp, Homo sapiens
agagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtagcacgaagtgccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctc

SEQ ID NO: 10328 - DNA, 587 bp, Homo sapiens
gccctttccgtagatatctctagaaagccgcgccggagcccaaaaacaaggactgcgcacgcgcggcggcaaggcccgggcattttgctgcgtcaccagccgccgcccggcctcaccacccctcgtttgcacgcacgcacgttcattctccgtcctcgcgccccttttcctacactttcctcttctccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaatgaaattgatctttttcactgtattgatccaaatgattcc

SEQ ID NO: 10329 - DNA, 145 bp, Homo sapiens
catcagtgtcccctcttattcttattactgatctctccctttgcctttctccacacttgtataatatgatgacctctctccctcatccacaagttgccaagaacttccttaaaaagctaaatctcagttttccatattccaccct

SEQ ID NO: 10330 - DNA, 205 bp, Homo sapiens
aagaggggaaaataacaaacctgttttatgaaaattcactggtgctgtttacattggaataaaaagctctataaggaggacgaatcaagaattagaagggaatagttttctgaaatgcatcacgggtaaagaattggaatactccagctccttttttggaacatagattgaaaatcattaccttagatggttttatttctgtggg

SEQ ID NO: 10331 - DNA, 136 bp, Homo sapiens
aaggtgctgtctttgtggcaaggcctaggcatgacaatcggaggactcgagggggatggaggactagtgatcggctggctgcttccagtcgattagagaggtgaaaaagctgaacgtgtgccagtaatcttcaaaa

SEQ ID NO: 10332 - DNA, 220 bp, Homo sapiens
caagaaaaagctgatttatacatccatgtgacatacatcaaaaagtgggatatatgtgctggtaatgccatcttaaaagccctaggggggcatatgactaccctgagtggtgaaggaatcagttactggttcagacggcattgaagggggactccttgctagcatcagaatgaaccaccaggccctggtcagaaaactcccagatctagaaaagacagga

SEQ ID NO: 10333 - DNA, 298 bp, Homo sapiens
gctctcacccgagagagatattcagctggatccaaagtgactgatgaagggaaggaaatcatgtcaagcgaaccttgaaaaagctgccctgagacggtgtcccgccgaaaggtaattttcacgaaaagtgtctctgagtcacaaagttcatgggactttgtgactcggaaaagagatgattctttagtgtttttcactcttctccaagttgccctaaaccctccttttctcatatcgaagcggttaataattgaggggctaaataatcgaactgcaccccaccgcgtcccttctcccc

SEQ ID NO: 10334 - DNA, 291 bp, Homo sapiens
gcggaggggaaatgcgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccct

SEQ ID NO: 10335 - DNA, 499 bp, Homo sapiens
  misc_feature 19: k=g or t
  misc_feature 384: m=a or c
  misc_feature 387: r=a or g
  misc_feature 460: k=g or t
  misc_feature 492: w=a or t
gaggatgtggcgcgcggakgggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacmgaraccaaccaacatgttttttgatctgtctctgatctgcttggcttgcattgaaagatacacaatgtgcacgttkgacttaactaaagtagcatgagttctgtctgwgtttctt

SEQ ID NO: 10336 - DNA, 253 bp, Homo sapiens
actaaacttccgggcgcggaggtttgcgcgccttggtgagccgttggcgtggtggtcccggagtgatcctggcagccggtggggaagacaaggagggtttgagcatggcagaaggaaacaccctgatatcagtggattatgaaatttttgggaaggtgcaaggggtgtttttccgtaagcatactcaggctgagggtaaaaagctgggattggtaggctgggtccagaacactgaccggggcacagtgcaagg

SEQ ID NO: 10337 - DNA, 172 bp, Homo sapiens
  misc_feature 11: n=a, g, c or t
ggagcagcggnggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagg

SEQ ID NO: 10338 - DNA, 329 bp, Homo sapiens
agagatgctgtaatggtgagactttggatccttcctgaggacgtggagaaaacttgctgctgagaaggacattttgaaggttttgttggctgaaaaagctgtttctggaatcaccccgcgggaggggccatcctactgcagtctaactttgtcttaacttattacatctgcaatgaccttatttccacataaggtcacattctgaagtactaggggttagaacttcaacatataaattggtggggggtgcatagtaagcaccatggtcactcttctccataggttaggggttctagactcttctccaatcagtttttcctctgtctgca

SEQ ID NO: 10339 - DNA, 155 bp, Homo sapiens
taaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaa

SEQ ID NO: 10340 - DNA, 636 bp, Homo sapiens
  misc_feature 7: n=a, g, c or t
  misc_feature 8: y=c or t
  misc_feature 30: n=a, g, c or t
  misc_feature 31: n=a, g, c or t
  misc_feature 565: r=a or g
attttcnyaatcatcgcattttcaaattanncactcatcactacacttgcattcaacatatataatttatcacataaaagcaaaatctctaagcttctccctaccttaggtttttagtcaaaatgaatgcaaacaatcacgtgggattcagccaagcagtgacgttaaattctgctctgtcagagagagcatctgtcaagcccacatttaaactgctgcctgcctgtgcagcagctgaggaaccgtggatttcatattatagactaaaaccccattaaaactgctcaaaatccttcctgcagctgccaggcaacaacgaaagaagagaggtaaatcctattcttttccaatacaactgaagcactacattttagctctggctgctttacattgcagctcagtgttattagtagaaatatggatactgagacgagaacacagcactgcattgtccagccaggaaaatagcagatgtaaaaagcttcaatgcatcaactgtcgggaagagtcaacagtgctacaagcagaacgggcaactacagctcttttgtttaacgaaagagaraaatgaaagaaagggaaaatttcagaagactaggacccatatgaacaaggagggtaactcgaagacaagca

SEQ ID NO: 10341 - DNA, 209 bp, Homo sapiens
aaaaacagtctccttccacaaaaccatggcgtcgctcaaatgtagcaccgtcgtctgcgtgatctgcttggagaagcccaaataccgctgtccagcctgccgcgtgccctaaacagtgcaaccctgaaactcgtcctgttgagaaaaaaataagatcagctcttcctaccaaaaccgtaaagcctgtggaaaacaaagatgatgatgac

SEQ ID NO: 10342 - DNA, 343 bp, Homo sapiens
  misc_feature 55: n=a, g, c or t
ggggttccagtgggtatacagttccaacagtgtgcagggaccattctcagttganattataaaccaaggttcacagtcctgaagtttgctgtagtgtggatgtcaaagacagtctttctctgatattctcagaagatttggtctttgggttctagattgtaagaggttgactgtcctcagtgaaccataaaaagctttctttttctgctgaaaatacactgtagcataataatttacttttataacatcagccctcttccatgggaaagcttttatacaatcagaaaacatgcgttgaaaatgacaattgaataaaatcccttcataaaatgtttaaacggcc

SEQ ID NO: 10343 - DNA, 210 bp, Homo sapiens
aaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtaagtttttaaaaaatgaga

SEQ ID NO: 10344 - DNA, 245 bp, Homo sapiens
cttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatag

SEQ ID NO: 10345 - DNA, 318 bp, Homo sapiens
attgttgagaggagctatgttactgcactgatatgcccgccagccttacaattttaattattttcaacttattcttggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgactggggtgagaagggttactactacttgcatcgcgggtccggggcctgtggcgtgaacaccatggccagctcggcggtggtggactgaaga

SEQ ID NO: 10346 - DNA, 330 bp, Homo sapiens
  misc_feature 67: k=g or t
  misc_feature 112: m=a or c
  misc_feature 121: m=a or c
  misc_feature 235: k=g or t
tcttccttaaaaaggaaatacagtgatttgagctagatgaatccagctacattttactttttttttkgagaccgagtctcattctgttgcccagggtggaatgcagtggtgmaatctcggmttactgcaatctccacctcctggggtcaagtgattcttgtgcctcccaggtagctggggactataggcaccaccacacccggctaatttttggtgttttttgtttgtttgtttkgtatttttagtagagacggggtttcaccatgttggccgggctggctgcaaactcctgacctcaggtgatcagcccgcctcagcctcccaaagtgc

SEQ ID NO: 10347 - DNA, 471 bp, Homo sapiens
  misc_feature 141: r=a or g
  misc_feature 307: m=a or c
  misc_feature 308: r=a or g
  misc_feature 331: r=a or g
  misc_feature 339: n=a, g, c or t
  misc_feature 340: n=a, g, c or t
  misc_feature 341: s=g or c
  misc_feature 344: k=g or t
tactgctttatacccttggagcttcatgatcacaggatggctgttatagctccagccatcatgaccaagttcagactccaggaacaagatggaggaagctatgtcaaggggggcttttcttgatgtgtctctcgcctttarccagtgaagaaaatcttcttagaaggacacagcagacttctccttatgtctcattatgcagaagtggaccacaggacagtccctactgtaaactctttcaagtatcaggcaaaaaggaacaaaaggccccagcctggcttaaaccaaccttgagtcatcacctgamrctggacacttgtttatccaagcraaatcagnnsttktctgttagcagcaaagaaactgctcatgggtaagaaattaacagtgtgtgccataattcatatttgtcgccaagcatcttctcaggctgacactgtgccaaacaagggattgtagagatgaagatgc

SEQ ID NO: 10348 - DNA, 291 bp, Homo sapiens
aacaaaaccatggcgtcgctcaaatgtagcaccgtcgtctgcgtgatctgcttggagaagcccaaataccgctgtccagcctgccgcgtgccctactgctcggtagtctgcttccggaagcacaaagaacagtgcaaccctgaaactcgtcctgttgagaaaaaaaataagatcagctcttcctaccaaaaccgtaaagcctaaggacttgtgacatcatagattagttttgcctacttctgtactttatttttgtacttatttttgtttctagctgtttttttgttttgg

SEQ ID NO: 10349 - DNA, 415 bp, Homo sapiens
  misc_feature 358: r=a or g
aagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcgaactgcttgtcttgaggaggtcrcccagaatcagctcttgtggccttgaagtggctgaagacgatcaccctccacaggtt

SEQ ID NO: 10350 - DNA, 488 bp, Homo sapiens
  misc_feature 99: s=g or c
gtttttgtgctcccagctctagcgaaaagccgccggtatttctccatctggctctcctctacctccaggcaggctcacccgagatccccgccccgaacsccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagatccacctgagacctgaggacgccttattcttctt

SEQ ID NO: 10351 - DNA, 246 bp, Homo sapiens
gtttttgtgctcccagctctagcgaaaagccgccggtatttctccatctggctctcctctacctccaggcaggctcacccgagatccccgccccgaaccccccctgctttgggggttaaggagaagtgtttatgtgggtttaagataatacagctgttaaggaagtggtctcttgttttaatgaagcaggcccttggaggggccacaaaggacatggggaagatgctggggggagaggaggagaag

SEQ ID NO: 10352 - DNA, 461 bp, Homo sapiens
  misc_feature 38: n=a, g, c or t
gagggcgccttcggcagccgcccgcggcagaagccggnctccagctcgcctggcggaattgcacgcggcggcgggagctggaatagcagaaggaaccacctcgtggagtcgggccggagccctgcagtggctcagacggttgcagggaccgccaggttgtcacatcttcccaagccaggccagccaggagcgctgcatgcaaattctgccgtgggctaaggcacgctaaccagagccggcggcatggacttcgtcatgaagcaggcccttggaggggccacaaaggacatggggaagatgctggggggagaggaggagaaggaccccgacgcgcagaaaaaggaggaggagcggcaggaggcgctgcggcagcaggaggaggagcgtaaggccaagcacgcgcgcatggaggcggacgggagaaggtccggcagcagatccgagataagtatgggctgaag

SEQ ID NO: 10353 - DNA, 519 bp, Homo sapiens
  misc_feature 131: k=g or t
  misc_feature 133: w=a or t
  misc_feature 140: y=c or t
  misc_feature 452: r=a or g
  misc_feature 453: m=a or c
ctctttccggtgtggtagcctagtacaggttgttttttaaaaaaaggaaaagcaggaaggaggagtgaattttattaacatgtttgccaaatgtattgagatttggcctctgaagaacactttttcagtgktwaagtttyctttaccttaagattcagaaatactttagaatattattaattttaagtcctgtctttacatccttttggaaaacttgtattaccatgagtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacrmagcttccattgagaagtctttctgtgtcgtgaatagcattttaatgacctcttggctcacataagc

SEQ ID NO: 10354 - DNA, 448 bp, Homo sapiens
  misc_feature 54: s=g or c
aacgctgccgaagaaaaaaggctcgggagtccagccccaagggagctggaacascctcacacacagcaggggcctgagaagttagcgggaaacgccatctacaccaagccttcgttcagccaagagcataaggcagcagtctctgtgctgacacccttctccaagggcgcgccttctacctccagccctgcaaaagccctaccacaggtgagagacagattgaaagacaacacacactatttccattttagaaagtgcaaaggctagagttacaaatatgaaggcttctaaaccaatttcacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaaga

SEQ ID NO: 10355 - DNA, 473 bp, Homo sapiens
  misc_feature 148: n=a, g, c or t
  misc_feature 154: w=a or t
  misc_feature 351: m=a or c
acagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttnaaaggwgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgmtttccaatgacaaccttaaggtctcttgacaggaatctgccctcagacagccaggacttgggtcaacatggattagaagaggattttatgttataaaagaggattttcccaccttgacacca

SEQ ID NO: 10356 - DNA, 457 bp, Homo sapiens
  misc_feature 30: k=g or t
  misc_feature 143: s=g or c
  misc_feature 407: s=g or c
ggtagttcggattacttctttaagtctctkttctcttttttcgcgcaaaaatgccggatccagcgaaatccgctcctgctcccaagaagggctccaaaaaggctgttacgaaagtgcagaagaaggacggcaagaagcgcaasgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcacaaggcggtcascaagtacaccagctcgaagtaagagtgtgcaagggacgcaatagatcaac

SEQ ID NO: 10357 - DNA, 470 bp, Homo sapiens
  misc_feature 150: s=g or c
  misc_feature 430: n=a, g, c or t
attacttcccgttttctcgatctgctgctcgtctcaggctcgtagttcgccttcaacatgccggaaccagcgaagtccgctcccgcgcccaagaagggctcgaagaaagccgtgactaaggcgcagaagaaggacggcaagaagcgcaasgcagccgcaaggagagctactccgtatacgtgtacaaggtgctgaagcaggtccaccccgacaccggcatctcctctaaggccatgggaatcatgaactccttcgtcaacgacatcttcgaacgcatcgcgggtgaggcttcccgcctggcgcattacaacaagcgctcgaccatcacctccagggagatccagacggccgtgcgcctgctgctgcccggggagttggccaagcacgccgtgtccgagggcaaggccgtcaccaagtacaccagcgctangtaaacttgccaaggagggactttctctggaatttcctga

SEQ ID NO: 10358 - DNA, 470 bp, Homo sapiens
  misc_feature 164: s=g or c
  misc_feature 166: n=a, g, c or t
  misc_feature 208: r=a or g
  misc_feature 211: r=a or g
  misc_feature 238: m=a or c
  misc_feature 241: y=c or t
  misc_feature 244: r=a or g
  misc_feature 253: s=g or c
  misc_feature 262: y=c or t
  misc_feature 268: y=c or t
  misc_feature 277: y=c or t
  misc_feature 295: y=c or t
aaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaastnagccgcaaggagagctattccgtgtacgtgtacaaggtgctraarcaggtccaccccgacaccggcatctcmtcyaargccatgggsatcatgaaytccttygtcaacgayatcttcgagcgcatcgcyggcgaggcttcccgcctggcgcattacaacaaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgc

SEQ ID NO: 10359 - DNA, 444 bp, Homo sapiens
  misc_feature 214: s=g or c
cgggtccttgcggccactgcggccactgaagcggcggcggcggctggcccaggaggaagaagtcgagcccaagctatttccggttccggtgtcagttcgaggcgccgccgccgccgccgcagccgccggagccgcaatgcctaaaggaggaagaaagggaggccacaaaggccgggcgaggcagtatacaagccctgaggagatcgacgcgcastgcaggctgagaagcagaaggccagggaagaagaggagcaaaaagaaggtggagatggggctgcaggtgaccccaaaaaggagaagaaatctctagactcagatgagagtgaggatgaagaagatgactaccagcaaaagcgcaaaggcgttgaagggctcatcgacatcgagaaccccaaccgggtggcacagacaaccaaaaaggtcacacaactggatctggacggg

SEQ ID NO: 10360 - DNA, 352 bp, Homo sapiens
  misc_feature 154: k=g or t
tttgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcakaccaaccagacccagatgccattaagatgtttgcggacagatcccccggtcatggtcggaaaaggagctgaaagaacttttgagccttacggagccgtctaccagatcaacgtcctccgggaccggagtcagaaccctccgcagagtaaaggttgttgtttcgtaacattttatacaagaaaagctgcacttgaggcc

SEQ ID NO: 10361 - DNA, 260 bp, Homo sapiens
ccattatatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggg

SEQ ID NO: 10362 - DNA, 347 bp, Homo sapiens
gggtgaagaaggggccggccttcaagcaacagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagagtaagcgtcgagctacggctataaatgtcaatgtcttaaattcactgtgcctccttttaaaaaatattagccttatcacggaaaaaaagctcaccaatggtatattttctgaaatgtggctattcttttttgacc

SEQ ID NO: 10363 - DNA, 378 bp, Homo sapiens
  misc_feature 171: r=a or g
  misc_feature 278: m=a or c
  misc_feature 281: s=g or c
  misc_feature 313: y=c or t
  misc_feature 351: s=g or c
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccrgatcactggcaagtggttttatatcgcatcggcctttcgaaacgaggagtacaataagtcggttcaggagatccaagcaaccttcttttacttcacccccaacaagmcasaggacacgatctttctcagagagtaccagacycgacaggaccagtgcatctataacaccacctacccggsatcctcgttaaccctaacaaaaaaaac

SEQ ID NO: 10364 - DNA, 453 bp, Homo sapiens
  misc_feature 382: s=g or c
gacttgcttcctctttgccttccaccatgattgtaagtttcctgaggcctcccagccatgcttcctctgaagcctgcggaacttcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccaacttgctcccctttaataaaacttttaagaagtcacattattggaaaacttaacttcaacatttggscgtgactcaagctcttctgaagttctctgagatgactgaatatgaaccaaagctgcactgtgctgtacttt

SEQ ID NO: 10365 - DNA, 212 bp, Homo sapiens
tatgtgggcaataatgtcaaatgtgctatgcagccaggttaacattttagataaacttgattgacttttaatataaactgttacaatgcacactgattgtatataaaaacgttatatatgacaaattaaatttaagaaaaaaggatatgtgggctcctgtaattttctgctgcattcttactccctcaagcacttaccaccaccaccaccgc

SEQ ID NO: 10366 - DNA, 282 bp, Homo sapiens
  misc_feature 10: n=a, g, c or t
  misc_feature 117: m=a or c
  misc_feature 121: w=a or t
  misc_feature 223: n=a, g, c or t
aggtagtctntctcgcgagaaagggaggggtcgcaggcccaggcgctcggagcgttaccagggaaacaggtctcggttttgcggctcccactcagctgcgggagaaagctaagcagmaaawttcagaccaggctctgaacccgcagtaaaaaatgtctgaggataaaaaggatgaaggcagtgggacaagtacttcagtaaggaaagcaagcaaagagacttnctgtaagcggcaaagcaaagacagtgcctgggatccctcacaaacaatgaagaaaccaa

SEQ ID NO: 10367 - DNA, 237 bp, Homo sapiens
aggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagccgccgccacagcagcctccgccaccacagccaccaccccagcagccaccgccaccac

SEQ ID NO: 10368 - DNA, 336 bp, Homo sapiens
ctcctccctctaatgcctgtaactcacatccgaggctgggcgaggaatccggaggggagattttcctcatgctcacggttgttggaaactggaagagtgagaggaaggaggaaggggatttgtggcgctctctacctactacaagactgacaaggggagggggcacctaaatttgcatcttttcttcgtggtgattgagaactgcaggttcaaaccgatcccactgagcactggcgattgattataaaaaaaaatcgacactgggagaagggaggctctgtcttcggctgtcagactcaatctcggaggtggtattggtgtgtgagtgtgtgtggc

SEQ ID NO: 10369 - DNA, 385 bp, Homo sapiens
  misc_feature 307: n=a, g, c or t
atcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcaggacagaaacagttggggtggattttcggaaaagacatatgaatggagctcagaagaggaggagccggtgaaaaaggcaggaccagtccaagtcctcattgtcaaagatgaccattcctttgagttagatgaaactgcattaaatcggatccttctctcggagntgtcagagacaaggaggttgttgctgtatctgttgctggagcatttagaaaaggaaaatcattcctgatggacttcat

SEQ ID NO: 10370 - DNA, 239 bp, Homo sapiens
tgattaattatttactgggccagtcattgtgctaaatagttgctcttttgtgtttcattgccttgatgtttgagtgtaatctagcattttaatacagtgtttattttgcatgatctttaacaaatgttttaagcaattttaaaaaggcaggatgttattgacattatacactgaagtcttaacattttaacatttatagtgcttatttgcaaaattgtataattaggaattatttcaga

SEQ ID NO: 10371 - DNA, 402 bp, Homo sapiens
  misc_feature 20: k=g or t
  misc_feature 38: s=g or c
  misc_feature 79: n=a, g, c or t
gtcggacgacagaccgtgtktttccaaaatggcggcasgatggatgtggataccccgagcggcaccaacagcggcgcgngcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttct

SEQ ID NO: 10372 - DNA, 728 bp, Homo sapiens
  misc_feature 71: s=g or c
  misc_feature 361: r=a or g
  misc_feature 388: n=a, g, c or t
  misc_feature 511: y=c or t
  misc_feature 722: r=a or g
gcatttcctgtttgttgttggagaaaggagagaaaggaaagcgcgaggagccgccgccaccaccagcgcasagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacgggrcatctatgacaaatatggcaaagaagnttaaatggtggaggaggaggtggaagtcattttgacagtccatttgaatttggcttcacattccgtaacccagatgatgtcttcagggaattttttggtggaagggacccattttcatttgayttctttgaagacccttttgaggacttctttgggaatcgaaggggtccccgaggaagcagaagccgagggacggggtcgtttttctctgcgttcagtggatttccgtcttttggaagtggattttcttcttttgatacaggatttacttcatttgggtcactaggtcacgggggcctcacttcattctcttccacgtcatttggtggtagtrgcatgg

SEQ ID NO: 10373 - DNA, 236 bp, Homo sapiens
  misc_feature 32: r=a or g
  misc_feature 71: s=g or c
  misc_feature 164: m=a or c
  misc_feature 169: m=a or c
  misc_feature 182: m=a or c
  misc_feature 194: m=a or c
  misc_feature 207: m=a or c
  misc_feature 213: k=g or t
  misc_feature 228: k=g or t
  misc_feature 232: y=c or t
gcatttcctgtttgttgttggagaaaggagaraaaggaaagcgcgaggagccgccgccaccaccagcgcasagtcctggagctgtgaggagattcgggccgtcaccctgcctcccctgcgtcccgccaccggccacagacctcatctcttatagaaaaaaaaamcaaamcaacaacacagtmactcctggcggmaaaccaaacaaamccagaktcatctggggaaaaktaaytcgg

SEQ ID NO: 10374 - DNA, 163 bp, Homo sapiens
ctcgtaactcatatttgttcttaataaaaaggcattacctgaggaatattcttgttattgctggatcaactcgttacgagaaaagtgggttaagatatattgacatttattcttttgggaaaagctgttctagtgtgtgtgtgtgtgtgtgtgtgtgtgtgtg

SEQ ID NO: 10375 - DNA, 472 bp, Homo sapiens
  misc_feature 370: k=g or t
  misc_feature 371: n=a, g, c or t
actctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgcacctataggggaacataknccacattaaatagttatatacacatcagttcctgtggttctgtacagagcagcggctgaccccacccccacaggacacaatgtggggagaggagacagagg

SEQ ID NO: 10376 - DNA, 412 bp, Homo sapiens
  misc_feature 312: r=a or g
actctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacartctgctccttttttttgtccgccacacgtaactgagatgctcctttaaataaagcgtttgtgtttcaagttaactctgtagcaaaaaaaaaacaaaaaac

SEQ ID NO: 10377 - DNA, 322 bp, Homo sapiens
  misc_feature 98: r=a or g
  misc_feature 219: r=a or g
  misc_feature 291: r=a or g
actctctccgccagaccgccgccgcgccgccatcatggacaccagccgtgtgcagcctatcaagctggccagggtcaccaaggtcctgggcaggaccrgttctcagggacagtgcacgcaggtaatcgggtgggggcatttggccgactgccggcgacctaaaccctgatgtgacctctaccctgccctaacccctgccagccggaatccgggagccgrttctcatttcatcacggggttctgatggttccctttaacgatctgtattctggccccgacacgttctctgarttcatatctgcttcccactccgcggtgcctt

SEQ ID NO: 10378 - DNA, 446 bp, Homo sapiens
  misc_feature 229: r=a or g
  misc_feature 230: n=a, g, c or t
  misc_feature 231: n=a, g, c or t
actctctccgccagaccgccgccgcgccgccatcatggacaccagccgtgtgcagcctatcaagctggccagggtcaccaaggtcctgggcaggaccggttctcagggacagtgcacgcaggtgcgcgtggaattcaatatttttcaaatatttatagcttatttagaaatatttctataatataagcaatttcttaaaaaccatcagatgatacttacagtataagtrnncacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgct

SEQ ID NO: 10379 - DNA, 367 bp, Homo sapiens
  misc_feature 267: r=a or g
actctctccgccagaccgccgccgcgccgccatcatggacaccagccgtgtgcagcctaagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacartctgctccttttttttgtccgccacacgtaactgagatgctcctttaaataaagcgtttgtgtttcaagttaactctgtagcaaaaaaaaaacaaaaaac

SEQ ID NO: 10380 - DNA, 427 bp, Homo sapiens
  misc_feature 267: r=a or g
  misc_feature 325: k=g or t
  misc_feature 326: n=a, g, c or t
actctctccgccagaccgccgccgcgccgccatcatggacaccagccgtgtgcagcctaagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacartctgctccttttttttgtccgccacacgtaactgagatgcacctataggggaacataknccacattaaatagttatatacacatcagttcctgtggttctgtacagagcagcggctgaccccacccccacaggacacaatgtggggagaggagacagagg

SEQ ID NO: 10381 - DNA, 446 bp, Homo sapiens
  misc_feature 21: r=a or g
agtgagcctagagcgccgcgrccccgagatgaagccggcggtggacgagatgttccccgagggcgccgggccctacgtggacctggacgaggcgggaggcagcaccgggctcttgatggacttggcagccaatgaaaaggccgttcatgcagacttttttaacgattttgaagatctttttgatgatgatgacatccagtgagatgccctctggctgcaggcggggccaagcccttggtacagagccgcagtgtgagcctgcgcaggacagtttcaggtggttttaaagaacacgtggaaatcccttgaatttaggacctggttaaccagaaagataagactgttcttaacgacctagatgattctgttcatctctgaacgggatcaggttttgtcctcactccaattaaaagaaagcaatgccggggtgacagagtgagactctg

SEQ ID NO: 10382 - DNA, 478 bp, Homo sapiens
  misc_feature 153: y=c or t
  misc_feature 211: n=a, g, c or t
  misc_feature 405: n=a, g, c or t
atcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtcyggtcccccggtgtcagagctcatcaccaaggctgtggccgcctctaaagagcgtaggnagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttnaaaaggcgggcggaccaaacctaagaagccagttggggcagccaagaagcccaagaaggcggctggcggcgca

SEQ ID NO: 10383 - DNA, 190 bp, Homo sapiens
ttatcctgaaaagacaaagttacaggaaccaaataagcaaatgtaaagaaaataacttgcctgaacttctttccccacaaacagctgttgtagctgatactcttggcgcctctccttgtgtcttctcaggcacattttaatggaaaccaggtaaaaagggaacaaatgaaaggcaaaatccagtatcctg

SEQ ID NO: 10384 - DNA, 900 bp, Homo sapiens
  misc_feature 97: n=a, g, c or t
  misc_feature 868: y=c or t
  misc_feature 884: m=a or c
  misc_feature 890: m=a or c
  misc_feature 899: m=a or c
  misc_feature 900: r=a or g
cgcagcagatcagcatccttcgctgccccttagcaacttaggtggttgatttgaaactgtgaaggtgtgattttttcaggagctggaagtcttaganaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcactgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgyattagtcacgcatgtmtggggmagtagtctmr

SEQ ID NO: 10385 - DNA, 886 bp, Homo sapiens
  misc_feature 97: n=a, g, c or t
cgcagcagatcagcatccttcgctgccccttagcaacttaggtggttgatttgaaactgtgaaggtgtgattttttcaggagctggaagtcttaganaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcactgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattaaaaaaaaaaaaaaa

SEQ ID NO: 10386 - DNA, 57 bp, Homo sapiens
atgacttgattaaaatgtggtgaaaaagggagaaaattattagaaataattgggtag

SEQ ID NO: 10387 - DNA, 165 bp, Homo sapiens
gaaccaagcacggtttccatttcaaaaagggagacagcctctaccgcgattgtagaagagactgtggtgtgaattagggaccgggaggcgtcgaacggaggaacggttcatcttagagcctcgaggtgcataccggacccccattcgcatctaacaaggaatctg

SEQ ID NO: 10388 - DNA, 321 bp, Homo sapiens
  misc_feature 130: m=a or c
tagaatgctcagtcctgccagatagttgcagaagtaacataaaattgcttggaagttatcaatgaatgctagactttccaaactgtgcaggaatcttttgttcaaatgagagtaaatgaaacatgctgcmcctaatgcatggaatggtgtgaaattctgactggtgtgggttcaagagcaaactgaaagggaaatcttaagacagagtatagtacaagtgttgctgaaaatgagactaatagtagtaaggggaaaatggggggtcaaaaagggaggttttttgttgagaaataacatttataggctgaaatgcaatccagg

SEQ ID NO: 10389 - DNA, 475 bp, Homo sapiens
  misc_feature 46: s=g or c
  misc_feature 233: s=g or c
acttcctttcctgattggccgtgttgtacggcggcttctcgcgcastgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcasccctggcttctcgccgcctcacgcggaagctctacaaatgcatcaagaaagcggtgaagcagaagcagattcggcgcggggtgaaagaggttcagaaatttgtcaacaaaggagaaaaagggatcatggttttggcaggagacacactgcccattgaggtatactgccatctcccagtcatgtgtgaggaccgaaatttgccctatgtctatatcccctctaagacggacctgggtgcagcc

SEQ ID NO: 10390 - DNA, 324 bp, Homo sapiens
  misc_feature 4: s=g or c
  misc_feature 7: n=a, g, c or t
  misc_feature 8: n=a, g, c or t
actsgcnnactattgcaaaaagggcacggggcagagggactatgttgtgagcctgcgaaagaagtttgtgtggggactgtgggcagtgaacgcgttgggaacaatatggaaaactgggagccgccttggaatctacagggccggagagaccgaggggctcactaggttgaccaggctggtcttgaactcctggcctcaagccatcctcccacctcagcctcccaaagtgctgggattacatgcatgagccaccacatccagcctacctaaaatattgaatgctgttaataaatctcctgaggccagcataagaaggtgatgggc

SEQ ID NO: 10391 - DNA, 252 bp, Homo sapiens
  misc_feature 157: m=a or c
actggcagattattgcaaaaagggcacggggcagagggactatgttgtgagcctgcgaaagaagtttgtgtggggactgtgggcagtgaatgcgttgggaacaatatggaaaactgggagctgccttggaatctacagggccgggctgaagaaaagmagaatggtattcatgcagttcccattttacagatgaaaacaagaggactttttctgtgaagtcaagaaagtggttacaatggtactttcagcctg

SEQ ID NO: 10392 - DNA, 217 bp, Homo sapiens
aaaaagggcaggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcagtcctcgccagtgaattaggaatcagag

SEQ ID NO: 10393 - DNA, 258 bp, Homo sapiens
ctggcatccctatattttcattaccaacatgcagccacgtgtgcatgcgtgcacacacactccaatcccacacagacacacaatgagaggtgggaacttttagataattccaggggaagagggaagaagttgtgtacctcacataggaaacccagaaaaagggcagtcttaatcagacatgacaagatctagaatgactgctacatccacgcattagaccatgaaatgagggtcacatcccctgccccgtgtttgtaa

SEQ ID NO: 10394 - DNA, 395 bp, Homo sapiens
  misc_feature 20: y=c or t
  misc_feature 39: m=a or c
  misc_feature 47: y=c or t
  misc_feature 122: r=a or g
  misc_feature 353: n=a, g, c or t
  misc_feature 378: y=c or t
aagatggtgagtcttcttgygtgacaaagaaaagaaggmacaatggycgtgccaaaaagggccgcggccacgtgcagcctattcgctgcactaactgtgcccgatgcgtgcccaaggacaargccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtccccancaaagcccatgtaaggagctgagtyttaaagactgaagacag

SEQ ID NO: 10395 - DNA, 373 bp, Homo sapiens
  misc_feature 48: r=a or g
  misc_feature 49: s=g or c
agtagtactttccggcgttgttgaccctatttcccgtgctgcaccgcrsccctttctcttccggttctaggcgcttcgggagccgcggcttatggtgcagacatggccaagtccaagaaccacaccacacacaaccagtcccgaaaatggcacagaaatggtatcaagaaaccccgtggaggggcttgttctgaatgcactgaaccaggttcaggaaagcattttccaggtttcctattgtgacacctcatttccttcttaggatcatgggattttgtcgtttgcctcttctgtggatgagtgaatctcatcccaagagcctgttttcgatgtatggggtttcttacactgttccaggtcttccgctcccagg

SEQ ID NO: 10396 - DNA, 221 bp, Homo sapiens
  misc_feature 48: r=a or g
  misc_feature 49: s=g or c
agtagtactttccggcgttgttgaccctatttcccgtgctgcaccgcrsccctttctcttccggttctaggcgcttcgggagccgcggcttatggtgcagacatggccaagtccaagaaccacaccacacacaaccagtcccgaaaatggcacagaaatggtatcaagaaaccccaggccgtgtacttttcagacttaataaatacaaatatgtatcaatt

SEQ ID NO: 10397 - DNA, 215 bp, Homo sapiens
  misc_feature 48: r=a or g
  misc_feature 49: s=g or c
agtagtactttccggcgttgttgaccctatttcccgtgctgcaccgcrsccctttctcttccggttctaggcgcttcgggagccgcggcttatggtgcagacatggccaagtccaagaaccacaccacacacaaccagtcccgaaaatggcacagaaatggtatcaagaaaccccgaccgtctcactcccaactacccccctgggggttaaaaaa

SEQ ID NO: 10398 - DNA, 436 bp, Homo sapiens
gttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggtacccgcgtcccacacgctaacccgtagccgggcaccccaggcagcctctgtggagctcttgtcccatcctgaggcgatgcgtacttagaaagactgacctcgggtgaaaccgctgtatgctcggaattagagccctgcccaagggaacactcctgcaccccaaatcttaccaattctcaa

SEQ ID NO: 10399 - DNA, 639 bp, Homo sapiens
  misc_feature 135: s=g or c
  misc_feature 522: k=g or t
  misc_feature 557: r=a or g
  misc_feature 582: m=a or c
  misc_feature 609: m=a or c
  misc_feature 615: r=a or g
  misc_feature 619: m=a or c
  misc_feature 633: r=a or g
  misc_feature 634: r=a or g
tttcttagatgtaaaaatgagatctcaatagcagcgggctgggcacatcctctcctctctccttctctctctgcccggagctggtttccgtctctcggctcggggctggaactccggcccaacctaggcgcgcascgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggaagtttctgtkcaatatgtaccttactcgagagcggcgcctagagrttagccgcagcgtccacctcacggmcagacaagtgaaaatctggttcagaamcgcagrttgmaactgaagaaaatrratcga

SEQ ID NO: 10400 - DNA, 362 bp, Homo sapiens
  misc_feature 3: n=a, g, c or t
  misc_feature 4: w=a or t
  misc_feature 277: w=a or t
  misc_feature 335: r=a or g
  misc_feature 336: m=a or c
agnwtgagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttctwctcaaaatccaagagagggaagataaagattcagaggctggaaagtgagatcattcarmcgtggggcctggtggaagatgaagag

SEQ ID NO: 10401 - DNA, 557 bp, Homo sapiens
  misc_feature 73: r=a or g
  misc_feature 388: n=a, g, c or t
  misc_feature 467: k=g or t
  misc_feature 468: n=a, g, c or t
atcccctgcgtggctgggctgctcgggttagatcgtcaggtgagggaggaagggatagccagcgcgaaggaartgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgangtttaccaactgggtgatgtcagtcaaaagacaacatggcacagaatatcagtattccggccaggcctcagagacgtgknatatcaatatgtgaaaaaggggtctcgaatttatttggaagggaaaatagactatggtgaaatacatggataaaaataatgtgaggcga

SEQ ID NO: 10402 - DNA, 390 bp, Homo sapiens
  misc_feature 73: r=a or g
atcccctgcgtggctgggctgctcgggttagatcgtcaggtgagggaggaagggatagccagcgcgaaggaartgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttggggcgtgcaccctatgctctctgttcctcaagatgaattgtcttcacaattcttcaatttcaatcatcaacaatgcttactgaatcaacttaaaaactgttgacac

SEQ ID NO: 10403 - DNA, 237 bp, Homo sapiens
  misc_feature 9: y=c or t
atcccctgygtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagat

SEQ ID NO: 10404 - DNA, 230 bp, Homo sapiens
  misc_feature 73: r=a or g
  misc_feature 160: n=a, g, c or t
  misc_feature 171: n=a, g, c or t
atcccctgcgtggctgggctgctcgggttagatcgtcaggtgagggaggaagggatagccagcgcgaaggaartgctggagtcgtgtgttttggctgcgcgtgatcctgcgtgggtcgggaggtgtttctgtgaaaagcctaaagattagactgtaaganaaaaaaaccgnaaggccagagttgccatggcatcggctagtgtctaaaggagacgcatacagacacacac

SEQ ID NO: 10405 - DNA, 456 bp, Homo sapiens
  misc_feature 341: m=a or c
  misc_feature 440: s=g or c
attttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggmgcaagggctggaatggcgagaagtatatgaaaggaaggtacaaaaaataaagctgaaaaggtagattgggaccaagattcatgctttcattcaactggsacttattgaagcttac

SEQ ID NO: 10406 - DNA, 96 bp, Homo sapiens
gctctctatggtgtgacccgggttggtggcggtaagaagaaaaagggtgaccgcactgcgcaggcgccctcggcgtctctctcgctctctcggtct

SEQ ID NO: 10407 - DNA, 387 bp, Homo sapiens
  misc_feature 11: n=a, g, c or t
  misc_feature 337: n=a, g, c or t
  misc_feature 338: n=a, g, c or t
  misc_feature 369: k=g or t
ggacggtttgnacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagnntcttttcctgtaaatcatggttaatgacatkaaccttcttaccatcagg

SEQ ID NO: 10408 - DNA, 175 bp, Homo sapiens
gtgcagtctgggacgcgggatgcttggcgctctacctcgccgcccctgagccttcccgtccgcctcgccacgcgcccggacggcctggggttgctgcccgtcagtctcgaaaggtgtttttggggaaaaaaatcacaatctggacgtgagaaaggacatgaggagactaaagacc

SEQ ID NO: 10409 - DNA, 451 bp, Homo sapiens
  misc_feature 3: m=a or c
ggmagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaacaactgctatgttctcagcaacccac

SEQ ID NO: 10410 - DNA, 409 bp, Homo sapiens
  misc_feature 10: w=a or t
agtgatgggwgtctgtggtcagtgacagagcctgtagggtcagttatggtgatcggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaaatagctagaggtttttactgggattagtgaaaaaactgctatgttc

SEQ ID NO: 10411 - DNA, 274 bp, Homo sapiens
  misc_feature 22: n=a, g, c or t
  misc_feature 225: n=a, g, c or t
  misc_feature 234: w=a or t
agaatgctggggtgggagatgngataactggatagagagcctgtaaaacagatgataattgactaagacaaaaaggtagcaacagcacgttactccctgcagtggcctgacaactgaatcagctccttagccagggtctctgcacattcatcttcagatggagtttttttcaagctgttcattcacaaggtcacgaaaaatatgcatgccaatcaccatggaggnacatgatawagaaacaactcatggtgtggtccacgtcactataagaggc

SEQ ID NO: 10412 - DNA, 295 bp, Homo sapiens
  misc_feature 272: w=a or t
cattttgctaacttctagtttaaaaaggtgctatccctaatgcctcaaatctagtgaatcatggcatgcaaagaagtgtgaactagggctaagtcacctttgtgtagtcaatttgattgcttttcttaaatggcacccccatctccagctgtgaagttcagccatctgatttgaaaagtgcatttatagatggaaataatacaaatcagtctcttgctaatgctgttttcttttcttttttctttttttgtttttgtttttgtctcctttcwctagcatgaaagactttctaggt

SEQ ID NO: 10413 - DNA, 380 bp, Homo sapiens
caaatattataagtagccttaacaagatgtggtactgcatggactgtttattccctgccaagtttctctataattgatcttccagtttcataaaagaccttactggttctgaaattttgtatttgttacccaagtttcttattttattttttttttaaataaaagattgtagatgtaattagacaagaggttttagagagtagtcaagtaacatttgttcatcatttacaggcatttgcaagtaaaatcactggcatgttgttggaattatccccagctcagctgcttctccttctagcaagtgaggattctctgagagcaagagtggatgaggccatggaactcattattgcacatggacggtaatgtgtacaattggg

SEQ ID NO: 10414 - DNA, 344 bp, Homo sapiens
ggattccggttccggtgggcctccatcagcaagctccagtgctacgtgtccctggcattttaggtgtcggttgggtaggcagtcatggatcaggtaatgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagg

SEQ ID NO: 10415 - DNA, 200 bp, Homo sapiens
cattgacactgtgacaccaggggcagcttttacaccatgtagagtcacagtagcttggcctgccgggcagcagccacgccagtacgttctcattgggacgataggatggctcttttatctcagcttcctctgatttgccatcttgggaccacctttcagccaaaaaggtggtgacttctggcctttctggccgtcctgtt

SEQ ID NO: 10416 - DNA, 804 bp, Homo sapiens
  misc_feature 192: r=a or g
  misc_feature 300: r=a or g
  misc_feature 301: r=a or g
  misc_feature 302: r=a or g
  misc_feature 303: r=a or g
taaaccacgatcgttatgctgagtatgttaagctctttatgactgtttttgtagtggtatagagtactgcagaatacagtaagcttctctattgtagcatttcttgatgttgcttagtcacttatttcataaacaacttaatgttctgaataatttcttactaaacattttgttattgggcaagtgattgaraatagtaaatgctttgtgtgattgaatctgattggacattttcttcagagagctaaattacaattgtcatttataaaaccatcaaaaatattccatccatatactttrrrracttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgg

SEQ ID NO: 10417 - DNA, 1284 bp, Homo sapiens
  misc_feature 448: m=a or c
  misc_feature 453: r=a or g
  misc_feature 464: w=a or t
  misc_feature 483: m=a or c
  misc_feature 1183: r=a or g
cccccaccttccctgctaggggcttcatagggtgtctgttgctagaaactgattgcaggcagtatgtaggcatctttcattcagaatggacattaatatcttgaatagagaagaaagcttttagaaatgtatcatttgtcaaaattgcatgccttttaaaaaatgataaagagagatgctgagtgttttgtatgttagcatcgactctttctttttatttctgttcagactcaagtttttagaagctagaatatagatccctttaagaaaaaaaaaggaagaaagaagaatttgctggttagtcgacctctgtttaagaagtgcttcatcctcctcctccacctctccgtggtgtttctctgcagctctctgtaggttagggttctgtgctgcctggcagaatgctcatgtgttagctgaatagatatcatcgacagacatagaccgmgtgtrgcagagggagwaaaggaggcaaacgtgggmtgggcatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagacgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagrgttacaaagaacaaaactccagacacaaacctccaaatttttcagcagaagcactctgcgtcgctgagctgaggtcggctctgcgatccatacgtggccgc

SEQ ID NO: 10418 - DNA, 897 bp, Homo sapiens
  misc_feature 796: r=a or g
atgaatagtctttccaatgagaaaaaaatagagggagataaccacgtaatgactatggtgatttagggaggcgagagctgctacgtttatgttatactggttatcactcaggagtggctgcccggttatggttgtattgcaatgcaaatcatgcagggatgtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagacgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagrgttacaaagaacaaaactccagacacaaacctccaaatttttcagcagaagcactctgcgtcgctgagctgaggtcggctctgcgatccatacgtggccgc

SEQ ID NO: 10419 - DNA, 177 bp, Homo sapiens
  misc_feature 163: r=a or g
  misc_feature 177: r=a or g
cccccaccttccctgctaggggcttcatagggtgtctgttgctagaaactgattgcaggcagtatgtaggcatctttcattcagaatggacattaatatcttgaatagagaagaaagcttttagaaatgatttctggtttctcttagttcttctctaacatartactttctttccar

SEQ ID NO: 10420 - DNA, 328 bp, Homo sapiens
  misc_feature 325: y=c or t
ctgtaataaacttgtagcatatgtaaagttttcttggcctttatcttacaaaaatggagtattttagtatgaatttgctgaatgtaagacccgtggactgttttttataatatggcctaattttaaaggtccaaaataacttgtttttaaagtttgcccttgtgctaaagtgccagtgtatgtatgttatacttgatttggttgtaaactatatttcaaagtaaaccctagtgtaataagttttataactaaaaaggtttaagctgctaaaactatttttaagagatgtgaaatgcagtatgggactatctttttttcctcctcyaag

SEQ ID NO: 10421 - DNA, 113 bp, Homo sapiens
agagactgccaagcagccggacacacgggggcacagaatcactgaaggggaaaaatacagaaaatatggccgtggatattttgagtacattgaagagaacaagtatagcagag

SEQ ID NO: 10422 - DNA, 351 bp, Homo sapiens
aacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgc

SEQ ID NO: 10423 - DNA, 271 bp, Homo sapiens
attacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaag

SEQ ID NO: 10424 - DNA, 168 bp, Homo sapiens
  misc_feature 113: m=a or c
  misc_feature 152: s=g or c
  misc_feature 153: s=g or c
attgcagcctcggcgtttgtagaagaggagcatctgctccaggtgggtttggatttctgtcggttttgcacaagggatcctaaaggcgattgaaatggtacttagagaaagamaggatcggggccggggctgttcattttgggccgcgcaasstggctgagtgtccgg

SEQ ID NO: 10425 - DNA, 164 bp, Homo sapiens
  misc_feature 104: w=a or t
tagtatgtactatttcaagaagtgcaaaaagtaatgatagtgaatgtaataccatacttaactaaggtaatatatatccttagtttgctcaaaagagtcctggwtattcctgttttctcagcttaatagtgcctcatcgtactctcaaaagtgttctaatttgg

SEQ ID NO: 10426 - DNA, 592 bp, Homo sapiens
  misc_feature 58: n=a, g, c or t
  misc_feature 500: n=a, g, c or t
ggttagagaataatttgtacatatttatttagacctttgatatttattaaagcaattntcacaatggaagtgaaagaatcaggagaaaagccttttaaaaagtattctccaggtttgtcagggtcactctaaagataaaaatgtaactaagtcttctgtgaaatatcatccatctaatcttgatgctgttgcagatggtggtgacacaagttaattgacaaactactgccaaatggtgcacaatattttgtaaaaagtacccagtagccccatttcatacaatgtacctaaattatgcagtaacttggcatcatcgttccctccttgttgctgtgtaattagtcagtgttgccacagtgtgtggcgctgatggagatgtcagaaccgagaacacttaaccttctttgattgtttttcaagttttaagacttcgatccacccctatgagagcaagtaattgtggaaatatttttggtgtaaaatcattccagagtatgtantatttaactgatagctgcatgaaagtgagattcgtgttactttggcttttctgtctctgttgacacggttgcacatttccaagttactacag

SEQ ID NO: 10427 - DNA, 312 bp, Homo sapiens
  misc_feature 122: k=g or t
gtagcctaatgaaaaggggttctagttgagctctgtagataaatgccttgtttcagtgtggttggagacctggtgtcagataaaagaaactccatccgcacagacagatgcaaacagctcckctagttctgcagagctagttgagaactcaacattaatcattttaaaaagtactgtccttgaaatagatttgctgtgggaagaagggcagtgagtgtgggagaaaggagccgtgagcgtggggaacccacagagcccaaaggactttttcagtattcgaaataaacaaaacaaaaacccatgaaaaaaccc

SEQ ID NO: 10428 - DNA, 438 bp, Homo sapiens
  misc_feature 358: r=a or g
  misc_feature 359: r=a or g
  misc_feature 361: w=a or t
  misc_feature 404: n=a, g, c or t
  misc_feature 410: n=a, g, c or t
  misc_feature 415: n=a, g, c or t
cttaataataaaagcaagcatcacatttttaataactgtgtaatagctaatcctatgaacacatcatacttggtagatattattatgattaaagaatttagttttgtcccaacttttcactattataacatattgtaatgcacttcttttgtacacatattttaaaacactcattggactcttccttaggaaaaagtagatttgctgtgtcaaaagttactattcctctctctcaccccttttaaaaattgctgtatttttctggttttaaaggaaacataagctcacagcaaaaaacaaaagtcagaaaataaagacaaagaaaacaaaatagacaatctgttatttagtggtatarrcwccactatcgggaacgtgtgttatttacatttctgttccctctnccctcncctcncctccccttccatccactctctt

SEQ ID NO: 10429 - DNA, 373 bp, Homo sapiens
aatagtctctcacctaactctaagatatggaaagatattgggatcagcaggtttgcctaaaggacccactgcatttatggagaaactgaaaaatgaaaaagtagctcctagaactcgtgccagcgagaacttgccacagatcatggtgcccatggacagccccatgcctttgtactgatacaccatgttggcaagcagtttggaggcagctgctacagagatgcgttccttatttcgaagctcatagattcgacattgccgagccaacagccgttcccagaagctgcaatccgctgcgcccccagccatggtgcctagcaggtatgggttgatctctatcaccttcttcaccgtctgggaggcaatgtaagca

SEQ ID NO: 10430 - DNA, 610 bp, Homo sapiens
  misc_feature 424: r=a or g
gcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagttctagctctgtcacccaggctggtgtgcagtagcgcaagactccctgcaacttagcctcccaggttcaagcatttctcctgcctcagcctcccagaggagttgaagccaaacagccaaattctgccattaggaagtgtgtaagggtccagctgatcaagaatggcaagaaaatcacagcctttgtacccaatgacggttgcttgaactttattgaggraaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaactttcatatg

SEQ ID NO: 10431 - DNA, 473 bp, Homo sapiens
  misc_feature 14: n=a, g, c or t
  misc_feature 259: s=g or c
ctcctcttctttanctctctcccttctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcasctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacaga

SEQ ID NO: 10432 - DNA, 163 bp, Homo sapiens
ctgttgtacgtgagaccctttttctaggcgatatgcaaataaaaagtagtttaaaaatggttgcttactaatgtcttcttgactggtcttttgaaataagctttcttgcagggacattacattaaagataaaagctaagtgtgtctttttttttttttttttt

SEQ ID NO: 10433 - DNA, 485 bp, Homo sapiens
  misc_feature 2: n=a, g, c or t
  misc_feature 7: s=g or c
  misc_feature 165: y=c or t
  misc_feature 463: y=c or t
angtccsgtcccaggattggttgcgcaggcgcagggaaggatccgttttggcgggcggttggcgttgcgcagaaggcggcggcggtggtggcttgtggtgcggcctcaccatacaggaacagggcagacgttagcgtgagtgatcactctcaatcccggggaccyggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggagcacaatacttgggaactgagaaaaacttggattgccctgagctaatttctgaatttatgaaaaagtataagaagatgaaggagggtgaaaataataaacccagggagaagtcagaaagtaycagaggaaatccaatttctcaa

SEQ ID NO: 10434 - DNA, 264 bp, Homo sapiens
  misc_feature 2: n=a, g, c or t
  misc_feature 7: s=g or c
angtccsgtcccaggattggttgcgcaggcgcagggaaggatccgttttggcgggcggttggcgttgcgcagaaggcggcggcggtggtggcttgtggtgcggcctcaccatacaggaacagggcagacgttagcgtgagtgatcactctcaatcccgggtaagtggcagacagtcttatctacccatagtaggtcttgaactgactccatttgggcccgttattgtgtgaaatgaatggacggcggggtggggggatagtcaa

SEQ ID NO: 10435 - DNA, 261 bp, Homo sapiens
  misc_feature 84: y=c or t
cagcccgccaagacccagacctgggaggggaggcccctcctgttagcccagagggaaagaaagaactggggcgatccgggaccyggtggccttagtctttcaggtggaacggtgtgcgacatgggaaagaaaaccaagcggacagctgacagttcttcttcagaggatgaggaggagtatgttgtggagaaggtgctagacaggcgcgtggttaagggacaagtggaatatctactgaagtggaaaggcttttctgaggag

SEQ ID NO: 10436 - DNA, 431 bp, Homo sapiens
  misc_feature 23: s=g or c
  misc_feature 247: n=a, g, c or t
  misc_feature 248: n=a, g, c or t
  misc_feature 249: n=a, g, c or t
agttgcgcgctgggattgttgcsgtgcgctggagccgaatacaaaatacagttaaaataaaatgtcaacctcctggagtgatcggttacagaatgcagcagatatgcctgctaacatggataagcatgccctgaaaaagtatcgtcgagaagcctatcatcgggtgtttgtgaaccgaagtttagcaatggaaaagataaagtgttttggttttgatatggattatacccttgctggtgagtagcannntctgattgcttaagaactgctgctttgggtataacacagtgggttcacagtaggcaattcaattgacatttgctgacttaatcatgtatttggctgccagaagcttttattatcaggttgcttccagtaagatttgtgaatattgaaattatcagatatccttgagatgtggctcatgagtt

SEQ ID NO: 10437 - DNA, 319 bp, Homo sapiens
ttcaagtggtgaaattcagattgcagtagcttgcattataaatgggagttgaagtgaagatactgaatgtagagcttttgcagtagtttacaagtagctgcaaaacacaaaactgttgattccaggaagggagcagacaaacacttaataagggcttgtataaagcttaatagtggtagctataattttaaaaagtatctttcgtgtaccaggtactttgctctgtagtttcataaacatatataggggaatgttaaattgaaagaccacttcagccagaggtgatgatagttaaatacagtatttgctttctatccaa

SEQ ID NO: 10438 - DNA, 283 bp, Homo sapiens
caaagaaaagttttaccaagaccagaagttaaatatgacatttcctaggtagttgtaactctaacatagtttaaaaagtatgtggcttcagattgcctatactttgttcacaaacgtgtgatttagatagactgatttagaagtgaacacttggtaacatccctagactccactcatgaacgcagaattattacctgctgtttgctttctgaaagaatttcagaaatcagaacaaatgtgtctttaggcagattcagctccttttaatatttttctcttggcc

SEQ ID NO: 10439 - DNA, 170 bp, Homo sapiens
gtttcctcattaccttatgctgatgtctgtcatttggtggagaagtcacctcttggagctgttctgggttcatttcactataggaagacctatgctgtttatggaatggcacaaaagtcaatacattgcatatggaaccagcctttaaaaagtcaaaactgatttatggg

SEQ ID NO: 10440 - DNA, 468 bp, Homo sapiens
  misc_feature 125: w=a or t
atttcatgaccggccctattgcactatggaagttaaagtgtcacgactgctctatgcatattggatttaggggaattttcattgttacataaatgtgtgaactagtttcaacagtgttctttcawattactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatat

SEQ ID NO: 10441 - DNA, 734 bp, Homo sapiens
  misc_feature 106: w=a or t
  misc_feature 113: n=a, g, c or t
cagtttgcagttatgcagaatccaaagtaaatgtcctgctagctagttaaggattgttttaaatctgttattttgctatttgcctgttagacatgactgatgacawatctganagacaagtatgttgagagttgctggtgtaaaatagttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgttttacttctcaccatttgagttgcccatcttgtttcacactagtcacattcttgttttaagtgcctttagttttaacagttcactttttacagtgc

SEQ ID NO: 10442 - DNA, 382 bp, Homo sapiens
gcccaggagctttttttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaac

SEQ ID NO: 10443 - DNA, 355 bp, Homo sapiens
  misc_feature 292: n=a, g, c or t
  misc_feature 333: n=a, g, c or t
gcccaggagctttttttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaagtgagtctagttccttgtggtatttggaagttngtggaccacataggcccaaattccaggttgctgctggatanggctagttttaacactttctca

SEQ ID NO: 10444 - DNA, 333 bp, Homo sapiens
gcccaggagctttttttctgggctcggacctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaaagatgccaaaatggaaccaaatctccatgaactctgctaatggaagacgaggaaaaggcaggtaacctaagcaa

SEQ ID NO: 10445 - DNA, 487 bp, Homo sapiens
  misc_feature 137: k=g or t
  misc_feature 343: r=a or g
  misc_feature 475: r=a or g
ccagtattccaccaaagtttgttttcctgcattccagttctcaagtcttaagataaagattgtacttgacagtttagtatatccataaaactatttgaggtggttaaggttcttgggttcattttccttaatacttkgctgaatattgtagattgtaggcaatgaaaaagtctactaaattaggaaaaccttgaataattaggtatcctaggtaagagcccctaaaacaatcaagcaatctgtgagtctgtaaagaaataaatattttttggattattcttatctaattccacccctgttggaagatgatttctttgttctttgcaactatggaagctgtgaraatcatcacaagtgcctctgaaagcgagtgttaggttggttagagggtttaatattttctgcaatggtttgtaggaattttaataaaatgtagtatattttctgagatgattttgtaaaagtactattttaratatcaaatcaa

SEQ ID NO: 10446 - DNA, 354 bp, Homo sapiens
aattatagatgaggcatacgaatttgtttaatgcttcccttcccttcccacatatcatctcactgcctattatctggtgtcacctcatgtatcgtaagttaatactaaaagaagagaaagcacttaagtttcacagaagccgttatgtttgtagtaatgggtcattgcctactaatgaactccatcactgtacacagaatgaagaataatgcatgttaattttcttgtattaaagatgccgtgatttgtaaaaagtctgtattttgcggaatgtctggattaagaagcattaccaataggaatggatcgatagttgaataatgattttttatacatagatatataaaatacagc

SEQ ID NO: 10447 - DNA, 289 bp, Homo sapiens
cagtaaatcctgttgactctaccttctgcaaaatctttcataccatctgcactgctactttgttcatcatatcttggctggattttcgcaatagccttccactggtcttcccaattttagtcttgtttctttacagcctatttttaacaaagaaactggagtgatcatttaaaaatggaaatcagatcctgccatgcctctgtcccgtgccttccaatggcttaccatctcacttggagtaaaaagtgaaatctggataatggtgtaaaagactatatgatccaatccc

SEQ ID NO: 10448 - DNA, 399 bp, Homo sapiens
ctaaaaaacagaagaaaaagaaacagaaaccagcacagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaagtgttcctaaacccaaaggaaagaaaaccaaagatatgaaaaaacctgtcagagtacctgctgaaccacaaacaatgagtgttcttatcagctgtacaacctgccattaaaccaccacatgctatttttctaagaggagtttgctcatgttgtgcccctctctgacacaaactctgcaaagggtttaca

SEQ ID NO: 10449 - DNA, 463 bp, Homo sapiens
gccgtggcgcggagaactctgcaaaacaagaggctgaggattgcgttagagataaaccagttcacgccggagccccgtgaggaagcgtctccgttgggtccggccgctctgcgggactctgaggaaaagctcgcaccaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaagaccatgtctgcaaaggagaagtcgaagtttgaagatatggcaaaaagtgacaaagctcgctatgacagggagatgaaaaattacgttcctcccaaaggtgataagaaggggaagaaaaggacccaatgctcctaaaaggcaccatctgcttctt

SEQ ID NO: 10450 - DNA, 370 bp, Homo sapiens
  misc_feature 179: w=a or t
ttttttccctttcgaattccagggtatatctgggaggccggaggacgtgtctggttattacacagatgcacagctggacgtgggatccacacagctcagaacagttggatcttgctcagtctctgtcagaggaagatcccttggacaagaggaccctgccttggtgtgagagtgagggwagaggaagctggaacgagggttaaggaaaaccttccagtctggacagtgactggagagctccaaggaaagcccctcggtaacccagccgctggcaccatgaacccagagagcagtatctttattgaggattaccttaagtatttccaggaccaagtgagcagagagaatctgctacaactgctgactgatg

SEQ ID NO: 10451 - DNA, 153 bp, Homo sapiens
aacaaaaaaatccttctgaattatatgccaagaaccaaggtgttctgtcatcaaaattgattttttatgtgtgaattgacaacttgctaaagtcccccaaatttgttgtttctaaagaattggaaaccatttgagaggagctattgtaagagg

SEQ ID NO: 10452 - DNA, 237 bp, Homo sapiens
gccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaa

SEQ ID NO: 10453 - DNA, 394 bp, Homo sapiens
atttttttaccagagggagccagggctgcagcctcatctgtttgcggatcagaacccgagctgtgcttgtggctgcggctgctaactggctgcgcacagggaccaaaatgcctcagggctacacatgcaaaaaaaattgtcagatagttaaaaatcaccaaaacgtgctatttttaaatgtgtatatgttgttggttttttaaagtacaggagtagtagaagtattaaatatgaaatattagcaggaatagtatttcagaactctgtaaaactgtgtggggagttcatggtgctagtgttctggaagattcatacatttctgatgaacattttggtttaattcctttgccattgtaatagtcccccacctggtggtccttatccagccccaact

SEQ ID NO: 10454 - DNA, 415 bp, Homo sapiens
  misc_feature 112: s=g or c
  misc_feature 178: s=g or c
  misc_feature 179: y=c or t
acacaagtgatgataaaaagccagccttcagccggagaaccgtttactcgctgctgtgcccatctatcagcaggctccgggctgaagattgcttctcttctctcctccaagstaaactcaggagctatgaagtgtgggcatcaagctgccaccctctgccaggctgcctgtctgcctsyaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagt

SEQ ID NO: 10455 - DNA, 256 bp, Homo sapiens
attcaaaacaaagtttgaagaatgcaggaaagagatcgaagagagagaaaagaaaggatcaggcaaaaatgatcatgccgaaaaagtggcggaaaagctagaagctctctcggtgaaggaggagaccaaggaggatgctgaggagaagcaataaatcgtcttattttattttcttttcctttcctttcctttttttaaaaaattttaccctgcccctctttttcggtttgtttttattctttcatttttacaaggg

SEQ ID NO: 10456 - DNA, 393 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcaccc

SEQ ID NO: 10457 - DNA, 454 bp, Homo sapiens
attagttgaagctgtcatactagtacagatacaggattagactagggtaatagcagtggagatagaaagaagtaaatgagtttggaattggataggagagatgaaggaagaaatcaagaatggctaaccaatttctggcttcagaaccaggtggatggcactgtttattagataggaagtctagggaaggcagattttggccatggtggttcagttttggaaaagttaaatttgcaatgtctaagacatcaaagaggatacatcgggtaagaacgtaggcacatctagagcttagagaagtctggggtaggaaaaaaatctaagtatttataagggtataggtaacatttaaaagtagggctagctgacattatttagaaagaacacatacggagagataagggcaaggactaagaccagaggaacactaatatttagtgatcacttccattct

SEQ ID NO: 10458 - DNA, 206 bp, Homo sapiens
  misc_feature 138: y=c or t
  misc_feature 143: k=g or t
ctgtccctgccctttgttctgaagggcttatgataaaaagtgttgtgcaactcaaagaaagagaagtaatgggatttgtacatgtatattacatagtcagcccagcttggactcctccaatatgagactagagctgaycatgkcccatccctcagcagggcacctcccttaatttgtccccatcctcaattccttttttttttttt

SEQ ID NO: 10459 - DNA, 139 bp, Homo sapiens
cttaacctaggtaaagcattctttaaaatattcctggtgtttgttggatacttacagattctggaacctttctttaaaaagtgttttccaaacagaagttgctctacgttagagtatgatggacttttatgtcgtaaca

SEQ ID NO: 10460 - DNA, 477 bp, Homo sapiens
  misc_feature 108: n=a, g, c or t
  misc_feature 115: m=a or c
  misc_feature 118: n=a, g, c or t
  misc_feature 141: y=c or t
cacttgagtcctatgccttcaacatgaaagcaactgttgaagatgagaaacttcaaggcaagattaacgatgaggacaaacagaagattctggacaagtgtaatgaanattatcmacnggcttgataagaatcagactgcygagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacagggga

SEQ ID NO: 10461 - DNA, 108 bp, Homo sapiens
tttttatgtttaaaaaaatctcattatggattgagtccagcccagctctaagagaaaaagaaggcccatatgggagacttcagtctcattattattgcctttatccag

SEQ ID NO: 10462 - DNA, 443 bp, Homo sapiens
  misc_feature 178: n=a, g, c or t
  misc_feature 183: r=a or g
cgaaatcccgtatcgtagggcgacggcggcttagaaagtgcttcctggagcgcagacgaggtcatgaatcatgtgacggtggcttgaggaggaacctgtctttaaagctgtccctgaagtgacagcggagagaaccaggcagcccagaaaccccaggacctaaagcgattcttgtatnaaaargttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcaatttaatcgtttacctttggtggtgagtttcatagccagcagcagtgcca

SEQ ID NO: 10463 - DNA, 205 bp, Homo sapiens
  misc_feature 128: r=a or g
aatctaggtttctaggctttcgcttctgacttactcatctgtactccttccctgaaaaagttaccacccctccaggagttttacattgccggcttttttatttctggagagttagagaggagaagggraacagagttagagtggcttattctttgtgaggctcttgggatagaaaacatagccagaaaaggattataaattgcca

SEQ ID NO: 10464 - DNA, 255 bp, Homo sapiens
ttttggagagtcaggcctcgttacattgcctgtcacctagactggccagctggtcttgaacccctggcctcgggtggtcctcctgccacgctgcttaagatctgaaccaaactcaaaataggaagacgggggctaaaaagttattttaagaacccccccaccacaaccacagtcacaggggcaaagccctgaaaaaggctgtggtgatgcccctacagctaattcaggagcaggcagcatccccaaatgccgaga

SEQ ID NO: 10465 - DNA, 164 bp, Homo sapiens
  misc_feature 2: w=a or t
  misc_feature 134: y=c or t
awatgacacactgcgatctgaatttcacaaaaagttcatggagaaatatattaaatagtacagttttatgtgcttaattaaagactgtaaaacgtaaaggatcattctgactttttttatgagttttttttttycttttcccctgtctaaattgtgtgtgggct

SEQ ID NO: 10466 - DNA, 411 bp, Homo sapiens
actctctcgggttgttactctgtagcttcccggctcgcgaaagggaggacctgtctgggtcatggattttgagaatcttttctcaaaaccccccaacccggccctcggcaaaacggccacggactctgacgaaagaatcgatgatgaaataggatacagaagttgaagaaacacaagaagagaaaattaaactggagtgcgagcaaattcccaaaaaatttagacactctgcaatatcaccaaaaagttcgctgcatagaaaatcaagaagtaaggactatgatgtatatagtgataatgatatctgcagtcaggaatcagaagataattttgccaaagagcttcaacagtacatacaagccagagaaatggcaaatgctgctcaacctgaagaatctacaaagaaagaag

SEQ ID NO: 10467 - DNA, 463 bp, Homo sapiens
  misc_feature 368: w=a or t
  misc_feature 418: n=a, g, c or t
  misc_feature 420: y=c or t
  misc_feature 452: n=a, g, c or t
gggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttwctggaggtagaacatcctgcagctaaagttctttgtgagctggcctgatncycaagacaaaagaagttggagatggaactactncagtggttatt

SEQ ID NO: 10468 - DNA, 296 bp, Homo sapiens
  misc_feature 259: n=a, g, c or t
  misc_feature 268: n=a, g, c or t
attattatgttctattaaagaaacaatataacttttaacttaggttgtctgttctgttctgtctttattcctcaatctttctactttttgagatctggcttaccttggccctgtaatctacagttaccttttataatgtctccattagcccctgtctaacccttatgataatatttctacatatattacacaaaaaatgaagtagaaacaatgttgaatgactgaaatcctttatcaaaaagttcttaagtagcaaatnatgattatnataattcatatccaccttaaaaccaggg

SEQ ID NO: 10469 - DNA, 200 bp, Homo sapiens
catctatataaaatacatcattcaatgatctctgaatatttcatctcagagaagttagtctctatgctttcatttcctcatctataacagaggtgaggaaaaaaatctgtaatgcccctttcaactctaatactccatgagtctaccagatattgaagtcacccaaagggaaaggaattgctacaaattcttacttgcaa

SEQ ID NO: 10470 - DNA, 405 bp, Homo sapiens
gcaaggctggcaagagggaaccagttaagaggctgtttttgatctgggacagagagaaggtgatgactggtttggggttggagaagaaagcacatgtttgagagggctgtggaagacagaatcagggagactctgccagcagaagatgtgggcaaagcgccgatgagctgttctggagcacggggcccagcacagggtgagaggtgagatgcctgtggggaaatccaggagatagttaaacacatgcaaggggctggagctcaggagaggcttggtctggaaggaaaaagttgaagttcatcacaacacaggtggtagttgtcaatactgtccagagacagtgtacagaaagagaaaaggatgggttgaggacagagcctgaggaatgaagaagggcatgcaagg

SEQ ID NO: 10471 - DNA, 302 bp, Homo sapiens
cacaaagcttattagaagtaattttagtgccagaatccaaattaaatgtcctcccccttagtctaggatgttttcacttatgaccttttcttagttgcttgcttttaaaattatttgtaaataggaatacctatgcaatagtctctctaaaaggaaggacatatttagattgatgctttaaaagttatttaaattctctaaataaaaagttgagtttgcaataattatattgactatataatggttgttcttacctgaagagaagacaaacatactctctcttttttctatttcaaaacgtg

SEQ ID NO: 10472 - DNA, 307 bp, Homo sapiens
  misc_feature 11: k=g or t
  misc_feature 49: m=a or c
acagtgtccakaatgctggagcgtaggtgaaaggacaaaagccagacamatttcaacatgagggacccactgacagattgtccgtataataaagtatacaagaacctaaaggagttttctcaaaatggagagaatttctgcaaacaggtcacatctgttcttcagcaaagggcaaacctggaaattagctatgccaaaggacttcagaaactggcaagcaagctgagcaaagcattacagaacacgagaaaaagttgtgttagcagtgctgggcctgggcctcagagggaatgaaatccacagcgga

SEQ ID NO: 10473 - DNA, 230 bp, Homo sapiens
tgataaattctttgaagcaaaagtgcaggggtggtgtgagagcatgcagtcaagattttatttagactgagtagatttgggacagcttccctgattgacaggtgagacttgaaagagcagtgttagccaggcatgagggctagagaagagaaaaagtttattgaagcagaaggaatagcacaccctgagacagaaggatcttggtttagtgtcttcaagggatagagatg

SEQ ID NO: 10474 - DNA, 194 bp, Homo sapiens
  misc_feature 87: r=a or g
actcccaagatggcggacctactgggctccatcctgagctccatggagaagccacccagcctcggtgaccaggagactcggcgcaargcccgaaggtgaggatcccaaattcacaaccgccttccttcgcccggttctcgggaccatacttctccctctttggacgatgccgcctcctcaaccttgaaagaccc

SEQ ID NO: 10475 - DNA, 521 bp, Homo sapiens
  misc_feature 54: r=a or g
  misc_feature 55: r=a or g
  misc_feature 98: r=a or g
  misc_feature 474: m=a or c
  misc_feature 477: m=a or c
acctacctgggataacggcggcgagcggacggctgcatttacggggtctcccgrrggccagagtcgtggcttacagaagagacgaaatgtggtctgarggacgatatgaatatgaaagaattccgagagaacgagcacctcctcgaagtcatcccagtgatgaatctggttatagatggacaagagacgatcattctgcaagcaggcaacctgaatacagggacatgagagatggctttagaagaaaaagtttctactcttcccattatgcgagagagcggtctccttataaaagggacaatacttttttcagagaatcacctgttggccgaaaggattctccacacagcagatctggttccagtgtcagtagcagaagctactctccagaaaggagcaaatcatactctttccatcagtctcaaacatagcaaataaagagaggcctgtccagtctttgaaaacatcaagagmtamttcaccctcaagtggttcagcagtttcttcatcaaaggtgttag

SEQ ID NO: 10476 - DNA, 242 bp, Homo sapiens
attgatccggaggaggattcgcagttcaacatcaaggtaaggaaggatacagcattgttatcgttgttgagatattagtaagaaatacgcctttccccatgttgtaaacgggctaagtttgacagtggtagttggcttttgcaacacccccttcccatttcgacatattacagattgaagaaaaagtttgttgctcaaaacttacagtttgtttctttgcagccccaaaccttttagctacc

SEQ ID NO: 10477 - DNA, 442 bp, Homo sapiens
caaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactct

SEQ ID NO: 10478 - DNA, 199 bp, Homo sapiens
aatctacaccatgaagttgaaagaaggatgaagacaaatgtccaacacctgggatcaagtgaagagtggtattaaaaagttttaatatcctgtttttatgaaagtctccacattatggacaatgtaatggtttatatgtaacttggatacatttcatgtggcttttttgttgttttgcaatctgagacacaccctctcc

SEQ ID NO: 10479 - DNA, 400 bp, Homo sapiens
  misc_feature 38: w=a or t
  misc_feature 196: r=a or g
  misc_feature 210: w=a or t
  misc_feature 212: k=g or t
  misc_feature 240: r=a or g
  misc_feature 248: y=c or t
  misc_feature 250: k=g or t
  misc_feature 255: k=g or t
  misc_feature 284: r=a or g
  misc_feature 344: k=g or t
  misc_feature 385: w=a or t
ttgtctttagcttcattgaatgctactaaattaaagcwccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtrgttagttgaatatwtkattagttctgaaggacgagaattgataragtaagtytkggagktttttaattaaaagaaatttgtgtctctrccagtgatttagagctgaagtttcttataaccctttttatttcaacttgaaattattgtkctgcttaaagtctattttaaactctcttcactgaaacagtwaggaaataattcagg

SEQ ID NO: 10480 - DNA, 393 bp, Homo sapiens
  misc_feature 137: m=a or c
ctcaaaaagttttggattttggagcattttggatttcagattttcagatttgggatgcccaacccaaacagattgaatctgattctctattcaatttgttgcaatgttgttttggttgaagtctataaagaaaatcmaacttcacacagaaagaggatgagtatttttaataccttctttgatattataccaaaactctgtaagtgttagtttcttaaaggttaattgcattgtggaatctgaaatgagctttttaaaaaaactaaacctttgatacattaaaatcagttggtctgttttgcactttttttcagtggatctttcatccatgcatgattttggtttttgtttgagagagagtcttactctgtcacccaggctggggtgcagtgg

SEQ ID NO: 10481 - DNA, 322 bp, Homo sapiens
  misc_feature 34: y=c or t
ggtattatttttcatatttcaggtttgacttgtyttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtatgaccgagctggttttgcttatggtcatgctgcaatttgttagaataataggg

SEQ ID NO: 10482 - DNA, 451 bp, Homo sapiens
  misc_feature 133: r=a or g
  misc_feature 300: m=a or c
aaaaataaaccaataacctacctactgacaagtaaatttatacaggactgaaaaccgcctgaaacctgctgcaactattgttattaactctgtatagctccaaacctggaacctcctgatcagttttgaaggrcattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgmgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaa

SEQ ID NO: 10483 - DNA, 575 bp, Homo sapiens
  misc_feature 335: s=g or c
atatactgcgcctgcgcaagggctgtggcccttttcccaccccctagcgccgctgggcctgcaggtctctgtcgagcagcggacgccggtctctgttccgcagatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcasgtatgcacacgaactgccaaaatatggtgtgaaggttggcctgacaaattatgctgcagcatattgtactggcctgctgctggcccgcagcttctcaataggtttggcatggacaagatctatgaaggccaagtggagtgactggtgatgaatacaatgtggaaagcattgatggtcagccaggtgccttcacctgctatttggatgcaggccttgccagaactaccactggcaataaag

SEQ ID NO: 10484 - DNA, 507 bp, Homo sapiens
  misc_feature 36: n=a, g, c or t
  misc_feature 266: n=a, g, c or t
atatactgcgcctgcgcaagggctgtggcccttttncccaccccctagcgccgctgggcctgcaggtctctgtcgagcagcggacgccggtctctgttccgcagatgagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcangtatgcacacgaactgccaaaatatggtgtgaaggttggcctgacaaattatgctgcagcatattgtactggcctgctgctggcccgcagcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaag

SEQ ID NO: 10485 - DNA, 818 bp, Homo sapiens
  misc_feature 391: n=a, g, c or t
  misc_feature 408: m=a or c
  misc_feature 578: s=g or c
atatactgcgcctgcgcaagggctgtggcccttttcccaccccctagcgccgctgggcctgcaggtctctgtcgcagcagcggacgccggtctctgttccgcagatggtcagtggatgcctcggtctcggggctttagatgcatggaggttcccttttcttgcccgtatgccagcctagggcccgtctcgcgcgtcgcaggggccggatggcgttagattgctagctctgacttggtcgaggtgcagttcccagcgtggccttaaatggctgccgcccggtgcgcgaacttggggggaggggttggcgaagaagggttgcgtgacttggacggcggattggggagaagggggtttgttaaagttgttaagaataaggcctactttaagacntacaagtgaaatttagmagacgaacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcasgtatgcacacgaactgccaaaatatggtgtgaaggttggcctgacaaattatgctgcagcatattgtactggcctgctgctggcccgcagcttctcaataggtttggcatggacaagatctatgaaggccaagtggagtgactggtgatgaatacaatgtggaaagcattgatggtcagccaggtgccttcacctgctatttggatgcaggccttgccagaactaccactggcaataaag

SEQ ID NO: 10486 - DNA, 207 bp, Homo sapiens
  misc_feature 69: s=g or c
  misc_feature 99: s=g or c
gtgaaaaaaaaggtgcagacaggagaaaaataaatgctaagcgcacactggcctgcatcttgcccattsacagcttactttggacttgaggtgttgtcsagatgatgatggcctcagttcaagaccaaaacggaaataaaaagagcttcctgaaaagaacacagcagaagtagtaaaccagttctctatcacaaaatgtgcaacagt

SEQ ID NO: 10487 - DNA, 339 bp, Homo sapiens
aattatcacatcatagttggccccacttcccttttggaaatgttcttgtcctggtgttcatgtttttactctttcttggttttccgctaaccactctgatcattccttcctaacctctttgactactttctctgcttccccatcttacattttaaaaattactttaaaaatggataatatgtacacgatatgaatttgaaaaggtacaaaagggtacagagtgaaaaataaatgttttccttttccttcctgcccttgacaactaaaacctgccaatcatcaagtcccttttccccaatctgttccttttcaaccccaaagtcattatctaggccagcc

SEQ ID NO: 10488 - DNA, 81 bp, Homo sapiens
tattgaaatgggcttattcaaaaataaattgcaatcaatttggtccaattatcaccaaacgtctcttttttcttttttttt

SEQ ID NO: 10489 - DNA, 596 bp, Homo sapiens
ataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcac

SEQ ID NO: 10490 - DNA, 379 bp, Homo sapiens
tacaggttagtagtaccaatcctatatatgctgtctagaaacttctgtacatgtttaccaggaagcacatataagaatattcctagaattactgaaatggcaaaaaactgaaaaaaactgcaactatccaccaaaagtaggatatatagataaatcaatagactgatagattggcagatagataggagtgctatacagctgttaaaaataactgtaatgcagtgttactcatcaatctggatgaatttcaaaaccaaaatgctaagaggaaagtgcaagaagcagaaaagaccatagaaattattccatttctgtaaggtcaaaacaagcaaaattcagcaacatagtgttttgaaatgcattcatatatggtagaact

SEQ ID NO: 10491 - DNA, 237 bp, Homo sapiens
agaaaaataagaaaagaagcattgagggaaaagagtcagagagatactgagttttttttaaaggagttgaaactcatatcttccgactcccaaatccaaaacctcaaacttggaaatttttaggaagaaaacatttattgggtactaagaccccacgctaggtctggcccacataatttaatcttcacagcagtccctgtggggcaggtgtttttatttccaccattcagatgaaga

SEQ ID NO: 10492 - DNA, 396 bp, Homo sapiens
  misc_feature 87: k=g or t
  misc_feature 142: r=a or g
ttcctaggagcggggctgctggattctatgaatacagcgtctaggcttttagtgccctctgccaaatcgttcttcgggaagccagtkcacctttccaaaaataatgtatgagagaatacatttacctgtaccttcactaatrctagattctgttgcttttgtgtacaagatatagatctagattttcacatataaggattccttaaagcaaggaacatcatagtacaataaaaataagacaaaatctcgttcaaggagctgtctgtattcaacaccctgaaagttctaagctacatcaacagctggaacagtacagaaacactatctctcagggaggacagagtaccaggtaccaaatagatcctggcaaaggaacaggcatggaagtttccagag

SEQ ID NO: 10493 - DNA, 176 bp, Homo sapiens
tagttaaaaataagggttaagatgtaagttattaaaggagtctcaaaaactatttcaacaaagaaattgtagatgtatggtgggtttttgtctttgtttttctcttagaatcagatacttttagttccagagggcatttgttataggtattcaaaaaatccaccaacacttttttt

SEQ ID NO: 10494 - DNA, 121 bp, Homo sapiens
cagccatttgcagatcattgcaggtgagctatgcagttaaaaataaggttcaccctgaccctagaatctctgacttattccgactttatgagttgaggaaatgacacataatactcatccc

SEQ ID NO: 10495 - DNA, 559 bp, Homo sapiens
  misc_feature 7: n=a, g, c or t
  misc_feature 8: n=a, g, c or t
taatgtnngaaaaagctcttgcaatcaagtcagtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgttatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccacc

SEQ ID NO: 10496 - DNA, 161 bp, Homo sapiens
agtatttgactctacagaaaaataatatacagacatgtttattcacttggtactttttaaattgtctagaacagactgagagtgacacgcatatttgattgtgaggacagtttttgtcataatatctggttatcgtgtgatattaaactactgaagtaggg

SEQ ID NO: 10497 - DNA, 542 bp, Homo sapiens
aatgtctcgcgacaagggcgtttcactagcacgtttgggcgcgttgggcggcgtccgggtataaaagactccacccgagcgggcggccgccattctggggttcgtttagaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaagaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggcccctaaataattgagtttgggtc

SEQ ID NO: 10498 - DNA, 442 bp, Homo sapiens
atatagcacggatacagacagctgatcatgcatttttctacaagcctgccggcaccatttaggattttgaaaaataatctagaaatgctataccctttatcaaaattattttttactttgcaagagcttaacagttttggttttttcttagcaattctataaaattaacatctataaaatgcatcccggaccagatacatactgtattgaaagctttcttcaggaagagaatatgagagtgttctttccagcttattttcttccttagcaaaaggattgtttgattctcagaagcagaaggacacattcattgtggagcagctctgcttaagtgtatgaaatgccttctgtctggttgcagaatttggagtttactaaacagtgtttagtgattgggctcatcttgcatcaccagttgatgacatttttctttgttccctcc

SEQ ID NO: 10499 - DNA, 359 bp, Homo sapiens
  misc_feature 338: w=a or t
  misc_feature 340: w=a or t
  misc_feature 344: r=a or g
  misc_feature 358: r=a or g
  misc_feature 359: s=g or c
gtcccccgaccggaagtcgaggggaggagtctagtgccgcgggctccggagtgacggaagttgtgctcttggtgaatggggttcttccttttttatttaccggtggctgtgcttccaatttaggaagaccccggcgacctgttcctcacccccgcttcgccctcacactttcgggatgtctgcgattcctgctgaggagagcgaccagctgctgatccgaccccttggagctgggcaagaagtaggaagatcatgtattattctcgagttcaaaggaagaaaaataatgctcgactgtgggatccaccctggcctagaaggaatggatgctcttcctwawattrattaaatgaaccars

SEQ ID NO: 10500 - DNA, 420 bp, Homo sapiens
  misc_feature 130: r=a or g
  misc_feature 136: k=g or t
  misc_feature 241: y=c or t
gtttttctgaaaatgagcatatttttagtcatgtcgattagctgttcttctacatcacattgttactctttctgatgatgattctagggttaacattggaaccatctcaaaataattacaaagttttagratgggkttaccaatgtcttctaaacaatgtaatctaaaaataattgagtcagatgctaacgagatactgcaggcataactgctgtttttctgacaactgattgtgaaaccyttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatgggg

SEQ ID NO: 10501 - DNA, 381 bp, Homo sapiens
  misc_feature 74: s=g or c
  misc_feature 219: n=a, g, c or t
  misc_feature 287: r=a or g
  misc_feature 291: r=a or g
  misc_feature 341: n=a, g, c or t
  misc_feature 345: n=a, g, c or t
gaaattctttatatgaaaaataattgctggtttaaaatagaccattttaacaaagtgactatatttctttttasgaaaatgctatttttctatgatgtaaacaattgttaggcggcagatttttaaggaagtattattttatttaagagtctgtatccctttgtgtgagaggaacccaaagagggtccacttttgctttaaagctctgtcccttacccnctgacaactctgctacttttattttatcttagaaaatgtcaatatagacatatcacagggttaataaragaracttttcacaaagatttttgtacaagtgtagctatcaggttatatttganaatnaccctctgaaaccagccaacattgtcatgacaattt

SEQ ID NO: 10502 - DNA, 333 bp, Homo sapiens
agtctgatttccctcttccccccaaaggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctccccc

SEQ ID NO: 10503 - DNA, 393 bp, Homo sapiens
  misc_feature 75: s=g or c
acttttctgagcagacgtccagagcagagtcagccagcatgaacgagctgacggtcaagaccaaggatggcgtgstggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctccccc

SEQ ID NO: 10504 - DNA, 426 bp, Homo sapiens
  misc_feature 230: m=a or c
  misc_feature 256: m=a or c
ggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacmctgtaagggtcccagaaaatggaaamgaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacg

SEQ ID NO: 10505 - DNA, 317 bp, Homo sapiens
  misc_feature 83: m=a or c
ggccttcccggctgacggcctgcgtgcactgcgcttgcgcgggttgagggcggtggctcaggctcctggaaaggaccgtccamccctccgcgctggcgggtggacgcggaactcagcggagaaacgcgattgagtagaaatggaaaagaaaatgaaataaatcagcagttatgaggcagagcctaagagaactatggcaacatcaggtgactgtcccagaagtgaatcgcagggagaagagcctgctgagtgcagtgaggcgggtctcctgcaggagggagtacagccagaggagtttgtggccatcgcggactacg

SEQ ID NO: 10506 - DNA, 260 bp, Homo sapiens
  misc_feature 88: m=a or c
  misc_feature 113: r=a or g
ttgaaccaaatcagttgttttcaatcaaagtcttcttggaaaaaaatgaatgctaattatgcattgcacattatcattaatgcagaamaaacgttttgtacacatttgctttraaaatcctaactaggccacttgtggtggctgacacttgaggctggagaactgcttgagtccacgatttcgagacctgccttggcaacataataagattctatcgagagtgcagtaagctgtgatcatgccactgcactgcagcctgg

SEQ ID NO: 10507 - DNA, 491 bp, Homo sapiens
  misc_feature 11: r=a or g
  misc_feature 478: y=c or t
agacctcggcrataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcatttyctcgattttgctc

SEQ ID NO: 10508 - DNA, 246 bp, Homo sapiens
  misc_feature 11: r=a or g
agacctcggcrataagaggctgcacagcgacatgcaacagtcttttcactgcagctgaatgagttgtggcgcccacaatgctcccatgacaaggagctgacaagttccattttccgtcgcgggcatcttggaatcatgactcccacaatgccttgggcacttggtcgacagtggggccgcctctgaaaaaaaaatgtgagagggccgttgctccagggagaactgcaaatatcttcatccaccccc

SEQ ID NO: 10509 - DNA, 336 bp, Homo sapiens
  misc_feature 45: y=c or t
aatgccttaaacttatgagtaaggaaaataactcggggtgacgcycgaatcctcactgctaatgtgagacgaatttttgagcgggtaaaggtcgccctcaaggtgacccgcctactttgcgggatgcctgggagttgcgatctgcccgaccctattcacgcctaaaaagtagactgactgtggggtggtcgtgttttttgtttcttgttggtaggtggtgaatgcgtttttttcgttgttttctccgttactcaggctgccagttgcttggcagtcttgtcgctggctgtggacgctctgcacttcatcaccgtccccagctgcgctttgagccgg

SEQ ID NO: 10510 - DNA, 338 bp, Homo sapiens
  misc_feature 60: y=c or t
aagagtcctgagctgaaccaagaaggaggagggggtcgggcctccgaggaaggcctagcygctgctgctgccaggaattccaggttggaggggcggcaacctcctgccagccttcaggccactctcctgtgcctgccagaagagacagagcttgaggagagcttgaggagagcaggaaaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcaccc

SEQ ID NO: 10511 - DNA, 252 bp, Homo sapiens
gtcttaaaaatactattgattttcttctccacaacaatgctctgatgtctctccactgccaccaagtaatttgtggggctgaaaacaactcgaaggctaggattctaggctctggagaatgtcttgttttgtgtgtatagatttatgtatgtatctatttatgtgtgtttgtgcatgcatatgtgtataaatagacatagatatattacaaagtatttaacttattaaataagtataaacaaatgaattaaa

SEQ ID NO: 10512 - DNA, 441 bp, Homo sapiens
acctccatctcccaggttcaagcgattctcctgcctcagcctcccaagtagctgggattacaggcaggcaccactatgcctggctaattttttgtatttttagtagatatggggattcaccatgtttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataaga

SEQ ID NO: 10513 - DNA, 364 bp, Homo sapiens
  misc_feature 346: r=a or g
agaaaggagattagcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggraagaagagggaaaagcca

SEQ ID NO: 10514 - DNA, 272 bp, Homo sapiens
  misc_feature 3: k=g or t
  misc_feature 48: n=a, g, c or t
  misc_feature 51: n=a, g, c or t
  misc_feature 226: r=a or g
  misc_feature 241: r=a or g
  misc_feature 263: r=a or g
ggktccgctccctggggcgcacgtcagtcaggaggcggaagcgcacgnagnggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcraactcttcaggacargaaacagggtctcgctttgttrcccaggctg

SEQ ID NO: 10515 - DNA, 667 bp, Homo sapiens
  misc_feature 114: w=a or t
ctcacatttttgaaaaatagatgctatcctctatagtaaaatattgaatcactttatagtagacaatacatacgagatttaacaaatacttggtttgaaaaagtttggctttawtcaacaattttagtttgcccactgattttcaaatgtctgtgggattgcttataactaagtagaaagtgaagattgatttttacttaagaatgggatagagatgagttttatggtttttaaaagtattttcagttcattatttaaatgttgggttgttgatatggtcttgtttctgataaggaaataggagcaacttgttttaaaataactacactaaaagactttcttcatctccgtatagagaaatccagatttcaattaattcatttattgggtgctaacaaaattcagggttagagtaaatttaggtctgttggtccatgtggcctggtttcctagcacccattaaacataatgctatcttttaagcctgaacatgtgggttttttaaatcaaattggaaaaaaattagacaactgatgtcatgctgtcttggtatccatactaaaaaagtatcaggaaaatagattatttttgtgctgtgaaacactattcagtggaaagtttagtggcacttttccatatcattcatgacttaatacctgaaatgcac

SEQ ID NO: 10516 - DNA, 336 bp, Homo sapiens
  misc_feature 15: s=g or c
  misc_feature 90: w=a or t
  misc_feature 92: k=g or t
  misc_feature 136: r=a or g
  misc_feature 177: k=g or t
gcgagagagcgagtsagcaagcgagcagaaaagaggtggagagggggggaataagaaagagagagaaggaaaggagagaaggcaggaagwakgcaagggacgagacaaccatgctgtgctgtatgagaagaaccaracaggttgaaaaaaatgatgacgaccaaaagattgaacaakatggtatcaaaccagaagataaagctcataaggccgcgcggatgggtgtactgagagaaaacatgtaattgaggatggagccttgaggataatgacgaacattggcaatgccagctgtggaggataagtgggcaacagacatgataaattatagatagg

SEQ ID NO: 10517 - DNA, 224 bp, Homo sapiens
tttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtaacctttattagtccacttcttggagctagacgtcctatacttagtcactggggatggtgaaagagggagaagaggaagggcgaaggga

SEQ ID NO: 10518 - DNA, 385 bp, Homo sapiens
  misc_feature 7: w=a or t
  misc_feature 328: r=a or g
  misc_feature 337: k=g or t
atctaawaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatgraggccagtktaacgttacatgactcgttgagaaagttgaggaatttcctctaccacc

SEQ ID NO: 10519 - DNA, 390 bp, Homo sapiens
ttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgtaccctattcaggctgctgggagttgataagactacctcaaatcgctgtgtgtag

SEQ ID NO: 10520 - DNA, 290 bp, Homo sapiens
aaaagcaatgtcagtgataacaagcaaaaataggacaggggagaaagccaagagtcttcagaccacaagagaaggagagattaattctggaaaatccacctggatggacagcagcagagggaggaggaggcaggacagaccagaagagagacaatgaggttctgaacctagatgttggccaagggagcagaggagggcaggtcaggaggccctcgccctgcaatcacccttcctgggagccttcacttcacctgtgatctcaagacctctccctactgcctgactcgcgc

SEQ ID NO: 10521 - DNA, 404 bp, Homo sapiens
  misc_feature 126: y=c or t
  misc_feature 164: n=a, g, c or t
  misc_feature 338: n=a, g, c or t
  misc_feature 339: n=a, g, c or t
  misc_feature 340: w=a or t
  misc_feature 341: r=a or g
  misc_feature 379: k=g or t
actttttaaaataaatgcataacacctctatgagatagacaggaacttgtgacatattacattgtcagatttgtttatatttatttatgtgacctcaatttaccctaggttgaggaaaagagattyagaggtggcagggtggaagtttggaaaagtaaaattanaggaaaaatagtacctgatgatatatgaaaaaataatttagccctgtgggatttctagattctatgaatattaaactttattaaattgcagatgcaattaaatactctaactatatttaagaacttaaaacttgaagttcagtctttagtagttataggctgaattccattccnnwraggtctaaagcatgtcagaattgtgcttttgaattatktcagactctttaaatcgaagcctct

SEQ ID NO: 10522 - DNA, 173 bp, Homo sapiens
tttgtgtttaggagtactgtaatataattagcaaaaatagtcaaagctgagttttttatttttcctctgaaagccatctgctttccatttaagatgaaggtttgtggtgcgtaggcttggtttcgtgtaaatactaatcttattaacctggtattggtaagaagttgttttag

SEQ ID NO: 10523 - DNA, 219 bp, Homo sapiens
ctgatctgtgattatgacttatccaaatcttacatttcttaaaaatagtcatagatgaagggaatcacagttgatggttatatggtgacattagtggcttaaattctaaatgactggaaactgtataataggcgaaactgtgaggcaaataaaatgcttctcaaatctgtgtggctcttatggggttaatttgatttggacctgtattaatttcttatg

SEQ ID NO: 10524 - DNA, 447 bp, Homo sapiens
  misc_feature 392: r=a or g
ataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaaragatttctacacatgaaaaaaatgcctttgtttagtaaatcacacaaaaatccag

SEQ ID NO: 10525 - DNA, 455 bp, Homo sapiens
aaaatctcttactttgcctccgcagtatacacgtacatccaaagccggttctaccgatccccagaagtgatcctgggccacccctacgacgtggccattgacatgtggagcctgggctgcatcacggcggagttgtacacgggctaccccctgttccccggggagaatgaggtggagcagctggcctgcatcatggagattccaaaggttttcctaaaaatataaccaacaacagggggaaaaaaagatacccagattccaaggacctcacgatggtgctgaaaacctatgacaccagcttcctggactttctcagaaggtgtttggtatgggaaccttctcttcgcatgaccccggaccaggccctcaagcatgcttggattcatcagtctcggaacctcaagccacagcccaggccccagaccctgaggaaatccaattcctttttcccctct

SEQ ID NO: 10526 - DNA, 381 bp, Homo sapiens
  misc_feature 78: n=a, g, c or t
aaaatctcttactttgcctccgcagtatacacgtacatccaaagccggttctaccgatccccagaagtgatcctgggncacccctacgacgtggccattgacatgtggagcctgggctgcatcacggcggagttgtacacgggctaccccctgttccccggggagaatgaggtggagcagctggcctgcatcatggaggtacgcggagggctggcggtcggctcccacggagaccgtgggcttggccctcagacacggggctgcaccagactcgcccaggaccatggcctgcataccttgttgttgttgttgttgttgagtattccctaaaaggaattttgaaattgtgtactcccttgtacttgtcaagtcgacatctaa

SEQ ID NO: 10527 - DNA, 255 bp, Homo sapiens
tttattcttaggcaacagaaattaaattattttaacttacatggccattcacaataatagaagatgttttgcttcgtaattgtgatgagtttacaaagagttagatggcttcactcagagaatttcacattagaaaacgagggtgaatcaggacatttctcaatctgtggctctgggggttaggccaatagtttttgagcatgaccacacccgggaaacttaaaaatataagcttcctgatgatacccacgtccc

SEQ ID NO: 10528 - DNA, 425 bp, Homo sapiens
  misc_feature 7: y=c or t
  misc_feature 8: n=a, g, c or t
  misc_feature 405: k=g or t
  misc_feature 407: n=a, g, c or t
tatttayntcacaaaaatctgtgttttatctaggatattttctgaatattctttgtaaaatgcagatttttttccacaaaacagtaggattctttgttatattcttaaaattgtttgtttaagtaggtaaaaaatatacattcagctgaaagcattacactaacatttacattttaagccttaggaggttattcagcccaattcccagcagtagagagaatactaaacttgtgtctcaaggtttcatggttttcccacgttctttggctattaatttaatttcccaggtcacgtagacaatcattgataattgaaacaagtcctgagttgaaataaccttgagttgagcaaaaatatcctcattttggcagaagctgggcttggtagtacagtaaaattttagtkanatgtgctcttgtaattga

SEQ ID NO: 10529 - DNA, 149 bp, Homo sapiens
accgcccgctcccggcacccccggacaccgccccggtctcacgcatgcgcagagggccgatccagttcttttcggctggaatggggaatttgtgaggtcaaggatgcattccaggaaagttctataaaaatataccatcaactccaacc

SEQ ID NO: 10530 - DNA, 335 bp, Homo sapiens
  misc_feature 114: r=a or g
  misc_feature 115: s=g or c
  misc_feature 122: r=a or g
  misc_feature 170: w=a or t
  misc_feature 297: s=g or c
gagagacctgaggcttgcagcgctgggcccggccgggtcgctgcggctgggctggaggtgaggcgaaagaagggcatcctctgatgggagtggaccggagtccgctaaagcgarsattccarggtcaaggatgcattccaggaaagttctataaaaatataccatcagcwccaacctgatatttgacctagccatggaaaacctcattggctcctcactggatcagaccataaaaatgatccaggaatgaaaatctaagataaattcccaccacttcaagatgttcttatacaagtsaacagtctagcagatcagccagtctctttcatcatcaa

SEQ ID NO: 10531 - DNA, 388 bp, Homo sapiens
  misc_feature 82: s=g or c
ctttttcggctggaatggggaatttgtgaggtaggccggaagtggtgttgcggagggaagtgtggggagagcagaggcgcastctgctggagagacctgaggcttgcagcgctgggcccggccgggtcgctgcggctgggctggaggtcaaggatgcattccaggaaagttctataaaaatataccatcaactccaacctgatatttgacctagccatggaaaacctcattggctcctcactggatcagaccataaaaatgatccaggaatgaaaatctaagataaattcccaccacttcaagatgttcttatacaagtcaacagtctagcagatcagccagtctctttcatcatcaagcagacatactcaagaaagaggaatagtga

SEQ ID NO: 10532 - DNA, 127 bp, Homo sapiens
aattttgttttttgaaaaatatccactatttgaatctaaatattatagaaatttctctttaaacattcccttttactttatcccaaaataaatctccctttgcataaattttttctttttctttttt

SEQ ID NO: 10533 - DNA, 107 bp, Homo sapiens
attggtgtgagtacagtgtttctcttgagaacctgtggcatcgggtatgctttttaacagccatgtgaaaaatatcctgcccaggccataaaactgttcagctgaca

SEQ ID NO: 10534 - DNA, 159 bp, Homo sapiens
tatgtatgtaaaaatatctacccatctattttgaacagaatgaccatttttatatagttgtataatatttgtgaaaagagatagactttttccattgtctcatagctttaaaattttttgacataaaataaacctatataatatatcatctttcattct

SEQ ID NO: 10535 - DNA, 329 bp, Homo sapiens
aattgcttgaacctaggagtcagaggctgcacttagccgagattgcaccactgcactccagcctgtgcgagacagagtgagactccatctcaaaaataaataaataaataaaataaaaataaaaataaattctcgttgtaaaaaactggctccaccccaatcctccagtccattgcgggcatgccctgacaagaccctgtgcaggttcccttatctgcacaaaaatatctggtgtaaacatttgtgcagcaggtcggagatcttccagagacccttttttatctgcctaggcatttgtctgcctcttgcctctatcaatagtatattgt

SEQ ID NO: 10536 - DNA, 183 bp, Homo sapiens
aacaacttcttcagcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggc

SEQ ID NO: 10537 - DNA, 464 bp, Homo sapiens
  misc_feature 33: n=a, g, c or t
  misc_feature 40: n=a, g, c or t
ctctttcctttcgcgccggttgccgctgcggangcgcggngtccatgtgcgcagtgagtggcgctattcctggcccagtagcacccgagccccgggtttgaccgagtccgcgctgcgatggaccccaacaccattatcgaggccctgcggggcaccatggacccagccctgcgtgaggccgcggagccagctcaatgaagcacacaagtctctgaattttgtctcaacactgctccagattactatgtcggaacagctggatttacctgtgagacaggcaggtgttatctatctgaaaaatatgataacacagtattggcctgatcgagaaacagcaccaggggatatatccccttatactattccagaagaagatcgccattgtattcgagaaaatattgtagaagccattaatccattctcctgagctcatcagggtacagcttactacatgcatcatcaca

SEQ ID NO: 10538 - DNA, 397 bp, Homo sapiens
aagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaacaccaa

SEQ ID NO: 10539 - DNA, 181 bp, Homo sapiens
  misc_feature 133: w=a or t
agttggaaagattatttgaaatgactaatttgtgctatctttatgaaatatgttaaatgtagcttttttgaaacagaagccttgaattgaaatttaactaatacttgaacattttgtatatatttctttgtawataattttgtgcagtaccaatgacaaaaatatggtgtcataataaaac

SEQ ID NO: 10540 - DNA, 213 bp, Homo sapiens
  misc_feature 88: s=g or c
  misc_feature 94: s=g or c
actgggcggcggaagttcgacggcgccgggcgagtggctgttgagcggcgccgcgggagttccgcagtttcccgtgttcgcagcggascggagscagctgaacccggccgtgggatcccggataggaggaggaggggacccataggacgcgttaacatggacctggaaaacaaagtgaagaagatgggcttaggtcacgagcaaggattagga

SEQ ID NO: 10541 - DNA, 349 bp, Homo sapiens
  misc_feature 341: n=a, g, c or t
  misc_feature 344: r=a or g
taattaaaatgaatgttaggcttcttgtggccagttaatagttgatgagattggtgacattatttattgccacagcctattgtataaactatgcagagttaaatatttgcttgtaaaatattagccaatgttgtcattattttgatgtatttccttggttatgaccaaaaatatgttgagatactgaaactaatgtctgtgtgtttaaatgtttaccagcaaattgtcttatcatgttaatgagaatgttcaatgcctgtgtggtaaatagtaaatacaatggcataaaagtaactttctctgaagatgtgatgttcaggctgtgaaatatatatgtaaangaraaata

SEQ ID NO: 10542 - DNA, 176 bp, Homo sapiens
ttaaacttgttaagcactacagttctattcaaaagtatagtattatcttaataatagccatagtctttgtgagagatatcattctttaaaaatattgactgatgtggcacctcacagtaccttttgtcaattgttgaaaccagattactgaaaataatattgaagacccagagccc

SEQ ID NO: 10543 - DNA, 472 bp, Homo sapiens
  misc_feature 459: w=a or t
agggtcgttgtgcgcctgcgccaggattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacaatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgwaccatagtaacac

SEQ ID NO: 10544 - DNA, 227 bp, Homo sapiens
  misc_feature 118: m=a or c
  misc_feature 119: m=a or c
  misc_feature 123: r=a or g
  misc_feature 129: s=g or c
  misc_feature 143: r=a or g
  misc_feature 148: r=a or g
  misc_feature 175: n=a, g, c or t
  misc_feature 176: r=a or g
ctttttttccgctcggctgttttcctgcgcaggagccgcagggccgtaggagccatggcgcccagccggaatggcatggtcttgaagcccccggggtgatagggggtttgggctttcmmtgaraggatstggggcagagtgargggtrtggctagtgggcactgctagggaaggnracatcttgccggagagaggggtctgggataccctggtcactggagatccca

SEQ ID NO: 10545 - DNA, 357 bp, Homo sapiens
gacgaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtg

SEQ ID NO: 10546 - DNA, 389 bp, Homo sapiens
  misc_feature 297: n=a, g, c or t
taacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttggnaggggccagaatattctcacctattttgggaaggcatgcaaccaaccctaaattacttttttttttccttaaagggacgtgggcctcaaaca

SEQ ID NO: 10547 - DNA, 238 bp, Homo sapiens
ttacaggaaacgctcaggttttgtttcgtttgataactagaatgacattggatgtaccagttcttttttggtttatctcagagtgaaaactacttctttttccaaactgggagagagatacatgtttcaccacaagggcagccaggcaagggggcacctttactctcacacatctaggaggtgttttagtctaggctctattgctaaggggccaataaaaatatttttttctcactgg

SEQ ID NO: 10548 - DNA, 459 bp, Homo sapiens
  misc_feature 34: k=g or t
acttaggaaagcgaagggggtagggctgccagakcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaacttgggtttctttcttaaaggactgatttttagaactccacatttgaggatcacagtcaccttctatatagcaccatccccaggatgcaggagccggggcagattgtggagacctacacggaggaggatcctgagggagccatgtctgtagtctctgtggagacctcagatgatgggaccactcggcgcacagagaccacggtcaagaaagtagtgaagactgtgacaacacgg

SEQ ID NO: 10549 - DNA, 374 bp, Homo sapiens
  misc_feature 34: k=g or t
acttaggaaagcgaagggggtagggctgccagakcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaacttgggtttctttcttaaaggactgatttttagaactccacatttgaggtaccttgttgggtttaaaagggacagaaggaaacagtgtgaagtgagggggtctctctccctccttctccttcctctgtgattcaccttcctttttaccc

SEQ ID NO: 10550 - DNA, 392 bp, Homo sapiens
  misc_feature 34: k=g or t
acttaggaaagcgaagggggtagggctgccagakcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaacttgggtttctttcttaaaggactgatttttagaactccacatttgaggtgtgtggcttttgaagaaaatgtatgtactgacgggaaaaggaggataagcaagtcgaatttttgtcttacggtaaccggagggaattaaaaaacgggagagtctgttatgctgatga

SEQ ID NO: 10551 - DNA, 530 bp, Homo sapiens
  misc_feature 34: k=g or t
  misc_feature 186: r=a or g
acttaggaaagcgaagggggtagggctgccagakcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcarctgccctgctggatttgtctttctcagcaccttggcgaacttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggatgcaggagccggggcagattgtggagactacacggaggaggatcctgagggagccatgtctgtagtctctgtggagacctcagatgatgggaccactcggcgcacagagaccacggtcaagaaagtagtgaagactgtgacaacacgg

SEQ ID NO: 10552 - DNA, 456 bp, Homo sapiens
  misc_feature 34: k=g or t
acttaggaaagcgaagggggtagggctgccagakcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcaactgccctgctggatttgtctttctcagcaccttggcgaacttgggtttctttcttaaaggactgatttttagaactccacatttgagctctctccttcctgcttcctccttgctgtggtggctgggatgcttcttccatgattttttgaatctagactgggctgttctctgtgttaaaccaatcagttgcgaccttctcttaacagtgtgaagtgagggggtctctctccctccttctccttcctctgtgattcaccttcctttttaccc

SEQ ID NO: 10553 - DNA, 413 bp, Homo sapiens
  misc_feature 19: r=a or g
aggagtttccggctgagartccttctagcggcgccggctggagtgcagtggcacaaccttggctcgctccagtgtctacctgccaggttcaagtgattctcctgcctcagcctcccgagtagctgggattacagattattgaataataaaatacagttttgaaaaaaatggatgaagaacctgaaagaactaagcgatgggaaggaggctatgaaagaacatgggagattcttaaagaagatgaatctggatcacttaaagctacaatagaagacattctattcaaggcaaagagaaaaagagtatttgagcaccatggacaagttcgacttggaatgatgcgccacctttatgtggtagtagatggatcaagaacaatggaagaccaagatttaaagcctaaatagactgac

SEQ ID NO: 10554 - DNA, 259 bp, Homo sapiens
  misc_feature 125: m=a or c
cagatttttaaaaatcaattctcttgccatgcctcctatgtgttcacatctctgcatacactacagatataagtgcataatcattcatataaacatctggtaggtattctgtaaaactgtgtttmctttagtgcatgttattgtcatgttatgatgtgactggggtgtttctttgtcatgaaactttgcttcttcacagaattagaatactgctctctctatattgaactacatatacagcgttttcttgtatcagccc

SEQ ID NO: 10555 - DNA, 281 bp, Homo sapiens
  misc_feature 109: r=a or g
ctttggcggattttctgttttcggaagttgctgggttcgttttattcagcggcagtggtgctttcccgaatctcagaatgcctgttaaaagatcactgaagttggatgrtctgttagaagaaaattcgtttgatccttcaaaaatcacaaggaagaaaagtgttataacttattctccaacaactggaacttgtcaaatgagtctatttgcttctcccacaagttctgaagagcaaaagcacagaaatggactatcaaatgaaaagagaaaaaattgaatc

SEQ ID NO: 10556 - DNA, 426 bp, Homo sapiens
  misc_feature 64: s=g or c
  misc_feature 65: r=a or g
  misc_feature 66: s=g or c
  misc_feature 233: k=g or t
  misc_feature 400: n=a, g, c or t
aagtctaactggctctggaaagctgaaagggctgcactggaacaacacagatgagatattctasrsattaatctacttatctggaatcactttgcctctaaaggccagagaaaaatcacagcttccttgtcggaggggaaaaggacaggtgatctggggaaaacgcagctacacctggagcaaggtctcttcccggcttggcaatctcagctgtgccggcgctacgggaccckagccgtcccagaaaccaaagggcaggcacggcagcaaacgcctgagtgctgctgccttcggtgactatatgagaatggaaacttctaaggaagccaggttgttagaattgttaccccctttactcagagataacatagattatccaggctgagatggaaaacaagcnctttattgaattttcaacacagactc

SEQ ID NO: 10557 - DNA, 495 bp, Homo sapiens
  misc_feature 26: s=g or c
  misc_feature 421: s=g or c
agcttctatcccggaagttgatgccsagcgcagatcgcttgcagcttgctagctgtgtgggctgggaggtctggtagggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttaattttgtgttgtctcacagaaagccttatcataaattcsataattctaattaatttaccaagataatgtaattacatttggttttgtaaggtatacagcagtaatctcctatt

SEQ ID NO: 10558 - DNA, 351 bp, Homo sapiens
aactttcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactccagcctgcatgacagagcgagactccatctcaaaaaaaaagaaaaaa

SEQ ID NO: 10559 - DNA, 346 bp, Homo sapiens
  misc_feature 256: w=a or t
aactttcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacgatgaggtaaacaaaaaataaaattaaaaaagatgaggtctgataggggagcagccggataagaaaatcaaaaaaggaacwgtaatttaaagtttattccatcaaatacgatgaggggtcttttccttaacccatctacagtgctactccttttagtctcatttttaatct

SEQ ID NO: 10560 - DNA, 653 bp, Homo sapiens
  misc_feature 595: n=a, g, c or t
aactttcctttccggcggtgacgacctacgcacacgagaacatgcctctcgcaaaggatctccttcatccctctccagaagaggagaagaggaaacacaagaagaaacaccctcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagtganccgctacacttgccagcgccctagcgcccgctcctttcgctttcttccttcctttctc

SEQ ID NO: 10561 - DNA, 232 bp, Homo sapiens
aactttcctttccggcggtgacgacctacgcacacgagaacatgcctctcgcaaaggatctccttcatccctctccagaagaggagaagaggaaacacaagaagaaacgcctggtgcagagccccgcaataagtgttacagcaaccagagggaaggtaggaggaaggggagaggaagaaggttggtcagcacaagtgtgaggagagaaaaaaaggcattcatggctgtctac

SEQ ID NO: 10562 - DNA, 578 bp, Homo sapiens
  misc_feature 488: w=a or t
aactttcctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacgatgaggtaaacaaaaaataaaattaaaaaagatgaggtctgataggggagcagccggataagaaaatcaaaaaaggaacwgtaatttaaagtttattccatcaaatacgatgaggggtcttttccttaacccatctacagtgctactccttttagtctcatttttaatct

SEQ ID NO: 10563 - DNA, 583 bp, Homo sapiens
aactttcctttccggcggtgacgacctacgcacacgagaacatgcctgtgagtgctttggtccaggtttcggcggagatctcgctgttctgtccgaactctcccctcacgctgatttcggatcgtagagggtcctcatttaccctctgcacttcttaggacattaactccagggaccgcagcggcccacgggccacccgcatagacgggagcggagaggagataagatggcggcccagctgcgcagacaccaggggcggcgaggggcgagctctccccgctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactccagcctgcatgacagagcgagactccatctcaaaaaaaaagaaaaaa

SEQ ID NO: 10564 - DNA, 256 bp, Homo sapiens
  misc_feature 84: y=c or t
  misc_feature 196: n=a, g, c or t
  misc_feature 214: k=g or t
  misc_feature 215: y=c or t
aaaagatgttatattgtgtttgactattttccaacttgtattttcatataatttatattttttaaaagctgaaaatttagaagyaagatgaaaaaaaggaaaagcaggtgctttttaaaaatcagaactgaggtagcttagagatgtagcgatgtaagtgtcgatgtttttttaaaaaaaaatgcaaaaaattctnatggcggagttttttgtkygtttattttagtagctgatgctggcacatcattttgctgga

SEQ ID NO: 10565 - DNA, 405 bp, Homo sapiens
  misc_feature 323: k=g or t
  misc_feature 341: y=c or t
  misc_feature 387: y=c or t
tgaagtttctgttttagatcaacgttaaagtttaaaggtttatgaagaattaatgttaagaatgtttcattcttttcaatcaaacagctaaaccatgtatttcatactatgaagaaaaccagtgatcagatgggcttaagagattttttttttgtttcaataacttgaattgaagctcaagattattgaaagttaatattttcatatgattagactaaagcttttgagtataagaaaaatcagattgttgaggtcattcataatgctgagtcattggtataatttgatgacagagttaatactttcatcatttttttctctckgtccttttgcaattcatyctgtagggtttctttgactcacgcttcaattagctcactaattcgyctttaaatgaagtcaccc

SEQ ID NO: 10566 - DNA, 224 bp, Homo sapiens
gagtccttctagcggcgccggtgagtccgcgtgtggaagtctgtgaggcgcagaggtggggcaggccgtctgactagctaggcggctgggagcgttttcgtggcggggaacggaggttgaattgccctgcctgggctcatagggaaggaggatgtgaaggagcttgtgaaggcagaggaagattattgaataataaaatacagttttgaaaaaaatggatgaag

SEQ ID NO: 10567 - DNA, 439 bp, Homo sapiens
  misc_feature 239: s=g or c
  misc_feature 424: k=g or t
cagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaasaaggaaaaatgaagagagtttctagtttaatgggttaaatttttgttgttgcaatagtaagtttagtcttcttataatatttctaaatgaaaaatcataggtatttgttaccatgtgtgaagattactttgttaaaagcaaaagtggtcgtgtgatatgctaaatgttaattactgattttatakgtttaaatcacgcca

SEQ ID NO: 10568 - DNA, 412 bp, Homo sapiens
acttctcacagtttagatggtattgtggtattaggatattggttttcatccacggatccaggctcataactcctatccacagcccttgttatggttttttgatataatgttagatgtgttaggcctcaggggcaggcctctgaccttctgctctccttccaccctaatctttccccacctgattgtgggccttaaaaccctcccctgagaggggtggaccctgtatcctgggggaaggaatgctgatgtcatgaagcttccataaaaatccaagaggacagagttcagggagcttgtggatagctgaacacacggaggttcctagagagaggcctgctcagggagggcacagaaactacacgcctcttcccccatacctcgccctaagcgtctccttatctgtatcctttgc

SEQ ID NO: 10569 - DNA, 438 bp, Homo sapiens
gcagtgagttcgacacaccatgccgactgtcagcgtgaagcgtgatctgctcttccaagccctgggccgcacctacactgacgaagaatttgatgaactatgttttgaatttggtctggagcttgatgaaattgtatatattggatatttgtctatttttcaaagattgtgtgcataagcttatttttcagggttatactgtatttcatctttgttaccttatagttagactaaggtgataatgtttgtgggccatgatttctgtgttcagagggctaagctccatgtctgtctgttgccttgactaaaatctcaaaaggagttcatgccttattccatctacaatcaccttgttaccaggctcatgctgtggaaatggatagaatgtgttagataaccccagtatgaaagtaagctccctcctttggcaaattaatc

SEQ ID NO: 10570 - DNA, 388 bp, Homo sapiens
gcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggc

SEQ ID NO: 10571 - DNA, 434 bp, Homo sapiens
cattgcaaaaacttaccctggttgtgggggagagttctagatctgtgccatgatccatacactggctaatagagtacataatttttccattttccattttttgtttttacttactactgaaggatctcagatgtaaaattatgtatttggtttgagatggccacttattgtccttaaaaatccatactgatatatgcagtcattttgaattggacagtgccttctctttttttttctcctcttcttccatctccctcacccatgcccccacccaatctaaagagacagtgctgtacactctcatagagatagagaaagatctaaaaagttgagactactcaatccagttaacaacagcaggagcactagagtttgttcatttattctctctgtaaaacaagctgtgctttttttcttctgcctttaaaatgcca

SEQ ID NO: 10572 - DNA, 237 bp, Homo sapiens
aaatagaaccaaaatatttatgaggatgctagcattttccaagcatagtaattagttcaactgagaaatattatgtctgtagtagataaatattagttgtgcattttaatttaattctcctttttccattttgtctcatgaagtaccttattgcaaaaatcccactgagtaatagctcataaattataatctttcaaatagccatgctaccagcgtacaacagtgatacatgtaacc

SEQ ID NO: 10573 - DNA, 234 bp, Homo sapiens
  misc_feature 113: y=c or t
  misc_feature 114: m=a or c
gtgtggggtaagtcgcgggccctcccaggcccaatacttcaaagcatcctacctctgctcaatatatattacttggagaggattgaggaaactgccctcaagaaaggcctctymactcaggccatctggcgccgactctgggatgaactgatgaagacaaggccttccagtttggaaagtgtgacatgttggcgagccaagtttatggaggcctttttttcccatgttctacgt

SEQ ID NO: 10574 - DNA, 414 bp, Homo sapiens
  misc_feature 123: m=a or c
  misc_feature 124: s=g or c
  misc_feature 300: n=a, g, c or t
  misc_feature 325: n=a, g, c or t
  misc_feature 382: r=a or g
gttctgtttcactctgaccatcggtgctcacagcccctatcacgtaccccctggcttgctcagtcgatcacgaccctctcacgtggacccccttagagttgttagcccttaaaagggacagamsttgagcacctgaggagctcagattttaagacgctaggctgctgatgctcccagctgattaaagccactcccttcactatctcggtgtctcctgtccgcggctcgtcctgctacatttcttggttccctgaccggcaagcgagaatgcaggctcaacagtaccagcagcagcgtcgnaaatttgcagctgccttctggcatnattttcatactggcagctgtggatactgctgaagcagggaagaaagagaaaccagaraaaaaagtgaagaagtctgactgtggagaatg

SEQ ID NO: 10575 - DNA, 402 bp, Homo sapiens
  misc_feature 339: n=a, g, c or t
gactcagttcctggagaaagatggcgacagcgagaagcagaaacacgacgggcgggtgaagatcggccactacattctgggtgacacgctgggggtcggcaccttcggcaaagtgaaggttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaccaggtcatcagtacaccatctgatattttcatggtgatggaatatgtctcaggaggagagctatttgattatanctgtaagaatggaaggctggatgaaaaagaaagtcggcgtctgttccaacagatcctttctgg

SEQ ID NO: 10576 - DNA, 378 bp, Homo sapiens
  misc_feature 15: s=g or c
  misc_feature 16: s=g or c
  misc_feature 18: w=a or t
  misc_feature 167: s=g or c
  misc_feature 171: n=a, g, c or t
  misc_feature 174: r=a or g
  misc_feature 175: k=g or t
  misc_feature 182: n=a, g, c or t
  misc_feature 200: r=a or g
ggcggctacgcggassgwcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggscatnaarktggcagnttaaaatcttaaaatagrcagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatg

SEQ ID NO: 10577 - DNA, 423 bp, Homo sapiens
  misc_feature 214: m=a or c
  misc_feature 245: r=a or g
  misc_feature 246: m=a or c
  misc_feature 261: m=a or c
  misc_feature 402: n=a, g, c or t
acaagatcatggccactaactacagtgccaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcmaatgcctctgaagaaccccctgctcgggtgrmcctgacctcccgtamaactgctggtgctgcctccctcaccaaatggatacagaaaaatcctgattactcaaggcctccaatgggctgtgtcctgaaatcttaggcaagccccatgatccagacagtcagaagaaactcagaaagaagtctatcacnaaagactgtacacaagcacga

SEQ ID NO: 10578 - DNA, 93 bp, Homo sapiens
attacctggcatttaggagaccagttcaaaaaaatggcctccgataaattttgtttaacatcccgtatcccttttgtcactctctctctctct

SEQ ID NO: 10579 - DNA, 331 bp, Homo sapiens
aatgtaatgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcctttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctg

SEQ ID NO: 10580 - DNA, 347 bp, Homo sapiens
  misc_feature 333: r=a or g
  misc_feature 339: y=c or t
cacttttgattttatagtaatttgtgctttaaaatagatgtatttatattgcacttcatactctattctttatagttcgagccatagcttgtttcctattaatgcttttcctgtctagttgtgttttacttaactgcctataaaaatcgtaagagtaatttttttcagttgatgtactgattgagcttgagttgctgttatacagcatttgacaggaactataccttggaaaatcagattgtgattctcagttctgtgttgcttttggtttgaagagttttgggaacgttttaattattaattacccttctctaaactttaaaaaaaaaaaargctttycccattaa

SEQ ID NO: 10581 - DNA, 148 bp, Homo sapiens
acatttacctagcagaagaaaaatcgtgtttacgaaggtggttttcgcagggcgaactaattcgtgcaacttccccaaatgtgggaagctcgactgcataatttgtggtagtgggagactgcgttcgctcttttcccccgtttttttt

SEQ ID NO: 10582 - DNA, 176 bp, Homo sapiens
  misc_feature 120: r=a or g
  misc_feature 121: r=a or g
ccccatctcattccactctcccatgcccactgaagtgccaatgattcaagtccacatgctgaaaaatctaacctagagtccctcctccactccctccatctcaaactcaattaaaaaaarraaaaacagatccatccagtgtgccacagtgagataccaatcagtaatcatgtaca

SEQ ID NO: 10583 - DNA, 575 bp, Homo sapiens
  misc_feature 547: k=g or t
  misc_feature 548: w=a or t
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgagtagkwggcttacttctctctttacatgtaagc

SEQ ID NO: 10584 - DNA, 626 bp, Homo sapiens
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtggaacagaagtcaaagcaataacatattcagcaatgcaggtctataatgaagagaacccggaagtttttgtgatcattgacatttaag

SEQ ID NO: 10585 - DNA, 556 bp, Homo sapiens
  misc_feature 529: r=a or g
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggragtacgagtgtgagttacacgcatggg

SEQ ID NO: 10586 - DNA, 580 bp, Homo sapiens
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggcccaagtatccgccagtcaataggaagtacgagtatttggatcatacagcagatgtccagttacacgcatgggga

SEQ ID NO: 10587 - DNA, 617 bp, Homo sapiens
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtgtgaatttggatcatacagcagatgtccatggattgtattacacagagcatgaatatacttctttaggttacacgcacg

SEQ ID NO: 10588 - DNA, 688 bp, Homo sapiens
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggccaagtatccgccagtcaataggaagtacgagtatttggatcatacagcagatgtccagtggggagaagaattttcattgtccaagcaccctcagggaacagaagtcaaagcaataacatattcagcaatgcaggtctataatgaagagaacccggaagtttttgtgatcattgacatttaag

SEQ ID NO: 10589 - DNA, 741 bp, Homo sapiens
  misc_feature 506: s=g or c
tgagaggtttggtccgcacactcccgcagcaagagggcagccattttcttgaaggctattaagcttacgaccctttcagagtactgagatgaaaaatctagaatgccttcgggtctagttatcaattttgggggtgaagcgggggaaagaacctcgccagtgagacccagacgggtttcattcaaggtgcccttcaacgtttttccttagtctttggaaagaactagtaatgaaggaatcgcagaagatggggttttggctttttaaatatgcgatccaagcggcagggtagggactaaagtaggtcaacagccaactccgagaaaggagtgtggtcctttaagggtgtgcgccaaggggcggagtctagagcggaagtagtaactccgggccgaagtccggtggatgaagggcggaagtagagtgtctaatcctgcagtcatggcgcaggaagaggaagatgttagagattacaatttgactgaagaacagaaggcgatcaaggscaagtatccgccagtcaataggaagtacgagtatttggatcatacagcagatgtccagaagtgaaagtacttagcattgatcaaagaaatttcaaattacgatcaattgggtggggagaagaattttcattgtccaagcaccctcagggaacagaagtcaaagcaataacatattcagcaatgcaggtctataatgaagagaacccggaagtttttgtgatcattgacatttaag

SEQ ID NO: 10590 - DNA, 342 bp, Homo sapiens
  misc_feature 11: y=c or t
  misc_feature 13: y=c or t
gctgcggtgaytyttttcacgtgtcgccagggccggactgcgagtctctttgcggcgctacactagagcagagtacgagtctgaggcggagggagtaatggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaaggtaaatgggagctgcagtggaactattttttatagtgtgcagtggagggaaaagaagtaattctggagtattaaaag

SEQ ID NO: 10591 - DNA, 412 bp, Homo sapiens
accggaggagcgacaacgacccctaacagacgtaaggaatcgggaattaaacttggaatattggcaggacaagcgtttagaaagtttcttccactctttgaccgagtattggttgaaaggagtgctgctgaaactgtaaccaaaggaggcattatgcttccagaaaaatctcaaggaaaagtattgcaagcaacagtagtcgctgttggatcgggttctaaaggaaagggtggagagattcaaccagttagcgtgaaagttggagataaagttcttctcccagaacatggaggcaccaaagtagttctagatgacaaggattatttcctatttagagatggtgacattcttggaaagtacgtagactgaaataagtcactattgaaatggcatcaacatgatgctgcccatt

SEQ ID NO: 10592 - DNA, 326 bp, Homo sapiens
  misc_feature 309: y=c or t
  misc_feature 311: y=c or t
  misc_feature 317: w=a or t
  misc_feature 318: w=a or t
tttccctttatagcaccattgaatcccagtcctaacagaagtactgcgaatcttgtggcctcattctgaacaaaagggattagagaagaaaaatctcttgatataaggcttgaaagcaagggcaggcaatcttggttgtgaatattttctgatttttccagaaatcaagcagaagattgagctgctgatgtcagttaactctgagaagtcgtcctcttcagaaaggccggagcctcaacagaaagctcctttagttcctcctcctccaccgccaccaccaccaccaccgccacctttgccagaccccayayccccgwwaccagacg

SEQ ID NO: 10593 - DNA, 219 bp, Homo sapiens
  misc_feature 2: k=g or t
  misc_feature 4: k=g or t
  misc_feature 10: y=c or t
  misc_feature 20: k=g or t
aktkacaggyagggcgggckgggcggccgacgacgttcgtcatttagtgcgggagggatcctgaaccgcgcggccgaaccctccggtgtcccgacccaggctaagcttgagcatggctgagcaggagcccacagccgagcagctggcccggtgatggccacgccctcaccatgtccctggcagagggcttccctccgggatcccctgcctggtgcccac

SEQ ID NO: 10594 - DNA, 725 bp, Homo sapiens
tgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactatttatttttgatcagtggcctttgggccactgttcagggtactgaccatcagtgtcagcattagggttttggtttttgtttcttttgggtctttcttttttggca

SEQ ID NO: 10595 - DNA, 227 bp, Homo sapiens
  misc_feature 202: s=g or c
  misc_feature 210: k=g or t
  misc_feature 212: w=a or t
  misc_feature 215: y=c or t
agaggcggagaacaatatggcggatggcgaggagccggagaagaaaagaaggagaatagaggagctgctggctgagaaaatggctgttgatggtgggtgtggggacactggagactgggaaggtcgctggaaccatgtaaagaagttcctcgagcgatctggacccttcacacaccctgatttcgaaccgagcactgaagtsagaaacgktwatytttaaataactg

SEQ ID NO: 10596 - DNA, 256 bp, Homo sapiens
aaagcaaggggcgagcgcgagtgcgagtgaggcaaagatagagcgcatgtctcatccctgcgagcagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttctttcttttt

SEQ ID NO: 10597 - DNA, 194 bp, Homo sapiens
atatttgaagtgggtaaaaatctgtaaagccacgttaccattagcacgcagagagccttttctggagattgaaaagaagttgaagagctgggttagctatcatcgtaagctatcatcgttagtgatggcgtaaacctggaagccagagaatatcatctaaatattgacatttcaagaaaccggatgtaaaggaa

SEQ ID NO: 10598 - DNA, 249 bp, Homo sapiens
  misc_feature 128: r=a or g
  misc_feature 134: w=a or t
tcatatataaaaatctgttgcaagtccaatcaaaatcccaacagataattttgtttagtgaaaattaatagattgattccaaaattcacttggaacagaagattgtgaaaagccaagacagttttaargaagawtgaaggaaaggcaatttggtttttcagataccaggatttattgtgaagtcatattaattaattcaaagtgatgttagtgcaaggatagcaagcatactaattaaacagagcagag

SEQ ID NO: 10599 - DNA, 507 bp, Homo sapiens
  misc_feature 324: k=g or t
  misc_feature 328: w=a or t
ccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccactattgggcttattctctgctctatagttgtgaaatgaagagtgaaaacaaatttgtttgactattttaaaattatattagaccttaagctgttttagcaagcattaaagcaaatgtatggctgccttttgaaatatttgatgtgttgcctggcaggatactgcaaagaacatggkttawtttaaaaatttataaacaagtcacttaaatgccagttgtctgaaaaatcttataaggttttacccttgatacggaatttaacaggtagggagtgtttagtggacaatagtgtaggttatggatggaggtgtcggtactaaattgaataacgagtaaataatcttacttgggtagagatg

SEQ ID NO: 10600 - DNA, 389 bp, Homo sapiens
  misc_feature 31: s=g or c
gcatgcgcagggaggggagaccttggcggasggcggaggcgcccagcggaggtgaaagtattggcggaaaggaaaatacagcggaaaaatgcagagctggagtcgtgtgtactgctccttggccaagagaggccatttcaatcgaatatctcatggcctacagggactttctgcagtgcctctgagaacttacgcagatcagccgattgatgctgatgtaacagttataggttctggtcctggaggatatgttgctgctattaaagctgcccagttaggcttcaagacagtctgcattgagaaaaatgaaacacttggtggaacatgcttgaatgttggttgtatatccttctaaggctttattgaacactctcattattaccatatgg

SEQ ID NO: 10601 - DNA, 452 bp, Homo sapiens
  misc_feature 440: n=a, g, c or t
agaaaggcacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtngcttggaaccca

SEQ ID NO: 10602 - DNA, 483 bp, Homo sapiens
  misc_feature 396: n=a, g, c or t
atccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccantgtaggagcaaaacgactagctgccagggcagggaagaagccacttgcacattactcttcactggtgagagtcttgggatcagacat

SEQ ID NO: 10603 - DNA, 154 bp, Homo sapiens
aattgtgggattggatgagtctcaagatggacaaccgggatgttgcaggaagagctcatcgctcagaagaaacgggaaattgaagccaaaatggaacagaaagccaagcagaatcaggtggccagccctcagcccccacatcctggcgaaacca

SEQ ID NO: 10604 - DNA, 255 bp, Homo sapiens
agggcgtggcttctcgtagccattaggaaagagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcg

SEQ ID NO: 10605 - DNA, 151 bp, Homo sapiens
agggcgtggcttctcgtagccattaggaaagagcaaccctttcacctcagttttcttcactccggcatttgcagcagagcgaaaggtggtcgagtcctgaaggagggcctgatgtcttcatcattctcaaattcttgaggcagcccaatat

SEQ ID NO: 10606 - DNA, 450 bp, Homo sapiens
  misc_feature 140: r=a or g
  misc_feature 284: y=c or t
  misc_feature 319: r=a or g
  misc_feature 321: k=g or t
  misc_feature 322: r=a or g
  misc_feature 334: n=a, g, c or t
  misc_feature 335: k=g or t
  misc_feature 338: r=a or g
  misc_feature 349: k=g or t
  misc_feature 350: s=g or c
  misc_feature 354: w=a or t
  misc_feature 361: k=g or t
  misc_feature 375: k=g or t
  misc_feature 376: n=a, g, c or t
  misc_feature 388: r=a or g
  misc_feature 401: k=g or t
  misc_feature 402: y=c or t
aactcagcctaccgacaggcactgtgcagattcaagcggagagatgtccaagcagtgaggccgctgctgcaccggccatcctgagcccctactcggccttcccgtctccgcttccccgccccgcactaggaccccctgcrgatgatcagggcggcaggaggtgatttccttcctcttttggcaacatggcgggcggagaagctggagtgactctagggcagccgcatctttcgcgtcaggatctcaccaccttggatgttaccaagttgacgccactttcacaygaagttatcagcagacaaagccacaattaacatargkrcaatttgtcatnkaarttctcctttgksccawttaacgkaataacatttgtgknaactcattctcraaactggtacctkycagcttgccttagtaagctaagtactctgaatacagactaactgtggt

SEQ ID NO: 10607 - DNA, 271 bp, Homo sapiens
aggaaaacgaaatacacattatgaaacttctatcactcctaaagaaaggggaaaacctattaaaaatgaagctcttatttactaatgcatttctatttcaggagcattaggctaaactggggacaaaaaacaaaaacttgttcttaattaacaaaagaactagaaagaagctcatatgaaagcaccaccttgtgttcagtaagcttcaggatagctctgttgacagcagggcatttagagagtcccaagtatagtcatgtatcactgggga

SEQ ID NO: 10608 - DNA, 143 bp, Homo sapiens
ggaagttttaacagttgaaaaatgacccatctctgattcaaggctttgacaacaagagccaggagaatttgggagatagagttatcatttataattaatatatcattaattctttctaactatgatgctagactcattgccca

SEQ ID NO: 10609 - DNA, 442 bp, Homo sapiens
  misc_feature 323: m=a or c
  misc_feature 324: w=a or t
aaaattgcaggtaataaatagcaggattaagcaagaagttaagtatatattgaattatagtaaataatgggtttggttttcttaaatctattttgatgtcattgggattttgacacaaaaacaaagaaaatggcatcattaagtctgatttgggactaaatagtagctataattcaaacatatttagcttctttagtgtaattgcaagaacaaatgaattatatcaccatttgaaggcagttcttaaagcaggttatcttaagaggtatagataatttttattaacaaatggagaaaaatgagacaactatgttttcataaamwtttactagggattttgatgataccgtcttctgtctggattgcaaggggttaagagttaaaatggtgtgtgcagctgtaacactggagctattttatctcttaatgacagttaaggaga

SEQ ID NO: 10610 - DNA, 353 bp, Homo sapiens
  misc_feature 226: n=a, g, c or t
  misc_feature 227: m=a or c
acggcgtttccacggacgcccaggagacagcccgttgctgagccgggagcgctgactggcccggctgggcaggtcttgactcgtctgctgaacaaatcctctgacctcaggccggctgtgaacgtagttcctgagagatagcaaacatgcccaacagtgagcccgcatctctgctggagctgttcaacagcatcgccacacaagtgggagctcgtaaggtccctcnmagcgggaaatgcgtcaaaggatgaaattgattctgcagtaaagatgttggtgtcattaaaaatgagctacaaagctgccgcgggggaggattacaaggctgactgtcctccagggaacccagcacc

SEQ ID NO: 10611 - DNA, 248 bp, Homo sapiens
tagggaagaaaaatgaggaaagaaacctttagaatacagtttggtaactgatgtgatattctgtcttatatgcatagaggggatggtgcttaaaccaagtcttaaagtatgtgtgtgggttatcctagtaaaatatcctagtggaaaataatattccatacagggggaatattatgtgcaaaggcataacacacatgcacacacatattgtgggactcaagtcacgtttggtaaaactgtagggtgag

SEQ ID NO: 10612 - DNA, 382 bp, Homo sapiens
  misc_feature 38: s=g or c
  misc_feature 39: s=g or c
  misc_feature 111: k=g or t
  misc_feature 348: w=a or t
  misc_feature 376: s=g or c
aggacgttcggtcccgcccccagctggcggccgcggcssccgcgcgccaagttcctcagcccttggctcctgcccagtgtttagggtgttggcggagacaaaggggaagaktcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagwaggtgaaaagggcaggggcgtggctctsggggcg

SEQ ID NO: 10613 - DNA, 292 bp, Homo sapiens
  misc_feature 38: s=g or c
  misc_feature 39: s=g or c
aggacgttcggtcccgcccccagctggcggccgcggcssccgcgcgccaagttcctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggtgtgtttgtagttgctgctaagcgaacgccctttggagcttacggaggccttctgaaagacttca

SEQ ID NO: 10614 - DNA, 339 bp, Homo sapiens
ctttccatcatgtgacaacacagtgagaaaatggctgcctgtgaaccaggaagtaggccctcagcagacaaggaatctcctagcaccttgatcttggacttcccagcctccagaactctgatggactgctcacaattccctgaggcaacgctattatatcaaaaatgaggttgtgagagctaactgattcattcaaaatcaagttaaaggcagagctggaattgaaggagttgttcttaagaagaggaaattcaaacacacagagatactaaggatgacacagacagaggaaaaaatcacgtgaggacacagcaagaaggtggccatctgcgagtcatg

SEQ ID NO: 10615 - DNA, 352 bp, Homo sapiens
  misc_feature 126: r=a or g
  misc_feature 130: r=a or g
  misc_feature 153: r=a or g
  misc_feature 192: r=a or g
  misc_feature 198: k=g or t
  misc_feature 250: r=a or g
  misc_feature 282: r=a or g
  misc_feature 306: k=g or t
taggttttaatgagatggtaagggatgcatgatcggtcaccaaggagggagtagaggtatcctatacttgtaggttaaggtgggggatatgagaggaggaagtgaaggaggctttgaactgggggraaargttggcaatgaggtgtggctgtrgcctaggaatagttagggaagcagataatttagttaaartgtcckgcctaataagggaactgggcaggtggggataactaaaaaggagtgcttaaargagtattgtctaagttggcaccagagttgggragttttaagaggtttagaagcctkggccatcaataccctacaacagttatggaggcaagggaaacaggcc

SEQ ID NO: 10616 - DNA, 437 bp, Homo sapiens
agtgctggggagcagggaggtgggaggggagggtgcccctacaaatcccgggggctagagcaggccaggtcatctttgggtggtggagtgcaaaggaggcgacctgcaacagaggagtcccggtcaccagcaaccatgacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccttaccttacactgaaattttctgttgttttttttaatcttaccttttggattgaacattttgtttcctttttctaatttcctttttatccctctgcttatttggaagttacactctaactacttcattagaagttactctaggtat

SEQ ID NO: 10617 - DNA, 507 bp, Homo sapiens
  misc_feature 443: k=g or t
cttccacgttgtctcctccacctagcagttggttggcaaccccttcctcagtccccggctgaaaaccctccagtcagcgcttatcccttctgctctctcccctcacccagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatkacccagatatggaaacagaagacaaaattgtaagccagagtcaacaaattaaataaattacccc

SEQ ID NO: 10618 - DNA, 174 bp, Homo sapiens
aaacagttcagtctttgattggttgctgagaggcggggctactcgactgctctggaggtagcggccgcggtgaggagagccatgggacgggcagtcaaggttttacagctctttaaaacactgcacaggaccagacaacaagtttttaaaaatgatgccagagcattagaagca

SEQ ID NO: 10619 - DNA, 250 bp, Homo sapiens
taatattcattgttgagaaatggacattagatttacaaaaaaatgtgaggcgggatggtgtaaattaagaaagtagctggctaggtaatttggaggtttctgatgaggaaacttgagggaactcactttatgtagactcagtatattcccactcaaaaagaagattaaattattgctgctttggagcttactggaagcagagggtagaagaacagcaggaaacacaggaactcatttcttctctctatag

SEQ ID NO: 10620 - DNA, 424 bp, Homo sapiens
  misc_feature 351: m=a or c
  misc_feature 401: n=a, g, c or t
  misc_feature 402: n=a, g, c or t
  misc_feature 422: w=a or t
agaaggctgtgcgtgctcctcgctttctccgcggtcttccgagcggtcgcgtgaactgcttcctgcaggctggccatggcgcttcacgttcccaaggctccgggctttgcccagatgctcaaggagggagcgaaacacttttcaggattagaagaggctgtgtatagaaacatacaagcttgcaaggagcttgcccaaaccactcgtacagcatatggaccaaatggaatgaacaaagtttgtgccatctccaacttcttgctcttgcatatgagaagccattacaatcatttttgcagcaggatgctgtacttctagttctcttaaaatagttgctgcatcgtttgtcamaaacaacttctccaagtggttgataaccattttgttcattccatttggtnnatatgctgtacgagtggttwgg

SEQ ID NO: 10621 - DNA, 384 bp, Homo sapiens
  misc_feature 7: n=a, g, c or t
  misc_feature 180: y=c or t
ttatttntactttcttgatctcctcttgttgcctgctaatcagggaaataaagaaaaaagtgaacagacaaataaagaagcaaaggtcctccccagtcagctctgaagatacctatgctctgtgctccccgttgatctagcgaggccttcaaaaatgatttagcccactaggagttctcyagttcttaggataagcatttatgcccaaattgccattatagtgattttctgtgctctctagtctgtggcattgtatttttatcatccaagcaagtgattagtggaatctattcatgctttatctgtggcaaactcaaatttacattctttcccagcttgagggctgtatagttggatggagtgtagagctacttataaagggcc

SEQ ID NO: 10622 - DNA, 273 bp, Homo sapiens
ccaaaaagttaaaaatgcagctatcactttccacatcctgaaaacaagggaatgtaccgagatttgcacaattaaccatgcttttttaaaagcattctctccagcaattgatgacttacattcttggctcatttggactgggtggctctccatggttctgtcttgtgaggagggagtggaagcaagtccctgtggacacctatgctacgcaacatcctttcaatgctagaatagtaaaagttacattaaaatatccaaatttttcaagaccca

SEQ ID NO: 10623 - DNA, 163 bp, Homo sapiens
ttacttctcagaccagcagaagaagcattactttggagctggttaaaaatgcaggtttttgttctctgtctcagacctgctaaatcagaaattctggggctgggacccagcaatgtgtgtttgtaaggagttctctagagaatttttatgcgcacaaaagatg

SEQ ID NO: 10624 - DNA, 476 bp, Homo sapiens
  misc_feature 13: s=g or c
  misc_feature 347: y=c or t
  misc_feature 357: k=g or t
  misc_feature 366: s=g or c
  misc_feature 402: y=c or t
  misc_feature 427: n=a, g, c or t
  misc_feature 428: n=a, g, c or t
  misc_feature 429: k=g or t
  misc_feature 436: k=g or t
  misc_feature 438: n=a, g, c or t
  misc_feature 439: n=a, g, c or t
  misc_feature 440: w=a or t
  misc_feature 468: w=a or t
gatgaaagattasaaagtagtcttcagattgctacttacctgttaaccagatgttaatgtttcagtggctaaaaaatagggccacttttctcatttatactcttaaacttgagtagttcttttaaccttatttaggtcatgaactcctttagaaacaatgacttgagaaaaaaatgtttttccttagaaaaattgcagtgttcacacacatgctttcatgtttagttttatagcattcgtagatcaccctacagggattcctaggcttctttttaagaaccagtaaccagtcaccccgtggaacttaaactgtttttcttttgaaggataaaaaagatacccaataytttttttttkgagctgacsgttgtatagaaaaggttgtccactctgacctatagycatttcagtctagtttagtgcagannkttttttkgnnwacttaccctgtgccctggcactgtttgwagcactga

SEQ ID NO: 10625 - DNA, 308 bp, Homo sapiens
cattttatcaaattattgcttttttattttataataaggcttaagacagattatagacctccttaagagatgagtttcttcttctaaaaatgcatgttgatagaggactatttaggctaattggaggaatcattaagaaagaaagttttaacactgtttatccctatctgctttccttgcactttttctgtgagaaatattttctgtttgcaaaatcttccctgagttctgaacccagcaccatcagtaccaaagtcttatgcaatatgtatttattatgctcctgaaataggcctcttcttgatgag

SEQ ID NO: 10626 - DNA, 188 bp, Homo sapiens
  misc_feature 59: r=a or g
  misc_feature 128: w=a or t
acgtaatcgccgagggcacgtgcatgccccctggttaagagttgcaggtagcggtagcratggacactctggatcgagtagtaaagcccaaaacgaaaagagccaagagattccttgagaagagagawccgaaactcaatgaaaatattaaaaatgccatgctgattaaagggggaaatgcaaatgca

SEQ ID NO: 10627 - DNA, 304 bp, Homo sapiens
attatttcgccccggggcggggggagcgcgggtcggggcagagggtgcgccggagctgctctctgattcaggtggtcacccgttttcatcccaggtatctcgctaaaaatgcccctgattacaccgagtactgtgcgcttgtttgacttttcatcaatggcctaaaagttaagcggccccgttgcgccggcaggtgcagcctcatgcagttgcagccgcagtagagctagggccctgatgaggcaggcaatggtgtgcgaaaccttcagcgattaggagtacccagtggttcttatttagcgga

SEQ ID NO: 10628 - DNA, 307 bp, Homo sapiens
acagcacctagggcagggaagagaaagaaaaatgccggcacaaacctcagtggtggttctgtggttgtttctgtctttttttgatagaatctttgattagtatcgaatttactgtatttggccatgtgaactattgggagcctcctagggtgagggaaattaagagctttcagaggaatgaggcgactgatttgcaaacggatctgtgattataaaagcttcgatgatgaagaatcagtggatggaaataggccatcatcagctgcatcagccttcaaggttcctgcacctaaaacatccggaaatc

SEQ ID NO: 10629 - DNA, 383 bp, Homo sapiens
  misc_feature 192: k=g or t
  misc_feature 193: n=a, g, c or t
agccttctggatgatgatgcgagagggaagattttacattgcaaagatcaatgtattaaaaatgccgtgcaggtagttcatagccaagagccttgctcgtgttggaggatgcaacggaggagagaggcaggagcaccggcagccagctgggggctgacctgattccctagaatcctcagctcccttcctctknctttcgacgtccttccttccctttttctcctctcccccctcccccgctttcccttctccagataagcagctccgggaaacaaagaatccggggctctccagacatcagagcttaaacccaggactctgcaagcggcatctcattccggggtccagggctctcccggctctccatcccctccctaacctcc

SEQ ID NO: 10630 - DNA, 522 bp, Homo sapiens
  misc_feature 260: k=g or t
  misc_feature 330: k=g or t
  misc_feature 352: k=g or t
  misc_feature 379: k=g or t
  misc_feature 425: r=a or g
  misc_feature 427: k=g or t
  misc_feature 445: r=a or g
  misc_feature 446: k=g or t
  misc_feature 450: k=g or t
agggaagtgagtgaagatgcagggttttaaaactctctgaagtttttatttacccagcgctctggctcccacttctgttttaaaagattataagtaaatactctgctctttcaagtgaaccaaacctatcaaacctgtttagaaaataaaccaggtatgtttctttctcttctttcttttccgcctctgtgtgtgtgtgtgtgtgtgaaatttaccatccatgcaaaagtttaggactagtgtttggggaactgagactktcagaaaaatgcctctttatgccactcaccttatggggctgatggagagtccacgtaaaggataaccgtktcctcaaaggatttatgctgtktcacctccatcaagaaaagggcttttkaaagttaaggtaaaattttaagagaaaagatttcgtaccaattgartkaattactctttaataccrktttktccttgagtatcacatatattggtggataccacttgggaggctcgtggagtctatttggtgaaggcagcagc

SEQ ID NO: 10631 - DNA, 395 bp, Homo sapiens
actagaagccagctgctgggagactgaaaagtgaaagtaaatttaggtccttcacctgaacctggtggtgggtcaaacgcttccacatggacacctgtcagtcccactggagtgtaggtctggccagagacctttagttgtctctgtgctcagatgttggccaccaaggatcacaagttgggaaagagaatggagaggattccctgtaaggagagagagtccttatatgggccaccaaaatgtcatggactttcttgcaaaaatgcctgtttgggattcctcagagtacagacaaaaaggaaggcttgatcagcatgtggtggatctgaagattcaaagaattgccgcggctcaaaagtagacattttggtaaatgtgaagagtgagattcaatg

SEQ ID NO: 10632 - DNA, 208 bp, Homo sapiens
tttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccag

SEQ ID NO: 10633 - DNA, 229 bp, Homo sapiens
ctgataaaaattaatggataagaagagaatatttttccttatagcttggtgccaactaataaatgtagaaagaatgacagaattagaaagttctccttttcttaaccactttagtaataattgtttcaggcacaattataaaaatgctaagactgatcaaaagtttggtgagaaataagatgtttaaatagtctcaagaatctgcatatagatacttaactaattataa

SEQ ID NO: 10634 - DNA, 336 bp, Homo sapiens
  misc_feature 214: k=g or t
gtatagaaaatattaatgcctagcacagtagctgggaaaatataattttgtgtgtgttaaaaatgctgctgtgatagaaccactaataaaatccctgccctcgacttgcttcttagtcttacttcagaaactgcatgcttttcgttatgaataaatggttcatgtgaaatttaatacaagacatttatagttctatgacctgagaatttgtgakccttcttgcccacattttgaggtttcactctgacattgaaaaaatcagttattttataaatgctagccaacaaaaatggcatgcatattttcaccagcaactaaatttgattatagcacagc

SEQ ID NO: 10635 - DNA, 333 bp, Homo sapiens
catagagacttttaagttgaattttaaaacttgcttcccttatttgtgaacttagcatttttttcctcctaaaaatgcttgtaaaatgtttttaaaatgctttaaaaatgttttcaaagatagatgtggttaaacaggaatccaagttaaaaaaaaagtgtgcctgatgcagtgggtcatgccttaatctcaccgctttgggaaaccaaggtgggaggatcgtttgaggccaggagctggagaccagcctgggtaacatagcaagaccctgtctataaaaaattgtttttttgccgggtgcgggctcacacctctaatctgagcactttggaa

SEQ ID NO: 10636 - DNA, 436 bp, Homo sapiens
  misc_feature 413: k=g or t
gtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtktgctttttcaagtggagaatatg

SEQ ID NO: 10637 - DNA, 174 bp, Homo sapiens
attcctgggcgaggatcctctgccttgcacgtgtggttttgtgctgcattggctttggaatcagtaaccaatccctgtcctcgtactccttgccgactcaggaaaaatggaaattaacaagagctataaagtaatacagaaagggacagtgctcccatctatgattaagtgcac

SEQ ID NO: 10638 - DNA, 318 bp, Homo sapiens
gaaggtggcagaaagtctcatttcaggaaggatgaacagatggaaggaaaaaaggaaactcaaagagggagagaaagcaaagaaaaggaaaagaaaaagaaaataaataaagctgacaaatcctgacaccttgtgatttgcctacaacaaagaatgaaaatcatccaaataagaagcaaacttccctgacttttgttcttccaatagaacagacagcttttactgatataaattttaaaaatggaaattaagggctacttatttcttctcatttctttttgagggaaaaaaatcatgcctcaaattggtaatgggtag

SEQ ID NO: 10639 - DNA, 276 bp, Homo sapiens
  misc_feature 70: w=a or t
aaaaaaaaccacatctctgataatttgctcattcatttagaatgctttctatgacggaagttacggcgawaggttttggaatgtggagggtgatgggaactccaaggatataaggcatgggaactctacgaatataaggcttgggaactttttagaaatgaagttttgttttgcactgtcatgctttccaggataaagcattactggagattagctgaacaaatgagatgaaagccaaaatatgcagttggatattttagataaattttgataaga

SEQ ID NO: 10640 - DNA, 420 bp, Homo sapiens
  misc_feature 374: w=a or t
  misc_feature 375: m=a or c
ttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtawmataaaaccaaagaatagtttggttcttcaaatcttaagagaatcc

SEQ ID NO: 10641 - DNA, 614 bp, Homo sapiens
  misc_feature 454: n=a, g, c or t
  misc_feature 607: k=g or t
tggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagtnatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaagttkggtgtct

SEQ ID NO: 10642 - DNA, 469 bp, Homo sapiens
  misc_feature 160: n=a, g, c or t
  misc_feature 161: n=a, g, c or t
atagtacgccggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatnnattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaa

SEQ ID NO: 10643 - DNA, 249 bp, Homo sapiens
  misc_feature 152: m=a or c
  misc_feature 153: s=g or c
actaaactttactttcatgttagaaagttttgtgccatgtagatttatggaaaatgtgcttaattgcctctagaaaataatgaagaggcttcgtcacctccatagaagatcctgtgacactagcctaattctgacacatggctcctgttttmsattttgtttgtttttttatgctgatcctctctccagagatgtgatgtggattgattaacttgtaatataaagttctatggtttctgaaaatgcaga

SEQ ID NO: 10644 - DNA, 193 bp, Homo sapiens
ttaactgagggaatctgaaaatatttttaaagaaggaaagatttaaggtggtgcttggaggatgggtaagtttcagtagattaacatagggattctagacagagggtcaccctttacagggtttgaaactatgagggtatatggattttggaaaaatggcacatacgtaagaatgactggagaataagtaggg

SEQ ID NO: 10645 - DNA, 488 bp, Homo sapiens
  misc_feature 364: m=a or c
  misc_feature 384: r=a or g
  misc_feature 391: n=a, g, c or t
  misc_feature 392: n=a, g, c or t
  misc_feature 393: n=a, g, c or t
  misc_feature 395: y=c or t
  misc_feature 401: w=a or t
  misc_feature 404: w=a or t
  misc_feature 409: k=g or t
  misc_feature 412: y=c or t
  misc_feature 422: n=a, g, c or t
  misc_feature 457: m=a or c
  misc_feature 467: r=a or g
  misc_feature 484: y=c or t
atagttctcaagtttgaattatcagtatattattacaattttgtatatcagaatcttaagtgttacaggtacaaaaagaatattgctagccaaatgaacaaagtttagctaaatctctgtagcatgcaaatcaaataaattaaaattttttgctattgctttatctatattgtcttaaatatcaaaagctcaggactgaacttaatatttaatcaggttaaattctgaacatgtttctgttttaatttgtcttgtttgtaaacgtatgcaaatacatcacatagattaactggtttctgcactttccatgtgtttgtgggtggaaaaaaattcagtggtttttttttaaaaaaaaaagcaaaamcaaagctacatattgcctartactctnnntycagtgwcgwttatkgtycagtttattnccctgattggcacaaacacaagagtttccttgaamcatgtaccargcaaatacaaaatattycatg

SEQ ID NO: 10646 - DNA, 493 bp, Homo sapiens
  misc_feature 2: s=g or c
gstttgaccgggtcgtggcagccggagtcgtcttcgggacgcgcctgctcttcgcctttcgctgcagtccgtcgatttctttctccaggaagaaaaatggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaagggctagacaggattgaggagagactgcctattctgaatcagccatcaactcagattgttgccaatgccaaaggcgctgtgactggggcaaaagatgctgtgacgactactgtgactggggccaaggattctgtggccagcac

SEQ ID NO: 10647 - DNA, 327 bp, Homo sapiens
  misc_feature 235: b=c or g or t
acgagaaggggagggggcccagccctgctttgggcaatccttgctctgaccactcagacaccgtgtcctcttgcctgggagaggggaagcagatctgaggacatctctgtgccaggccagaaaccgcccacctgcagttccttctccgggatggacgtggggcccagctccctgccccaccttggggctgaagctgctgctgctcctgctgctgctgcccctcaggggccaagcbaacacaggctgctacgggatccctggagagccaggtgaggagggcagatacaagcagaaattccagtcagtgttcacggtcactcggcagac

SEQ ID NO: 10648 - DNA, 244 bp, Homo sapiens
acgagaaggggagggggcccagccctgctttgggcaatccttgctctgaccactcagacaccgtgtcctcttgcctgggagaggggaagcagatctgaggacatctctgtgccaggccagaaaccgcccacctgcaggaatcccagccattcccgggatccgaggacccaaagggcagaagggagaacccggcttacccggccatcctgggaaaaatggccccatgggaccccctgggatgcca

SEQ ID NO: 10649 - DNA, 345 bp, Homo sapiens
  misc_feature 217: s=g or c
  misc_feature 306: n=a, g, c or t
  misc_feature 331: r=a or g
acagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggasattcgggagcccgctctgcgagatgcgcagtggacttttgaatcagctgtgcaagagaatatcagcattaatgggcaagcatggcaggnaagcttcagataattgttttatggrttctgacatcaaag

SEQ ID NO: 10650 - DNA, 140 bp, Homo sapiens
agaacacagcccaaactgcagacggatcacactgaggtgttcacagaactgcaggagaagtatggggagattgaagagatgaatgtgtgcgacaaccttggggaccacctcgtgggcaacgtctatgtcaagttccggag

SEQ ID NO: 10651 - DNA, 284 bp, Homo sapiens
  misc_feature 8: m=a or c
agcagccmgacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctc

SEQ ID NO: 10652 - DNA, 451 bp, Homo sapiens
  misc_feature 10: r=a or g
  misc_feature 204: s=g or c
  misc_feature 237: k=g or t
tcgttcagargttgacgtcagcttcggagacagaaattacacactctacggcgaggggtcgggttcaaacttagtgaaaagccgcggagaggtgggctaagggttggtgagccacaaatctacggcgtccggcagcagccaaatttgataataacgaagaaaaatggctgcgtcgcttctcctcctgtgatatgcagctatctstggaattagcgaagaaagactgaaactctcgtktcctggctcccacgctggttttgcggcgacaccaatttacctttaatacctttaatctcgggcatccctccctcaagccctatctctgccatttctcccatgctaatgcagtggcccgcgcttgattctgagggtcaggagcgtcccaagcctgcggaacggcctcacgacctctggtcatgccgagtccagctgctcagcctcccggagcccc

SEQ ID NO: 10653 - DNA, 368 bp, Homo sapiens
  misc_feature 178: w=a or t
gtcaaactcccgcagacttctctgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccaccwctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagtcc

SEQ ID NO: 10654 - DNA, 229 bp, Homo sapiens
  misc_feature 37: r=a or g
aattccgcgcgatgacgtcactgcaaggcgccggggracacgttggctgcgttttcggcgggcttcccgggtacaaaaatggctgtggctagcgatttctacctgcgctactacgtagggcacaagggcaagtttgggcacgagtttctggagttcgaatttcggccggacggaaagcttagatatgccaacaacagcaattacaaaaatgatgtgatgatcagaaaag

SEQ ID NO: 10655 - DNA, 302 bp, Homo sapiens
  misc_feature 37: r=a or g
aattccgcgcgatgacgtcactgcaaggcgccggggracacgttggctgcgttttcggcgggcttcccgggtacaaaaatggctgtggctagcgatttctacctgcgctactacgtagggcacaagggcaagtttgggcacgagtttctggagttcgaatttcggccggacggtgagaagaggcccacggcacgcggtgctgggaaaggggagcgagaccgagaggccgggtggtgtggagggtacaggcggcggaggccactgcttccctcgaaggaaataggagcttaagaatagaggag

SEQ ID NO: 10656 - DNA, 296 bp, Homo sapiens
aggcgcgtgacgacggcgcacttacggcaacccacgccttcgacgtggcgttttcttcggtttcacttccggtgggaaggatacgagcaagataaagcagcgagggatttaagtctggcaacagttggactgctggattttcagagaagtgttccccaaagcaaattatagtgctaatttccaatgttccataagcgtggcaagaaaaatgggaagttctcggtaaggtatatagtattatttctagaaataaagatgaaccaatccaatattgattttttgtttgtttaatcctg

SEQ ID NO: 10657 - DNA, 350 bp, Homo sapiens
tgcttcatgagatatggcaaaaatgggatcattagtaaagttgaccttcatttgtcactaatttgagtcaaacacattgttctgaattgtcaggagccaggatgaatttttcaagacttcccaagcagtgagattgaaggaagcttgtaattattgaaaggctgttgtctcaggcccctggttaggcacttttcttatctaatcctcaaaatcacctgagaaggaggtattcttaaactagttattacaggtagggaaactgagcctcaaagtagctgcagtgacttggcagagaacattcacagagctggtcagagccattgccagggttcaagcccacatcatcccac

SEQ ID NO: 10658 - DNA, 186 bp, Homo sapiens
  misc_feature 158: y=c or t
  misc_feature 167: y=c or t
agcgtgtgcagcggcggcggcggaagtggccggcgagcccggtccccgccggcaccatgcttcccttgtcactgctgaagacggctcagaatcaccccatgttggtggagctgaaaaatggggagacgtacaatggacacctggtgagctgcgacaaytggatgaayattaacctgcgagaagtca

SEQ ID NO: 10659 - DNA, 340 bp, Homo sapiens
  misc_feature 12: w=a or t
  misc_feature 150: y=c or t
tactgaaaacawacacatttaaaattggtttacctcaggatgacgtgcagaaaaatgggtgaaggataaaccgttgagacgtggccccactggtaggatggtcctcttgtacttcgtgtgctccgacccatggtgacgatgacacacccytggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttc

SEQ ID NO: 10660 - DNA, 221 bp, Homo sapiens
tgggggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggcg

SEQ ID NO: 10661 - DNA, 418 bp, Homo sapiens
  misc_feature 393: s=g or c
  misc_feature 401: r=a or g
  misc_feature 404: m=a or c
  misc_feature 416: s=g or c
agagttgaaattctgtatttttgatgcccataatcaatacatctctacataaaaatggtataaagaaacccaagctgggttgtggttgtcattccctcttccttctaagatcctggcccaactccaggaaagaactaatgtgaaagtaaagagcctccagagtgctccaggcttctctctacccccgtgggctgaggcaagggtagtcagcaggaggagaaaggaggtctgccttccagactctccagacaccactgctcaagtcacctactacctagcatgcgtgccactgcttcctgatgcatccaggagcttctggagtcactgtggaaccctgtcactgagatcaacctgattttgtttgtttgttctcattcgtagggcttactgggscacactgrtamcgtcaactgcgsca

SEQ ID NO: 10662 - DNA, 141 bp, Homo sapiens
tgaagtctcggttaaaataaaatttctttgctatctcactcctaggaagttatggagttcatattttcaaaagatatgttaaaaatggttacacactctgctggccacattaaaaattagaagactcatgttaaattatct

SEQ ID NO: 10663 - DNA, 524 bp, Homo sapiens
  misc_feature 465: r=a or g
  misc_feature 471: n=a, g, c or t
  misc_feature 475: r=a or g
  misc_feature 488: k=g or t
  misc_feature 491: m=a or c
  misc_feature 497: y=c or t
  misc_feature 510: k=g or t
ttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacrcgaaanacaragaaaaaaatgcktgmgctttytctaacttccccktgcagtctgttgtg

SEQ ID NO: 10664 - DNA, 101 bp, Homo sapiens
  misc_feature 62: r=a or g
tgtaaaaatgtaaagaaataacttgcatctggaaaagaaatgcacactgaagcatttatacrggcttagttcaaaaatgctgtcctttttttttttttttt

SEQ ID NO: 10665 - DNA, 135 bp, Homo sapiens
ctttattgagaaagaggaaagaatgaattgaaaaatgaatactgggatctttagaagaagaatgtaggaaaaatgtacaaaattgacttgacttctccttggacccaatttagaggttttataagatagaagagc

SEQ ID NO: 10666 - DNA, 113 bp, Homo sapiens
gtaaaaatgtaggattgcatttttcccccaaaaggaatatgttttacaattaactcaccgtataacccaaatagattaacaaaaaatgtgtgtgtgtgtgtgtgtgtgtgaac

SEQ ID NO: 10667 - DNA, 243 bp, Homo sapiens
gagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaaggtatgagcatacccccttc

SEQ ID NO: 10668 - DNA, 244 bp, Homo sapiens
  misc_feature 214: y=c or t
gagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtyaacctgcaagagtttcttaatgtcacgagc

SEQ ID NO: 10669 - DNA, 244 bp, Homo sapiens
  misc_feature 34: r=a or g
  misc_feature 51: s=g or c
agcagtaagttccagcgcagtagaccgcggggtrgtcggcgcgaggcggasttggcagttccgtccacttcagccgcagcgtccctcgccgggtgtctcgccgcagcctccggagaggaacagaccctcactctctctgtcagaaaaatgtctgctccagctcagccacctgctgaagggacagaagggactgccccaggtgggggtccccctggccctcctcctaacatgaccagtaacagac

SEQ ID NO: 10670 - DNA, 204 bp, Homo sapiens
attcctagttaaggcggcacagggccgaggcgtagtgtgggtgactcctccgttccttgggtcccgtcgtctgtgatactgcagcgcaccatggcagaaccgcagcccccgtccggcggcctcacggacgaggccgccctcagttgctgctccgacgcggaccccagtaccaagccacagagtgactttatatatgttcaacag

SEQ ID NO: 10671 - DNA, 379 bp, Homo sapiens
caatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttagg

SEQ ID NO: 10672 - DNA, 207 bp, Homo sapiens
taaaatgctaaggtaggtaaaaatgtgccacacttcttaaaattgttgcttttacctaaagggttttccatgccatacttactattcttggtttttgtttttttgaaatgaaatgctgtatgtacagtgtgagctgttctctaagcatgattttctactactggtagatgatgagtcagtcttcaccactgtcatcacctaccccac

SEQ ID NO: 10673 - DNA, 461 bp, Homo sapiens
  misc_feature 58: r=a or g
  misc_feature 105: k=g or t
  misc_feature 114: y=c or t
  misc_feature 119: r=a or g
  misc_feature 121: k=g or t
  misc_feature 123: n=a, g, c or t
  misc_feature 127: r=a or g
  misc_feature 132: k=g or t
  misc_feature 142: m=a or c
  misc_feature 391: m=a or c
  misc_feature 457: m=a or c
aagtcacatgagccaccaaaatggtggtgttcgggtatgaggctgggactaagccaarggattcaggtgtggtgccggtgggaactgaggaagcgcccaaggtakgcggaaatycgaartkgntatrggggktgatttctgmaccttcaaagtgttggcagactcttctaagatgatacctttaaaggagatttgaaaagttaaaacagctcccaagtccatgcaaggagcagtcgattaagtctccagttgctgtggaaagaggcggagagaacgtagatgacctaaattctagtcctcattatctgcagtttgttttctcttgtctccaggcctttgcacaggctttttcttcaacttggagtatttccctgcttctatccgtcccaamtcccctgccaaactgttctctttcggttattgatttaaatgtcacttcttccgggaagcttcccamgctt

SEQ ID NO: 10674 - DNA, 485 bp, Homo sapiens
  misc_feature 366: n=a, g, c or t
  misc_feature 399: r=a or g
  misc_feature 454: w=a or t
  misc_feature 473: n=a, g, c or t
aagtcacatgagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcataganaaaaattttgactatcttagaaaagaaatatartataagcaaggaaaactgtgttttcagaagctcactgattggcatagtttgtggwgttttctatcccagttctntggcttttacta

SEQ ID NO: 10675 - DNA, 167 bp, Homo sapiens
  misc_feature 107: w=a or t
  misc_feature 111: w=a or t
  misc_feature 146: s=g or c
  misc_feature 151: r=a or g
aagtcacatgagccaccaaaatggtggtgttcgggtatgaggctgggactaagccagggattcaggtgtggtgccggtgggaactgaggaagcgccccaagcttttwtgtwctgaactcccactgcgttgtggattcctgaggatsggatractgtatcttgattac

SEQ ID NO: 10676 - DNA, 313 bp, Homo sapiens
  misc_feature 47: k=g or t
  misc_feature 227: r=a or g
  misc_feature 282: w=a or t
  misc_feature 301: n=a, g, c or t
aagtcacatgagccaccaaaatggtggtgttcgggtatgaggctggkactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatatartataagcaaggaaaactgtgttttcagaagctcactgattggcatagtttgtggwgttttctatcccagttctntggcttttacta

SEQ ID NO: 10677 - DNA, 269 bp, Homo sapiens
aatttgaattagttgagaacctatgtttgtgcattttgaatatattgaggatattttcccccttaactctaaacattttgagttaacattttaaaagtacattttcaacatgcagaggttgagtgcccaataagtggcaggccataatgttcggtatggcaacacaaaaatgtgtaagagacagtttctgcttgtaggaccttctaagagtgggcaaaacaatacaggcttataagaggtagctacgaaaggcctaaaggagaggacac

SEQ ID NO: 10678 - DNA, 185 bp, Homo sapiens
aatgaagtaggcaggtatgttaagaatgctttgaaaaatgtgtgtagctataaaatacaagatggcagcaattatttttccttttacttctttaagtctcttgatcttcctcttgatcccagcaccaaatagaaactgatccttctcatttagatctccttcctacccttcgtgaacctcagccg

SEQ ID NO: 10679 - DNA, 142 bp, Homo sapiens
cactgtacttttgagcaaaatatagtacaaaaatgttactctttagtattagagaatgaataaagttttcccaaatagataggggatacagccagggaaacacaaagaaaaggtaattttggattagtgtaaatagattccc

SEQ ID NO: 10680 - DNA, 537 bp, Homo sapiens
  misc_feature 358: w=a or t
  misc_feature 536: r=a or g
cactgtgtatggtccgtgtagattgatgcagattttctgaaatgaaatgtttgtttagacgagatcataccggtaaagcaggaatgacaaagcttgcttttctggtatgttctaggtgtattgtgacttttactgttatattaattgccaatataagtaaatatagattatatatgtatagtgtttcacaaagcttagacctttaccttccagccaccccacagtgcttgatatttcagagtcagtcattggttatacatgtgtagttccaaagcacataagctagaagaagaaatatttctaggagcactaccatctgttttcaacatgaaatgccacacacatagaactccaacawcaatttcattgcacagactgactgtagttaattttgtcacagaatctatggactgaatctaatgcttccaaaaatgttgtttgtttgcaaatatcaaacattgttatgcaagagattattaattacaaaatgaagatttataccattgtggtttaagctgtactgaactaatctgtgra

SEQ ID NO: 10681 - DNA, 237 bp, Homo sapiens
aactttagatttagaatggttttagatttacaggaaaattgcaaagatagtacagagaatttatcaccaacgttttgaaatttgtttaaaaatgtttaggtttggggttctctttggggttatttgtggtgaccctgtactcttgtataacggctaagtaaaatatttcaagcagtagctggatctcagtctcctgtaatctgagtacactatatcagaaactcctctattgaagca

SEQ ID NO: 10682 - DNA, 266 bp, Homo sapiens
  misc_feature 214: m=a or c
  misc_feature 216: n=a, g, c or t
  misc_feature 253: r=a or g
  misc_feature 254: r=a or g
  misc_feature 255: r=a or g
tttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgmcntggaagactgggctagctctgtaggctcggagagctrrrggagggtgcca

SEQ ID NO: 10683 - DNA, 219 bp, Homo sapiens
ttattttttgagtaattaaaaatgttttcaagttgtattcagattgtctggagtttatcctcgtggtgtaggatggtaatgtaataaggacggggtctgtgttgtgcctttgagaattgtaagactcagcatttaccgagttctggaactcaccgtctccttggggagatagaaaagtaaatcagtaattgcattcaccttctgtcaccactatgacag

SEQ ID NO: 10684 - DNA, 100 bp, Homo sapiens
tcatggtctttgggaatattagtctgctccttattctctctttaaaaattaactatccgtgtaatttaatcatgaaccacacctcctaaggtttatgaaa

SEQ ID NO: 10685 - DNA, 239 bp, Homo sapiens
ttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggag

SEQ ID NO: 10686 - DNA, 161 bp, Homo sapiens
aagcggagtagcgagtcggcaacccggagttttcttgtttcaggggtagaaatatttctgtcatggctcattcaaagactaggaccaatgatggaaaaattacatatccgcctggggtcaaggaaatatcagataaaatatctaaagaggagatggtgaga

SEQ ID NO: 10687 - DNA, 335 bp, Homo sapiens
tatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagag

SEQ ID NO: 10688 - DNA, 494 bp, Homo sapiens
  misc_feature 444: s=g or c
  misc_feature 445: r=a or g
  misc_feature 450: m=a or c
gaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagaggtttgagcggtggtggtggtggcggctcccgtttccacggttgtgcctccgcagacgactacgtagcaagggggaggggtgcccttctctctcccagagtaggcagaggcgccttcctgatgcagatgcggggctttttgctttgttttttaaatcggcgaasrgtgcmcttcggcgattcgggcccccttctctgggaggatggtgttacgg

SEQ ID NO: 10689 - DNA, 470 bp, Homo sapiens
gaccagcacttccgggtgagggaggccgggccgcgagacgggaaggccctgggcaagaacgctgagaaacggtttgctcttgtctcattgtgtcgcctcccattcagctgaaatccgcaaacgccaagtggggccccggtgcctgctggcgaggcagggaatgggtgctggaagggcgcttggatatcactgaagccacttgctctggaagacggggaactggaggctcgcttatcccattcgctcgcagccgctccctgtaccccagccagtgccgagagggtgacaatgaagaacaagaaaaattactgaagaaaagctgtacgttatatgttggaaatctttctttttacacaactgaagaacaaatctatgaactcttcagcaaaagtggtgacataaagaaaatcattatgggtctggataaaatgaagaaaacagcatgtggattctgttttgtggaatattac

SEQ ID NO: 10690 - DNA, 403 bp, Homo sapiens
  misc_feature 68: r=a or g
  misc_feature 346: n=a, g, c or t
acactcgggtagggaatcttatgaacagaaccaggacagggaggctggccggaggttcctgcagaggragcgtcaaggccctgtgctgctgtccctgggggccagaggggttgcccagcatgcccactggcaggagagagggaactgacccacttgctcctaccagcttctgaaggctccaaagtccggaggtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatnccagtgaggtagagaaatcttgggacatagaagttcctgaagggtatgggattcacc

SEQ ID NO: 10691 - DNA, 490 bp, Homo sapiens
  misc_feature 373: n=a, g, c or t
  misc_feature 379: k=g or t
  misc_feature 433: n=a, g, c or t
acactcgggtagggaatcttatgaacagaaccaggacagggaggctggccggaggttcctgcagagggagcgtcaaggccctgtgctgctgtccctgggggccagaggggttgcccagcatgcccactggcaggagagagggaactgacccacttgctcctaccagcttctgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggtggacaaatcgccagagatgtggtgcattgtcctgttttcacttttggcatggntttatkctgagcctaccatgtatggggagatcctgtcccctaactatcctcaggcatatnccagtgaggtagagaaatcttgggacatagaagttcctgaagggtatgggattcacc

SEQ ID NO: 10692 - DNA, 315 bp, Homo sapiens
actcgattcctttggagaaaaattaggagaaagtctagagaagcaatgagggaaggatacaatttagctatagtctagaaagttagtcgaagttaactagggagggtgtgaggggcacggtgccatgtggggatgttggtgatatggccctgtgtgttatacctttgaaggtgacactgagccccaggtgacgccgcaccaccaaagaaggtgcttgtgtttgtcagacaaatacagccaggcctgccaccccttaggctccaaagtccggaggtgcagaaagccaggaccaagagacaggcagctcaccagggt

SEQ ID NO: 10693 - DNA, 228 bp, Homo sapiens
  misc_feature 91: w=a or t
  misc_feature 92: m=a or c
  misc_feature 113: n=a, g, c or t
aaaatttttaagtaaaaatttgtgttggaaaaattagtatcacctgtaaaccctaactaataattaacttcattgcttttgaagctgaaawmcaaatgcccaattgtgccagncacacagcaaatactggggaaagatgggaatctaaatattttaaatgaaactttcaccctcttcactaacaccactgataagcaactcagactcttcttctgtttctttttctat

SEQ ID NO: 10694 - DNA, 256 bp, Homo sapiens
  misc_feature 164: n=a, g, c or t
  misc_feature 231: n=a, g, c or t
ttttaagctcacgtttattttaataaacttcagtagatccttaaaacttctggtaagttgtttaatttttaatgtataattaagtaagtatttctaagtagttgcattttatttttgttttttatttctgtgttgggaagtctaagccctgatgaaactgcctngtggaccctgaccaccacccctgcagcacaagccccgcgtttaaaaattatagacccgtgctcactnagcagcacatacactaaaattggaa

SEQ ID NO: 10695 - DNA, 378 bp, Homo sapiens
taaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgcc

SEQ ID NO: 10696 - DNA, 335 bp, Homo sapiens
  misc_feature 304: s=g or c
  misc_feature 305: w=a or t
  misc_feature 306: w=a or t
  misc_feature 327: y=c or t
ccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatcswwgttgctttcctgataccagaytgtttccc

SEQ ID NO: 10697 - DNA, 189 bp, Homo sapiens
atgaattgttctaagtaaaataatttttggaacacaaatatttggcttctggttatataagccatcatcctcagacatagattttaaaaattatattagagtttattttaacttgtatcaaccataaaataaaaaagagctcaaaacatacacagttggaatgagaccttcattctgaaagcagcaagg

SEQ ID NO: 10698 - DNA, 205 bp, Homo sapiens
gaactaatctttttggatcattggtattggtagaagggattcgctatgttttctgccaccattggatctctgtataaagtttggctccactatcaaaatgcttagatagatgcctttgcaatagttgccaccctaggaatagctcaaaaattattaacttaatactggttacttaaattccacctctgttgcttggagttgtgct

SEQ ID NO: 10699 - DNA, 396 bp, Homo sapiens
  misc_feature 384: k=g or t
gcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccaggtatgcagtaatttatctcacttgtcaatataactctgtggcataaaatatatatagagagatgtgccagctaggtgttctttaagcttaattttgtatttaacatactttaaattagagtactttgtccccagaatgtattctttattgcagtkacactgttggac

SEQ ID NO: 10700 - DNA, 293 bp, Homo sapiens
gcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggttttaaatcaagatttaacattccaacacataaaaattatttatccaacagctcctcccaggaggattctctatgggaggatgcatggcaatgcatttagcatatagaaatcatcaagatgtggc

SEQ ID NO: 10701 - DNA, 384 bp, Homo sapiens
gcacatgcgcggcagctcccgctgctgaatagctgagaggcgcacccgggcggccagctgggctcggcagtgcagcggggttaggatggacgaggacgtgttgcaccctgaagagcctcatcatcgcctgctcttgaggttcacagatgatacctttgatccagaacttgcagcaacaatagacaatgcaggaatcacatgaacctgtccatccacagataaagtggtaaagaaactgccgtattagatacatgatggtatactcttcagccataaagcttcgggaaaccctgtcatccgcaaccacgtggagaaacctgtccatccacagatgaagggatcaggaagctctggtatatatactgaagggaaatgctttttggc

SEQ ID NO: 10702 - DNA, 301 bp, Homo sapiens
gcacatgcgcggcagctcccgctgctgaatagctgagaggcgcacccgggcggccagctgggctcggagtgcagcggggttaggatggacgaggacgtgttgcaccctgaagagcctcatcatcggtgagagtggggtgggcaagtccagcctgctcttgaggttcacagatgatacctttgatccagaacttgcagcaacaataggtgagcctgtgtttaaaaattcaatagaaatgtctaatattttcttgcctttgggcttttttatctaaatccttctaccttcctcttaccacgcc

SEQ ID NO: 10703 - DNA, 162 bp, Homo sapiens
  misc_feature 31: n=a, g, c or t
agcacagaccggagagcaccgcgaggcggantgcgttctcctctgcacagatttcggtggtactgcgaaggcggagcagagttctcctcagatgatgattattccccaccttctaagagacaaagaccaacgagccaccacagccaccagtcccagaacccg

SEQ ID NO: 10704 - DNA, 454 bp, Homo sapiens
  misc_feature 39: k=g or t
  misc_feature 50: y=c or t
  misc_feature 71: r=a or g
  misc_feature 73: r=a or g
acaagggcgggtcttcgccgacaccatagaggtgggcckttggcgacgtyagaggcgcgggtgttcggctrcrtcactggggcgctatggtgcctggagctgggcagttttctcgtcagagtggggactggtaagagcgacctccccgccaggtcctgtgtgttgccggctgaagaagggtagctgaaaaattcagacccagcacagtgtttatgttggtcaaaaatagaaaactatgtctggcgcggccgaggcgggaggacccttcaggccaagagcagcagcctagcaacatggcgcaaccccatctctgtagtcctacctcagccccccagctacttgaacccaaaggttcaaggctccagtgagctatgatcccaccacagcattccagcctgcgagattgagatgatgattattccccaccttctaagagacaaagaccaacgagcca

SEQ ID NO: 10705 - DNA, 121 bp, Homo sapiens
tataaaaattctaatcacagctccttctgcatgccttcggcacttcttatagcatccaaggcactgtgttgttgctttttaattttattttactttttattgaatagataatgcaccatgg

SEQ ID NO: 10706 - DNA, 593 bp, Homo sapiens
  misc_feature 107: y=c or t
  misc_feature 137: r=a or g
  misc_feature 214: m=a or c
  misc_feature 216: s=g or c
  misc_feature 240: s=g or c
  misc_feature 241: m=a or c
  misc_feature 366: y=c or t
cctagctaaaaccttgaactcttttcaaaacagtaagtggtagaataacaataatttcatactcatagttttaaaagaattaaacaactggatttgacagacatttycacaattttttgttgtcatgcaattttggrtacagccattctgcatggtttcacaaagttggcatagagaaatataagtttcctaagttgaaacggaagattataamasagggaaggagaatgagagtaagasmctggttaaagatgcaaaggatttccacttcttcattgttatgtaaatgtgtctgctttttaaaaagcacaatcactgaaaaatctatttggataatgccttcactctatgcaactatatctgacyacaggctgagcacccttaatccaaaaattctgaaatgctccaaaatgtgaaattttttgagtgccaacatgatgccaaaagtggaaaattccacacccgaccttctgtgacaggtttgcagtgaaaatgcaggtatacaacatgaagatgaggtcagggagtcatctaagacaaaaaccattgttaataaggcagatgactccatagggaacttttttttttttttt

SEQ ID NO: 10707 - DNA, 290 bp, Homo sapiens
attcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcagg

SEQ ID NO: 10708 - DNA, 255 bp, Homo sapiens
cctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggt

SEQ ID NO: 10709 - DNA, 477 bp, Homo sapiens
cacagtcccaaacactattcagcaactgtcatgcagcaggagaaggaggggctcttggcctctgacaggacaccactgtcttgcagttgtgtgtccccagtgcccagctccaatgggtgttcatagtttattttggggctcaggaaatagaacaggaaaaggccggaaagacagtggctccatatagacagaaagacaattaaaactgatatgactcttaacagaagtggcaagagcaggcaggatggaagtaatttattcaacgaattgtccaaatacataaaattgcactgatgtatggtgtagcggtgggacagtggaaaatttgatagttgtttccgttgtgtgaattactcagacaggatgcctttgtgaagtatgggggtttgtttaatgttctgacaacaatttagatcctgttatggttattgcagtgtaatgccgtagtaaaaattgaacatgacacacagcgacggg

SEQ ID NO: 10710 - DNA, 301 bp, Homo sapiens
gaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgcccctcctggagaatttaatgaggttttcaatgatgttcggttactgcttaataatgacaatcttctcagggaaggagcagcccagtaagtattatttatcatactaacctaactaaaatgacatgggaaaacgagagatgctttaaaagtgtgtgg

SEQ ID NO: 10711 - DNA, 239 bp, Homo sapiens
  misc_feature 230: n=a, g, c or t
agcttctagatgtttattagcttttatgtcatgaaatgttggagtctcagggttgctgattttctgctaatgggaaaaattgactaagtctttaaaatagtttgcagccttctcccacaggagacaagtgaaagataagtgtgattttagatctttcttgtccatagttgttttcagtggagtcttccattctgtatcttaccctaagatctggttcttccctccccatncccaccccc

SEQ ID NO: 10712 - DNA, 680 bp, Homo sapiens
  misc_feature 664: w=a or t
ctatttctttttaaatctcaaaggtgtgggattacaagtcctgtcttagtaataaacttttgcagataaaccctgagatggtataactgcatcctttcttggcaccttaaatcaaattaactaaatacttagtgaggagagaaaaggaaaacacagtttttttgcaacgtatctgactgggtgagaagccactgctgcagcataaagaaccgacgggaatctgggctttcccactctggaatgaaggggggaattacgggttggtggtcggcttcatgttaggaggacacccctccatctgttcacagctcagcctgtttccaatttaaagcccagatttcaatacaaacctcaatttcttttccccattttaaatgcaaagcaagacttgtgaatcatagtgtctctgctcctgggattcagaccaaatttccccccaaaattctcaggctatttgtttgaatacctgcttacagtggtacacaatgggcagctttgagaagaaaaattgataatcttcacggaagagtaatttgaatgaaattacacttgacagcctgtctccaagcaaacaagaggaacgagggagcctgagctaagctctgaggacttgcccaagccactgctgttggagcttcccaggaaaaaaaaaaaaaaaaaaaawaaaaaaaaaaaaaaaa

SEQ ID NO: 10713 - DNA, 320 bp, Homo sapiens
agtaggggaccaagcctctgcggcagtttcctgatcttctggatatgctgccacgctgtcccagggctggtggtgtcccctgacttgttcctctcctgactttctcagcctggagactgaaagctctctttggctgttggccctcccaggcagagtccactggctgttagggtgaaatggggctgatgcttcctggaatccaccagaagtatgcaaattgcaccatctctttcagctgcctgcgcctgcattccatcgaggattccgacaggtcttgctgtcgcccaggctggagtgcagtggtgagaatgaatgagccc

SEQ ID NO: 10714 - DNA, 184 bp, Homo sapiens
aaaaattgcaccatctctttcagctgcctgcgcctgcattccatcgaggattccgggtggaactaatcaaaagatacatctttctaagaagaggagaggacacagagagacacacagagaaggtgatgacaatgatgagaagacggaggcggagattggagtgatgatgcatctacaagccagg

SEQ ID NO: 10715 - DNA, 650 bp, Homo sapiens
  misc_feature 647: m=a or c
atagtggggtttctgtcaatctgtcctcggctgcccttctcatttgttgatgggacttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacmcag

SEQ ID NO: 10716 - DNA, 305 bp, Homo sapiens
  misc_feature 148: k=g or t
  misc_feature 149: s=g or c
  misc_feature 165: w=a or t
  misc_feature 184: w=a or t
  misc_feature 191: r=a or g
  misc_feature 193: w=a or t
  misc_feature 196: n=a, g, c or t
  misc_feature 201: m=a or c
  misc_feature 253: m=a or c
  misc_feature 257: y=c or t
  misc_feature 274: y=c or t
gcggatcggggaattctgctggcgctgcagctgcagaatggtcggcggtggcgggaagcgcaggcccggcggggaggggccgcagtgtgaaaaaacaactgatgtgaagaaaagtaaattctgtgaagctgatgtctccagtgacctksgaaaaagaagtagaawatcattataagctttcttwacctgargwttnctatmacttctggaagttctgtgaagaacttgatcctgaaaaagccatctgaattcmcttyctgcaagccttggactycaatttagttggtccttattgatatccttgc

SEQ ID NO: 10717 - DNA, 413 bp, Homo sapiens
  misc_feature 170: r=a or g
  misc_feature 346: n=a, g, c or t
  misc_feature 347: n=a, g, c or t
  misc_feature 352: n=a, g, c or t
  misc_feature 377: w=a or t
  misc_feature 378: w=a or t
  misc_feature 381: n=a, g, c or t
  misc_feature 396: k=g or t
  misc_feature 407: n=a, g, c or t
ttccatattcctagtaaatgatgcattactttggtatgttctcagatttgggtaaagccttcctcatgttctataaaaattggttaactgctggtgagcacatctcttgaagttttgatatgggttgcacaacatttataggactgatttggagagaccgacaataccgrgtgcagtcctcccttggtatctagttccaggacccctgtggataccaaaatccaagcaatgccctgcagatcatgggacctatgcatatgaaaagtcggtccttgtatttgagggttttgcatccctcaaataccatatgttttatttgtgtttggttgaaaaaagtttgcatatnngtganacttagcatttcaaacctgtgttgwwcanagatcatttgtattkctcttcaagancaatga

SEQ ID NO: 10718 - DNA, 98 bp, Homo sapiens
cttttaaaaattaatgtatttcaaaattgatttgaaaaattgtatatgaaaacaataataactataagactgaaatttgactccttctgcatgccggg

SEQ ID NO: 10719 - DNA, 360 bp, Homo sapiens
  misc_feature 129: s=g or c
  misc_feature 130: y=c or t
ttcaacccggcacctgccaacatggaaggtggcggcggcagcgtcgctgtagctggcctcggagctcgaggctctggagcggctgcagctacagtccgggaacttctgcaggacggtaaggagacgggsyctgaccaggtcgtggggttgggggtctgcgctgctccgcacctggacagcgaggtggacccaacccgttgctttgcagaaagttttccagtctggacgtgaccactcccctccgcccggccccctggcttgggtactgttctagccaacctatttactctgggactggctccctcttttctggagtcttggggacacttggtttctgtgtgttcctcatttcaactcggc

SEQ ID NO: 10720 - DNA, 350 bp, Homo sapiens
ttcatcatattttacgttttctcttaggtccttctattatatcagtcaagatttagagctttcttcatgtagaattcttgatagagctttcttcatgtaggttgttcacatttcctggtaggtttatttttatgattttagtcggtattgtgaatagagttttttgttacgccttgttaatttaaaaagttgaaaaatttaaacacaatattatagaactattaacgaaaaatacagttttttctcagccttcttcgcctctttccaaataaattacttttaactcttttactttcctttttgtagggttttagtgttacttttatatctccaactgatgcacttacaca

SEQ ID NO: 10721 - DNA, 224 bp, Homo sapiens
caatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttgggg

SEQ ID NO: 10722 - DNA, 511 bp, Homo sapiens
  misc_feature 71: m=a or c
  misc_feature 360: r=a or g
  misc_feature 377: y=c or t
  misc_feature 437: r=a or g
gtttccgggagcgccgcgtggttagcgtcggcggcttttggcatggcgactttttctggcccggctgggcmaatcctgtcgcttaatccgcaggaagatgtcgagtttcaaaaggaggtggcgcaggttcgcaagcgcataacccagcgaaaaaacaagaacaacttactcctggagtagtctatgtgcgccacctacctaacctacttgacgaaacccagatcttttcatatttctcccagtttggcactgtgacacggttcaggctgtccagaagtaaaaggactggaaatagcaaaggctatgcatttgtggagtttgagtctgaggatgttgccaaaatagttgctgaaacaatgracaactacctgtttggygaaagactcttggagtgtcattttatgccacctgaaaaagtacataaagaactctttagrgactggaatattccatttaagcagccatcatatccatcagtgaacggtatatcggaatcggacactaacacaaa

SEQ ID NO: 10723 - DNA, 183 bp, Homo sapiens
ctgagttggttctatcattagagttaagggcctttttttgcttattttatttagagtatgcaagttttgtaaaagttgaagttctacataggatataaaataatataaaatgtacaacgtatgtgcagatgatataagataattctagtattaagtaacaaaaatttattagaaaggtaaaac

SEQ ID NO: 10724 - DNA, 597 bp, Homo sapiens
cagatattctatacagttctgttgtcttttactaggactgtaaacttttgtgataaaattcaaataagattttatttcttggtaattttggctttcacaatttatctttaaatccttgagcaatctgtatacaattaagagatttctgacatttattcttacactaaatggatcaactctaggatttaggcatgttaacttctgttgtgttttgaatctctccagagttgcatgtagatagcatttatttctgtgcccttaaacccatttagaaaataactacaaagtaaaaatgtagaggaaatagaaatgtattttttcatgaacattttgatacaaatttcatcatttaatgattcaccaatttcttgcattaatttgaatttaagcatttaattcaaagagaggggagcatccattattgatacatgtgggcttttaaaaactccatcctttataaatagtcaaggtttgggccacacaaagtatatttttatcatggaaaaatttcaactcctcaagccgtaatgttgaacagaattggagtattttctttataatttcttgaacaggcaaatgaaagcttattatagaatg

SEQ ID NO: 10725 - DNA, 165 bp, Homo sapiens
gatttaatcatctgttttacaggtgaggtaacaggccttggcagtaaagtgactgccctcctgtcacacaattagtggcaaagctgggaaagaacccagatcttcgatttctaattcagcacttttctgtccaagttgaccgtttaaaaatttcttgattctaag

SEQ ID NO: 10726 - DNA, 226 bp, Homo sapiens
tgaacagaaagggagaaaaatttgttgtagttcgctctcgaagccaaaatgttagcactatcttttccctagatagagttcctttgaagtcaataaggcctccacacaggcaggaggcagctgcaggatgaaagggcttggctactcctagctatgtgagattggcagtagactctgaatacaactaaagtaagcataataaattataaattagaaagtacattct

SEQ ID NO: 10727 - DNA, 454 bp, Homo sapiens
  misc_feature 416: n=a, g, c or t
  misc_feature 417: n=a, g, c or t
gaaaaagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcannatttcggtggtgcttgggggtgaacaattttgtggct

SEQ ID NO: 10728 - DNA, 217 bp, Homo sapiens
ttagatttcagccaaaagaggcattttgttaagacaccaccatgtctatggtaatctgttttcagtagtaaccatttgaaacaacagggtaaaaattttaagcagtaattactgcatgccagattgtgatgatacctagtagagaaatatgaagaaaattattggagatgttgattcttagacagtttttttggtgatttgaattaaattaatgaga

SEQ ID NO: 10729 - DNA, 518 bp, Homo sapiens
  misc_feature 504: r=a or g
  misc_feature 508: n=a, g, c or t
cccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattatratanagattatggc

SEQ ID NO: 10730 - DNA, 413 bp, Homo sapiens
  misc_feature 375: r=a or g
tagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcraacccacaccactcattctcagctaagagattttacac

SEQ ID NO: 10731 - DNA, 100 bp, Homo sapiens
gacctgagtgagctggtgaaaaaacaagaacttcgcttcattcaatactggcaagagagatgccatcagaaaatccatcaccttttatcagaaccagggg

SEQ ID NO: 10732 - DNA, 130 bp, Homo sapiens
cagatttcattgtatgtagaacacctgtaaaaattttattggaacacatcttccatagaatataattcagaaaatatggattaaaaggaatccaccacgaagtgtgtttctgaaatgcttattaaaaacc

SEQ ID NO: 10733 - DNA, 329 bp, Homo sapiens
cttgttcataagactacatggatcataaccaaagaaaggactatatatagaagaatgatcaggtaatattattgggatataaaaatggttttgttaaaccaattgtttattgggatatttatactttgatttcacttaaatggtcagacactctggcacttctccagactaggggttggaatcttttttggtaaagtttaggctttgtgagccaaaaggcaaaattgaggcttttatatatttaatgagaatgaaaaattttcacatatattttattgataaaattcaaaatatattaatacttgaattttttgtgtgatacagggcta

SEQ ID NO: 10734 - DNA, 137 bp, Homo sapiens
tcagatgtttcaatgcctcatgatacaataaaaccacaaaaattttcttaacagtttaaattgttttaattagtttactagttggctgggcatcagaagctacccagacccgttgtctctctcatgtttcaccctcc

SEQ ID NO: 10735 - DNA, 521 bp, Homo sapiens
  misc_feature 32: n=a, g, c or t
  misc_feature 489: k=g or t
agtctctgagcagccattgaaggggaaggaantgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgacagagttagtccttgataattgcctgtgtgtcaatggggaaattgaaggcctgaatgatactttcaaagaactagaatttctgagtatggctaatgtggactaakttcgctggcccggcttcccagcttaaataaac

SEQ ID NO: 10736 - DNA, 154 bp, Homo sapiens
aaaaatttttaaactgtcaaatgaagtagtgttaacctcaaataggctaaatgtgaacaaataaaatacagcaaatactcagatacagctttttatctttgtgcttgagttcctgcctaaggcaataacattattcttttgacaacttttgcag

SEQ ID NO: 10737 - DNA, 572 bp, Homo sapiens
  misc_feature 278: n=a, g, c or t
agctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagagcctgataaaggtcctgcgggcaggacaggacctcccaaccaagccctccagcaaggattcagagtgcccctccggcctcgccatgaggctcttcctgtcgctcccggtcctggntggtggttctgtcgatcgtcttggaaggtaaaagtgggatgggagaattgcggagttggagatttggaagagtgaaggtggctacaggcctggggtcccggcttagaggacctctgagagctccggggccccttctgggtcgtggttgcctcatcgtggtcgggtgggtctccaggttctcccaggctcagtcccgcagcgccaaatctgcgcaggagagcactagcaaccgatgacgtattgaggcccacacctctgggattggctgtcctgcttcgacagccttgaaagtgg

SEQ ID NO: 10738 - DNA, 307 bp, Homo sapiens
  misc_feature 12: r=a or g
  misc_feature 52: n=a, g, c or t
  misc_feature 56: n=a, g, c or t
  misc_feature 57: r=a or g
  misc_feature 64: n=a, g, c or t
  misc_feature 117: m=a or c
  misc_feature 240: s=g or c
  misc_feature 247: w=a or t
  misc_feature 262: s=g or c
actctgcaagaractcaaaaagggagatgaggggatcgtgggagggaggtangganrgaagaanggtgccactgatcccctgaacccctgcctctgcctccagagtgcccctccggmctcgccatgaggctcttcctgtcgctcccggtcctggtggtggttctgtcgatcgtcttggaagggagtggttttcagagacatttcagaaagtgaaggagaaactcaagattgactcatgasgacctgwagggtgacatcccasgaggggcctctgaaatttcccacaccccagcgcctgtgctgagga

SEQ ID NO: 10739 - DNA, 400 bp, Homo sapiens
aagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggc

SEQ ID NO: 10740 - DNA, 368 bp, Homo sapiens
  misc_feature 358: m=a or c
aagctcgttcttccgccagcttccctcctcttcctttctccgccatcgtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagagggcacacaataagtttctgttgttttaagccatctagtttatggtaatttttttacagtagccctaggaaactcatataccattggtgggccagttatacattgataamatcttgttct

SEQ ID NO: 10741 - DNA, 155 bp, Homo sapiens
tatacttcaaagaaattctaaacagtggaaatctccaggagatgaagatgacaaagactgcaaagaagaggaaaacaaaagcagctctgagggtggagatgcgggcaacgacacaagaaacacaacttcagacttgcagaaaaccagtgaaggga

SEQ ID NO: 10742 - DNA, 271 bp, Homo sapiens
aatctctcattgcaaacagaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccgg

SEQ ID NO: 10743 - DNA, 449 bp, Homo sapiens
  misc_feature 25: n=a, g, c or t
  misc_feature 424: k=g or t
acacacacacacaagcacacacgcncacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcatttkcattatgttattcatgaacacccgg

SEQ ID NO: 10744 - DNA, 373 bp, Homo sapiens
  misc_feature 212: k=g or t
tattttctattagtcaaacttttttgtagaaccttctttcccttaccctggcaaattgcttctttacttgctggtttccttacgtttggggcacatgttgtaagaaactgattggaaggggaaatgtgcagctctccactggaaaggaactctccacccctcccatcctgataaaacaaacaaggtttacatttacaactaaaaggattcakatgcaattttcaactattctgaaaccagcaggacacacctgactttaatagttttagctgaaattgtagatgttttgcttcagtttaacttatgagaaaagattatctgacggattttgtgttgacttcccctttagtggtttattttgtctttttctgcc

SEQ ID NO: 10745 - DNA, 325 bp, Homo sapiens
gccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgcc

SEQ ID NO: 10746 - DNA, 416 bp, Homo sapiens
  misc_feature 84: s=g or c
aggcccgacaggggagcggaagaggcccaggaggctgggtgaggcgctgagacggtttggcggtgagtcctgggccaggcgcastgaaaggcccgcaacccgggaaacgtcaaaacaaacagaaggacttgggattccggagcagtcgcccctatcgctgctcctgcagttgcggacgccaccgaccccgccgccggaggactgggcactgaaaggcctctaggcctaggcgcggcccgcggagccagacgtgttgctgccgtgagtaaaacgagcgccctctccgcactcgtttacaaattaaaatggaggaaatttcgttggccaacctggatagtaacaagctagaggccatcgctcaggagatttacgtagactgatagaggattcttgtttgggattctgctttgaggtgc

SEQ ID NO: 10747 - DNA, 384 bp, Homo sapiens
  misc_feature 3: y=c or t
  misc_feature 5: k=g or t
  misc_feature 10: n=a, g, c or t
  misc_feature 11: y=c or t
ttytktcggnytgactattacttggggcacggaaatagccaacccttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaa

SEQ ID NO: 10748 - DNA, 439 bp, Homo sapiens
  misc_feature 3: y=c or t
  misc_feature 5: k=g or t
  misc_feature 10: n=a, g, c or t
  misc_feature 11: y=c or t
  misc_feature 344: r=a or g
  misc_feature 345: n=a, g, c or t
  misc_feature 367: n=a, g, c or t
  misc_feature 422: k=g or t
ttytktcggnytgactattacttggggcacggaaatagccaacccttttcttccgcacggttggaggaggtcggctggttatcgggagttggagggctgaggtcgggagggtggtgtgtacagagctctaggactcacgcaccaggccagtcgcgggttttgggccgaggcctgggttacaagcagcaagtgcgcggttggggccactgcgaggccgttttaggtaggttgctaagagggcgaggccgtccgggcctggcgggcgggggaggcgttgcatatctggggtttcccggggccccttcgttggtccggaggatcgagactccgaagtcggtccgagrnggtgaagggatcacggccgcancaactccgctgccacgcggctggtatgagtcccacacaaacgtggttgtagtgtkgacgggcttcattatat

SEQ ID NO: 10749 - DNA, 220 bp, Homo sapiens
  misc_feature 8: m=a or c
tttaccgmagtgtggcaggactgatttatcttgacaagcaaagaacaaaaagattttaaaaagtgcttctttgtccagaaaacaaagaggcaactttgtaaagacctttgtattttttgaccttaaaattttcattccaaaagctttaaatttgaaagtgtagttttgagtcaacacagtttctcggtttaatgtatgcagtgagaacaaaatggaaagg

SEQ ID NO: 10750 - DNA, 383 bp, Homo sapiens
aattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatcc

SEQ ID NO: 10751 - DNA, 265 bp, Homo sapiens
aattttgggaagagctttgttatggttgtggactagccgcctctgccgggtcgacaagctggggacgcgtcctcagacgcagcgtctagtccctggccatagctccgccgctgcccgttggtgtctcacctttaactctccttatgctgggtgaaaacaaaggtgaggctcacaaagttgactattccaaaagtttacataagaatgggtgcggtgcggtggtgtgtgtgtttaatagttgcttatagttttgaaattgtgctgt

SEQ ID NO: 10752 - DNA, 338 bp, Homo sapiens
  misc_feature 16: w=a or t
  misc_feature 17: w=a or t
  misc_feature 21: w=a or t
  misc_feature 44: w=a or t
  misc_feature 60: w=a or t
  misc_feature 73: w=a or t
  misc_feature 238: w=a or t
  misc_feature 244: h=a or c or t
aattttgggaagagcwwtgtwatggttgtggactagccgcctcwgccgggtcgacaagcwggggacgcgtccwcagacgcagcgtctagtccctggccatagctccgccgctgcccgagtgatagattcgtgtggcctttcaaatgattgtgaagtggtggaaatggatccaaaataataagtgacttctctaccaaagcatagaagattcttcatatctccttccagtggctcaatwtagathttgggaaggagcagaacaagtgaaacacagaaaactgaagagaagaaatcctcattttggacctatatttctccttgactatttcttaatatcc

SEQ ID NO: 10753 - DNA, 155 bp, Homo sapiens
gtccttgtcccaccagtcgggcggtgaattggactgactggtgacccctggcaccaggcttccccatgggcaccggagcaggcggacaggggtggggtcccgcgagcgacacggaaggattcctaggtcaaaacaaagcataaacaatcaacgcc

SEQ ID NO: 10754 - DNA, 217 bp, Homo sapiens
cagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgccccatcctcaagt

SEQ ID NO: 10755 - DNA, 261 bp, Homo sapiens
gtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctcccc

SEQ ID NO: 10756 - DNA, 517 bp, Homo sapiens
  misc_feature 4: n=a, g, c or t
  misc_feature 396: y=c or t
  misc_feature 411: r=a or g
  misc_feature 492: r=a or g
cttntttattccggaagttgctctcagaggcagcgtgcgggtgtgctctttgtgaaattccaccatggcgtaccgtggccagggtcagaaagtgcagaaggttatggtgcagcccatcaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctccaactagaaatgatcaatgaagtgagaaattgttgagaaggatacagtttgtttttagaygtcctttgtccaatrtgaacatttattcatattgttttgattacacttatgtttttacaagatggcaataaatgctgtgggattgtttgtattaaractaataatactaataataataata

SEQ ID NO: 10757 - DNA, 562 bp, Homo sapiens
  misc_feature 4: n=a, g, c or t
  misc_feature 414: k=g or t
  misc_feature 417: r=a or g
  misc_feature 418: r=a or g
  misc_feature 420: r=a or g
  misc_feature 537: r=a or g
cttntttattccggaagttgctctcagaggcagcgtgcgggtgtgctctttgtgaaattccaccatggcgtaccgtggccagggtcagaaagtgcagaaggttatggtgcagcccatcgtatcctacgcaggatgtcaggactaggagccactgtggtgcagaacctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggagataatattactctgctacaaagtgtctcctactagaaatgatcaatgaagtgagaaattgtkgarrarggatacagtttgtttttagacgtcctttgtccaatatgaacatttattcatattgttttgattacacttatgtttttacaagatggcaataaatgctgtgggattgtttgtattaaractaataatactaataataataata

SEQ ID NO: 10758 - DNA, 408 bp, Homo sapiens
gtagccgggctgggccagaacagcccaagatggccgacttcgatgatcgtgtgtcggatgaggagaaggtacgcatagctgctaaattcatcactcatgcacccccaggggaatttaatgaagtattcaatgacgttcggctactacttaataatgacaatctcctcagggaaggggcagcacagtaagtatctttccaaatccacttagaatgttactctaacattggataaactatgttgacagtaaactagcaccctgaaaacaaagtttaaaatacttcaaagtaaagcagttggttttagcaattttcgttgttttttttaattggagaaaacatgttcccccaattgttgtttacttcctcaaagcttactataatatatgaactagtttttatttctgccc

SEQ ID NO: 10759 - DNA, 283 bp, Homo sapiens
atactctggaaggtgttccagggctgcgtgattccgggagtgtgctttctctttcaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacgggtcttgctctgtcgcccaagctggagtgcagtggcaccatctccactcattgcaccctcaacctccccggctcaactagtcctcc

SEQ ID NO: 10760 - DNA, 427 bp, Homo sapiens
  misc_feature 152: k=g or t
  misc_feature 249: r=a or g
ttctagtgaaagatctattttctgagactaaggagaaggcttggggaacaagtgatttattgataaggctaatatgcattttggaaatagaaatctcatatttttggtgacattacatctgatatgatgtagaggaaggttttttaaaaagkttgagattgtcctaagggctggggcaatttatgtgtgtagaagaacttatcaggcaggtttttgggcaaatgtgaacaggaggaagatctagaaagrctaatgtcaggaaagacaaaatgtgttgggaagctatgtcagaaacttgaaataagctaagtttggcagttgaaaaaacaagatactaaaggaatttgaagctaatgaaagaaagtatgcctaattaaaaattctgttagtaaccttgaacatgaaatagattgtcatgggatcagga

SEQ ID NO: 10761 - DNA, 256 bp, Homo sapiens
  misc_feature 7: m=a or c
  misc_feature 8: n=a, g, c or t
  misc_feature 9: y=c or t
agcgaamnyaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataaccc

SEQ ID NO: 10762 - DNA, 404 bp, Homo sapiens
cagtgaaacttgagtgagatgagagagcatggagcctgccagtctccccctctgcgcacacacacacgcaaacacatttaactttccacttgcagtgacctgcccttcagtgtgacttatcagctgtttggcttttgtcactaaaggaaaacaaattgtggaatatcccgctctgcatgctcatgagatggctgagccaactcaggggttatgaggtggtttgcgagtgaggagaagaatgatcttcagtttctgacctcctggcacggtggcgggcggtatttatcaggaggtacatgtgactggttaagactcagagccccagcttgaaggaaacagctgctctcggcgtgctccggcacttggcagctggacaggcagagtgctgatgtgaaaaataccac

SEQ ID NO: 10763 - DNA, 181 bp, Homo sapiens
cctttttaggcaaagaaaacaacacatacaaagtaaagagctgtcagagtgccacaggtgtggagggaatggctaaacacttgggctggctcggggcacaggatcctgggtggtggtagtcaggacaggacttgttataaaacatgtggggctaaggcatacgacagattttttttttttt

SEQ ID NO: 10764 - DNA, 196 bp, Homo sapiens
  misc_feature 32: y=c or t
aggagacagatgaatttctcattcttgtaggytaccatttcttttggcttattacaaaacaacaggatgctgcagctttatcaaagtctacttatttgtccactaaaagtttatggctatacgtttccaactagaacatctgaacaccaatatatggaattctgacaaagttaaaaccaggaagagatcctatgaa

SEQ ID NO: 10765 - DNA, 122 bp, Homo sapiens
  misc_feature 4: r=a or g
tgarattacccttgatccttgggctgcagaatgggtattgtgttagcaggtatgaaaacaacattgtctcctcatacgcctctatcagagctcttgggtgaccaggtgtattgtcagtgagc

SEQ ID NO: 10766 - DNA, 329 bp, Homo sapiens
  misc_feature 15: n=a, g, c or t
  misc_feature 76: s=g or c
  misc_feature 96: y=c or t
  misc_feature 109: y=c or t
actccttgatctatnggctgcagaatggatgttgtattagcagtcaagaaaacaatgtgaatctttttgtcatctscatcagagctcttgggtgaycaggtgcattgtyaatgagcagtaatattttgaaaggaatcttttttcctgagcaataggtctcaagagtgggcttaaaatatttagtaaaccatgctgtaaacagatatgctgtcatctaggctttgttgttccactggcactggcagaatagatttatcataattcttaagggccctaggagtttcaacatggtaaatgaggccaggtgcccctcacacgtataatcccag

SEQ ID NO: 10767 - DNA, 324 bp, Homo sapiens
aagtctttaagagcaaacggtggatgccttggcatctggagccgaagaaggacgtagcaatctgcgataagcctcggggagctgataagcgagctgtgatccgtggatgtccgaatggggaaaccccgccaggcgcacttgtgtgacctggtgactcccgcctgaatatatagggcgggtagagggaacgtggggaagtgaaacatctcagtacccacaggaagagaaaacaaccgtgattccgtgagtagtggcgagcgaaagcgcaagaggctaaaccgggtgtgtgtgatagccggcagggttgcatgcccggggttgtgg

SEQ ID NO: 10768 - DNA, 452 bp, Homo sapiens
  misc_feature 110: s=g or c
cttctttttgcgaagtgggctcgtgggttggcagtatgagagttgtaatggcccgactgttgagtgagggggagcaggggatcccaacggcttgcgctgcctttgcgcasagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaagggtctaaggtttggaatctccccctcatggagagaagctttgtatggctgtcatgc

SEQ ID NO: 10769 - DNA, 390 bp, Homo sapiens
  misc_feature 110: s=g or c
cttctttttgcgaagtgggctcgtgggttggcagtatgagagttgtaatggcccgactgttgagtgagggggagcaggggatcccaacggcttgcgctgcctttgcgcasagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgtgagtggggttgggcgagtgattgcaaaatgggggtggcggtcgcccgacccacgactcacaggcattcctcccacagccctttcatttcctccccaccccg

SEQ ID NO: 10770 - DNA, 114 bp, Homo sapiens
  misc_feature 105: n=a, g, c or t
  misc_feature 106: m=a or c
  misc_feature 108: n=a, g, c or t
cttttttttgcgaagtgggctcgtgggttggcagtatgagagttgtaatggccccagtgcagttgggtgaactaccgttgcacactggagtttctggtgtctttnmtnggaact

SEQ ID NO: 10771 - DNA, 403 bp, Homo sapiens
  misc_feature 110: s=g or c
cttttttttgcgaagtgggctcgtgggttggcagtatgagagttgtaatggcccgactgttgagtgagggggagcaggggatcccaacggcttgcgctgcctttgcgcasagccggcgggcggccacgtcgcggcctggctggggagttgtaagacgttcatcgccgtgttatccttgagtaaagaagcgggcttttgccatgttgtccaggctggtctctactcctgggctcaagcagtcctcctgcctcagtctcccaaagtgctggaattacagggaatgaactctggaagcccagccagggacaatgcaccttcacagagattctgcactaatctgagtgaagggtctaaggtttggaatctccccctcatggagagaagctttgtatggctgtcatgc

SEQ ID NO: 10772 - DNA, 339 bp, Homo sapiens
gaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaggctaatgaaaagtattaaagatcagaaaattaaaattgaatggg

SEQ ID NO: 10773 - DNA, 160 bp, Homo sapiens
caggtccctcaaagattccttggaccattttcatgtgaatgaagaagaaatcaattgtctttcattgaatcaaacggaaaacctgctggcttctgctgacgactctggggcaatcaaaatcctagacttggaaaacaagaaagttatcagatccttgaag

SEQ ID NO: 10774 - DNA, 209 bp, Homo sapiens
attaaaataccaatacaaagtcagaggcctcaccagggtgtggacatcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaagg

SEQ ID NO: 10775 - DNA, 864 bp, Homo sapiens
  misc_feature 186: k=g or t
  misc_feature 188: k=g or t
  misc_feature 193: k=g or t
  misc_feature 195: s=g or c
  misc_feature 321: m=a or c
  misc_feature 322: m=a or c
  misc_feature 330: k=g or t
  misc_feature 338: m=a or c
  misc_feature 341: n=a, g, c or t
  misc_feature 342: r=a or g
  misc_feature 347: w=a or t
  misc_feature 348: r=a or g
  misc_feature 351: r=a or g
  misc_feature 352: n=a, g, c or t
  misc_feature 444: w=a or t
  misc_feature 470: n=a, g, c or t
  misc_feature 471: n=a, g, c or t
  misc_feature 472: n=a, g, c or t
  misc_feature 473: n=a, g, c or t
  misc_feature 798: r=a or g
ctttcgatgttgcgtcatgcagtgcgccggaggaactgtgctctttgaggccgacgctaggggcccggaagggaaactgcgaggcgaaggtgaccggggaccgagcatttcagatctgctcggtagacctggtgcaccaccaccatgttggctgcaaggctggtgtgtctccggacactaccttckakggttkcsacatgcagtgcgccggaggaactgtgctctttgaggccgacgctaggggcccggaagggaaactgcgaggcgaaggtgaccggggaccgagcatttcagatctgctcggtagacctggtgcaccammcaccatgkttggctgmaanrctggwrtgrnctccggacactaccttctagggttttccacccagctttcaccaaggcctcccctgttgtgaagaattccatcacgaagaatcaatggctgtwaacacctagcaagggaatatgccacnnnnaacaagaaattgggatccgacgctaggggcccggaagggaaactgcgaggcgaaggtgaccggggaccgagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggaatatgccaccaaaacaagaattgggatccggcgtgggagaactggccaagaactcaaagaggcagcattggaaccatcgatggraaaaatatttaaattggatcagatgggaagatggtttgttgctggaggggctgctgttggtcttgg

SEQ ID NO: 10776 - DNA, 238 bp, Homo sapiens
  misc_feature 212: r=a or g
  misc_feature 214: m=a or c
gacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagatrcmaatgtcagccaatgacatataaca

SEQ ID NO: 10777 - DNA, 593 bp, Homo sapiens
  misc_feature 12: m=a or c
  misc_feature 511: r=a or g
ggaagagcttcmgactgagcctggtacagtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaagcctcaaaggcactggaggtctcagaggatgtgaaggtctcaaaagcctctggggtctcaaaggccacagaggtctcaaagaccccagaggctcgggaggcacctgccacccaggcctcrtctactactcagctgactgatacccaggttctggcagctgaaaacaagagtctagcagctgacaccaagaaacagaatgctg

SEQ ID NO: 10778 - DNA, 430 bp, Homo sapiens
  misc_feature 348: r=a or g
agggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccgaagcctcaaaggcactggaggtctcagaggatgtgaaggtctcaaaagcctctggggtctcaaaggccacagaggtctcaaagaccccagaggctcgggaggcacctgccacccaggcctcrtctactactcagctgactgatacccaggttctggcagctgaaaacaagagtctagcagctgacaccaagaaacagaatgctg

SEQ ID NO: 10779 - DNA, 331 bp, Homo sapiens
atttttcttgatactctaggacttttgaatctagtcatttagcaagttggttttggttttttcttctttacaaaatatttttatttttgttacccttatgtttatggtttagatttctttggccttatcaagcttttcttattttgtcttcaacaaagttaaatccagcatataaaacaagatttctacaaactgggtatctttttaatactttgtttccaaaggatgcaaggtgttgtaaaccgactgtccaagttactgaaacctgggggaatgctgttatttcgagactatggaagatatgataagactcagcttcgttttaaaaagg

SEQ ID NO: 10780 - DNA, 194 bp, Homo sapiens
taattagcacttattgaatgcttaagatgtgctagacactaagcaaaacaagcagcctatgataccccattctgttgtcatagtaactgtcagatcgatggttaccacaatttacagtccaacaagacagttgaataggcttccagacattaagtattggttcaggatcatacaggatttaagtgtcaaataag

SEQ ID NO: 10781 - DNA, 468 bp, Homo sapiens
  misc_feature 245: r=a or g
  misc_feature 425: m=a or c
gtggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaaatgtcaggaatggaagccactgtgaccatcccaatctggcaaaacaagccacatggggctgctcgaagtgtagtaagaagaattgrgaccaacctacccttgaagccgtgtgcccgggcgtcctttgagaccctgcccaacatctctgacctgtgtttgagagatgtgcccccagtccctaccctggctgacatcgcctggattgctgcggatgaagaggagacatatggtggggtcaggagtgatacgcgccccctgaggcacamctggaaaccagccctctgattgtcatgcagcgcaatgcctctg

SEQ ID NO: 10782 - DNA, 291 bp, Homo sapiens
  misc_feature 7: r=a or g
  misc_feature 8: k=g or t
  misc_feature 153: y=c or t
aagagtrkaccgcagacatcatttctactacagtggcggacgtacaggacctgtttcactgcagggggatccaaaacaagccccgtggagcagcagccagagcaacagcagccgcaagacattgtttctctccctctgcccccccttccccaygcaaccccagatccatttacactttacacatactggagcatagtgaaagagtctattttgaagcttcaaacttagtgctgctgcagaccaggaacaagagagaaagagtggagctcatcaaggacaccgaagaccctg

SEQ ID NO: 10783 - DNA, 200 bp, Homo sapiens
  misc_feature 7: r=a or g
  misc_feature 8: k=g or t
  misc_feature 41: n=a, g, c or t
  misc_feature 189: m=a or c
  misc_feature 190: s=g or c
  misc_feature 198: r=a or g
aagagtrkaccgcagacatcatttctactacagtggcggancgtacaggacctgtttcactgcagggggatccaaaacaagccccgtggagcagcagccagagcaacagcagccgcaagacattgtttctctccctctgcccccccttccccacgcaaccccagatccatttacactttacagagcatmstgcatcargt

SEQ ID NO: 10784 - DNA, 244 bp, Homo sapiens
  misc_feature 7: r=a or g
  misc_feature 8: k=g or t
  misc_feature 41: n=a, g, c or t
  misc_feature 167: y=c or t
aagagtrkaccgcagacatcatttctactacagtggcggancgtacaggacctgtttcactgcagggggatccaaaacaagccccgtggagcagcagccagagcaacagcagccgcaagacattgtttctctccctctgcccccccttccccacgcaaccccagatycatttacactttacagtcacagaacagaaagtgctggtggacatctcttcttgccccaagatcttcgttggaaggcc

SEQ ID NO: 10785 - DNA, 427 bp, Homo sapiens
acacagtacatcaccttcatgagcgcatcagtgaacaccagtctaaggcaagacatctctgaacgtaattttggagattttgatgagttccattgaaacaaggaggaatgtgatgtccagtatcagttctgcagacccaaggacaaagaaaattctgtgataaactcatccagtgtgactgtaatgatacaagacaccggactttcaaatcaacaattgtttcaaaagactcctactggattcctgctagtgatgggagaaaattatcattctgctagttaatctgtagccagagatgattaaggaggtcattaaaggaaaacaagctgcccaccatgctgatgcctggttgttcagatcgttgaggtggtgtagagatgacgcacactggctcagtttacccacatttggatctacggacctgcaa

SEQ ID NO: 10786 - DNA, 177 bp, Homo sapiens
  misc_feature 132: k=g or t
ttaaaggataagtaggttttgaagacggggacagaaagaaggaaaattgtggtcagggccaggggagaaaacaaggagtaactttctttggcaggaatgagggtgattcatgctggaatggtaggctggggkcagactgtggtgctataaatgcggggagagagattagagaaggca

SEQ ID NO: 10787 - DNA, 163 bp, Homo sapiens
ctcgggatgagttcacacccattatacaggtggggagctgaggcgccggacgtcaagtggctggctccagcccgaagactacggagaaaacaaggctgaaatcttacagctaatcaacaccttgtagcttaacaccccgcttcctccaccccctacttcacgc

SEQ ID NO: 10788 - DNA, 339 bp, Homo sapiens
  misc_feature 326: r=a or g
  misc_feature 327: n=a, g, c or t
aaaaaacccctcgctaaagagaagcacgttagtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagarnaaactaagggga

SEQ ID NO: 10789 - DNA, 201 bp, Homo sapiens
  misc_feature 99: s=g or c
agtggttgcgttttcaagatggcgactccctatgttactgacgagaccggcggcaagtatatcgcgtcaacacagcgacctgacgggacctggcgcaasagcggagggtgaaagaaggatatgtgccccaggaggaggtcccagtatatgaaaacaagtatgtgaagtttttcaagagtaaaccagagttgcccccagggc

SEQ ID NO: 10790 - DNA, 336 bp, Homo sapiens
  misc_feature 99: s=g or c
agtggttgcgttttcaagatggcgactccctatgttactgacgagaccggcggcaagtatatcgcgtcaacacagcgacctgacgggacctggcgcaasagcggagggtgaaagaaggatatgtgccccaggaggaggtcccagtgtacgtggttaggctttgcgtaggggttttctgatggggtccctacagaaggatagaatatccttatgcctacaagttcagggaggactctcctaagccccaaggaaatggaaggaggggcaactatctgagaaaggagagaaagagtctgggattcagggatgagtgagggttacagatcactagtcgcc

SEQ ID NO: 10791 - DNA, 298 bp, Homo sapiens
gcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaag

SEQ ID NO: 10792 - DNA, 394 bp, Homo sapiens
  misc_feature 55: k=g or t
  misc_feature 56: r=a or g
  misc_feature 209: r=a or g
tcattagggtactagacacatcagcctaaagtggcatctggaattgaatggattkrctgataatgatcagtctttagtcttccctttgttatatgactttataggttatgattgatcaaatttacgttttactaatggtaagggtgagggtcatagggcaggttttgggttttctagtactgttgaaaactgcaagtattggctatttrtatacttagccataacttggtgaaaaaaaacctgagcagtgtctatgtattaatgcgttggaaagaaagctgcttgtgtttgctttgttaattgcctcaggatatttcttttaaaataagctgttttaagaggcagaagggaaatctgctacctagtctatacacagcgtgaacctcacaggggg

SEQ ID NO: 10793 - DNA, 413 bp, Homo sapiens
  misc_feature 55: k=g or t
  misc_feature 56: r=a or g
tcattagggtactagacacatcagcctaaagtggcatctggaattgaatggattkrctgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaagggggggcttctgataccctcaaacatgg

SEQ ID NO: 10794 - DNA, 140 bp, Homo sapiens
caactatgtacatattcagaggagtaaaggaaaacaagtttttaaggacaaatgacgaggattacaaaattactttgaggtaattattcttggctaccaagatcaataacaaggatgacaccagtccaaggttgacaggc

SEQ ID NO: 10795 - DNA, 427 bp, Homo sapiens
  misc_feature 131: r=a or g
  misc_feature 137: k=g or t
  misc_feature 138: n=a, g, c or t
  misc_feature 140: s=g or c
  misc_feature 357: n=a, g, c or t
  misc_feature 358: n=a, g, c or t
gtgttgcgtagggcgcctgtgcttgaggttgggggttgcgtcgctctctggtaaaggcgtgcaggtgttggccgcggcctctgagctgggatgagccgtgctcccggtggaagcaagggagcccagccggrgccatkngscaagtacagtggtagcagttggactgaccattgctgctgcaggatttgcaggtttgtttatggtttggggatggaagtgaagtcggggagattggagatttagtttacttattctgttgcttttggttttaggccgttacgttttgcaagccatgaagcatatggagcctcaagtaaaacaagtttttcaaagcctaccaaaatctgtaagactttnntaattctttgctgcttctatttgaaacctagagccacacttagggaagggtaaatttccaaatatccat

SEQ ID NO: 10796 - DNA, 230 bp, Homo sapiens
  misc_feature 165: r=a or g
  misc_feature 172: y=c or t
  misc_feature 173: y=c or t
  misc_feature 178: s=g or c
  misc_feature 179: r=a or g
gtgttgcgtagggcgcctgtgcttgaggttgggggttgcgtcgctctctggtaaaggcgtgcaggtgttggccgcggcctctgagctgggatgagccgtgctcccggtggaagcaagggagcccagccggagccatgccctactgccaataaagggaaaataagrgatggcyycatcsracgaattatgcttttaaatcatcctgacaaaggaggatctccttatatagc

SEQ ID NO: 10797 - DNA, 398 bp, Homo sapiens
  misc_feature 371: k=g or t
  misc_feature 379: y=c or t
agttgtacgttcgaaacctgtcgccgtcacttgcgcgtttggcattatccattgtcaccgcggaggaacgagcgctcgagatatcatcagtgcccgcaaatctccgcgccaaggcgctgagctactcctttccgaggtgcgcctctggtcctccgtccctggtgcccagcagcggcgaggcggcatctccgctcccgccgccgtgtccaccgagccctgggatcagggtggcagttctcaacgatgggcaggagggacctcggcggcgacccctaaaacaataccatgccccgggatccccgctgctgccgcgccacgtcttccctttccacctccctgaccctgtcggattcggatgagcccattgcaakgagaagaygcagccgtcagtaaaaggg

SEQ ID NO: 10798 - DNA, 602 bp, Homo sapiens
  misc_feature 256: s=g or c
  misc_feature 446: n=a, g, c or t
  misc_feature 447: r=a or g
ttccagacctattcaggaccatatagtatttcacaagtagtggaaaaccagttacctcattgcttaccagctcatgatagcaaacagagactagattctattagctactgtcaactcaccagagactgtttcccagaaaaaccagtacccttgagccttaatcagcaagaaaataactctggctcatacagtgtagaatctgaagtttacaagcacctctcttcagaaaacaatactgctgaccatcaagcaggtsataaacggaaacatcagaagagaaaacgacacctagaaagaaggcaaagaaaggccagagaaagagcagtccaagcataaaaggaaaaagagttatgaagatacagatttagacaaagacaagagcatcagacaaaggaaaagagaggaggatagagtcaaggtcagttcaggaaagcttaagcatcganraaagaaaaaaagccatgatgtaccctccgagaaagaagaacgtaagcacaggaaagagaaaaagaaatctgttgaagaaaggacagaagaggaaatgctttgggatgagtctattcttggattttgaatgtttagttttgtttacccaaggttga

SEQ ID NO: 10799 - DNA, 480 bp, Homo sapiens
aataaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaag

SEQ ID NO: 10800 - DNA, 159 bp, Homo sapiens
acattcagtggttagttctaagaacaacccttatttcctttcttttggtagcctgccctctccctgcaaatgcagctccatttggtatgagcaacaaggcaaatgcctaaaacaatcaacagatagaaggaaagcattaatgctggagtattagtagcc

SEQ ID NO: 10801 - DNA, 212 bp, Homo sapiens
  misc_feature 126: r=a or g
  misc_feature 142: k=g or t
  misc_feature 161: n=a, g, c or t
aaaaaaacactctgtgtggctcctcggctttgacagagtgcaagacgatgacttgcaaaatgtcgcagctggaacgcaacatagagaccatcatcaaactaacacaagaaaagaaaaccaggccargaagcaactgactcakgcctgtagtctcagaactntgggaggctgaggtggagagtttgagatcagcctgaccaacatgatgaaac

SEQ ID NO: 10802 - DNA, 385 bp, Homo sapiens
  misc_feature 183: m=a or c
  misc_feature 189: w=a or t
aaaaaaacactctgtgtggctcctcggctttgacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgmaaaatwgaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcacccctaagaccacagtggccaagatcacagtggcca

SEQ ID NO: 10803 - DNA, 430 bp, Homo sapiens
catatacttttttggcccctcatttcctctttatggccttcttttctgtttttttgtagtgaactagtctgattctctttccactcccctttgtgtatatttgttagatgttttatttgtggttgctatggggattatagttaacatcctacacttaaaacaatctaatttaaactgataccaatttaccttcaatagcatacaaaatctctactcctgtaaagctctgcccctgccccctgaagaactgcttgaacccaggaggtggacgttgcagtgagcggagattgcaccactgcactccagcctaggcaatagagactcagtctcaaaaaaataaaaataaaaacaaaaataaaaaactagcagtgtaactataatacatagatccaccaaaaatctgattgctagaatcacctttacactagca

SEQ ID NO: 10804 - DNA, 375 bp, Homo sapiens
  misc_feature 365: n=a, g, c or t
  misc_feature 366: s=g or c
acgagatctgatggttttataaacagcagtccccgacgggcttttctgtttcctaccgcgttgtgaaggagattcttgctgcttcttcgctttctgccatgattgcaagtttcctccggcctccccagccatgtggaactgtgtggtaccaggaataatgtgggaggctggattgaagtctgggccaggaacaacggtaattgtgggagactcaacaaagaaagacttgaggagaaaaggagagatgttggaatgaacaagcagtccatggagcagttacacacactcatcaattaagtttgctgtcttatatgagggaaattcatggtaccccaaaacaattaccatagtaacattaaataaanstgatcagag

SEQ ID NO: 10805 - DNA, 344 bp, Homo sapiens
  misc_feature 123: w=a or t
  misc_feature 225: m=a or c
ttgttgtgtctcaagtaatgggcttggtgaaagggagagacagagaggaatggttgtcagtggagcagtgagatcacacacacttttaagtagctaagtttgctgtcttatatgggtgtgatwcatggtcccccaaaatagttacaatagtaacatcaaagatcactgatcacgtcaccaaaacagcatattataataatgaggaagtttgagatattgtgagamttaccagaatgtggcacagagacaggaagtgagcacatgctgttggaaaaatggcactgatagatttgcttaatgcaaggttgccacaaagcttcaattggcaaaaaatgcaatacctg

SEQ ID NO: 10806 - DNA, 419 bp, Homo sapiens
attactccctcgcctgacacagagcggcagtttgactttaccactcccaggaagcacacaggcaaaacaattcagaacaatctgttttgaatccttgttttatttccccattccctttctcatcgcatggaaattcacatccctgtaaagctgaaaatggtgtggatctcccctgatggtctttccaaggaattatcagcaggtaaactagaccgtgtgggccagtttacctgaaatgaaaacagaaacgtcactgggctttgctgggagattcagcgtctttgtcagtgatagaatcatcctaagcaggttgtttgttgtgctgcagatccacacggttagctgtgtcaggattaaaattacccagtgcggacagtgtagcttaatcctcatggaagggtgtcaagtacattgaagag

SEQ ID NO: 10807 - DNA, 176 bp, Homo sapiens
  misc_feature 10: r=a or g
  misc_feature 31: n=a, g, c or t
  misc_feature 32: n=a, g, c or t
aagaaatgcraacaaaagtgattataccatnncaagctatccttcaagtgttaaggccatagaaaacaattttgaatgtgtaagaactcagagaatattgtacacatatacctttcttcagacattcactagagcagaagttagcaaactatggcccatgggtcaaatccagcctg

SEQ ID NO: 10808 - DNA, 193 bp, Homo sapiens
gttggatagccagatctgtgagctgaaatatgaaaaaacactggacttggcatcagttgacctgcggaagatgagagtggcagagctgaagcagatcctgcatagctggggggaggagtgcagggcctgtgcagaaaaaactgactatgtgaatctcattcaagagctggcccccaagtatgcagcgacacac

SEQ ID NO: 10809 - DNA, 242 bp, Homo sapiens
cacaaaagatgaggggatgtgagacaatgcattctttatagaaattctgattgtgagcaggggtcacgcttccttgtaagccgcaattatacattggtaagtatctttactgctctgactccgtcgtgtattcaagtaaaacacaaagagtaacagcaaacaccttgtttccccatcacccaggacctgctctctgtgaagtggccggggcagtgggtgctcagggagcagcgtcctaaccc

SEQ ID NO: 10810 - DNA, 423 bp, Homo sapiens
atctggtggaagaaaagtcaggcaaacacaagcacgcacacaccactgggagatcagatcttctagctggctctctgctgccacagctccgccgaaggagggggtggaagaggaggactaaactcagagctgagaggagaggcaggtgtgtgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttccca

SEQ ID NO: 10811 - DNA, 188 bp, Homo sapiens
  misc_feature 120: r=a or g
  misc_feature 158: s=g or c
aaaacacaagcacgcacacaccactgggagatcagatcttctagctggctctctgctgccacagctcccctctccaggccctccatctatcttccctgactgtccccgcgaatgctactrcccccctgatttcccatctgccctctactgtgatagcsgcaacctgcgaaaggtccctgtcatcccgc

SEQ ID NO: 10812 - DNA, 349 bp, Homo sapiens
  misc_feature 124: y=c or t
  misc_feature 184: y=c or t
  misc_feature 185: w=a or t
  misc_feature 310: n=a, g, c or t
  misc_feature 315: k=g or t
  misc_feature 317: r=a or g
aaatgcgactccatctcccccgacccaagcgcgtaatggccgctggctatcttgggggagccagctgttggactatgccccactgccaggaaacaggcgccggaaggttctctgacaagatctygctttcctagggcggtgaaggcgttcaaaggtcgggaaggggcgctgggagaagcggggywgcgctgagccatgctcgcgaactgtgggtctgtctgtgaagagacccagtttcgtgggaccacggtggcgcctgcgctgggagagttcttcactaccacaaccaaggagggatatgataggcggncagtkgrtataactcctttagaacaaaggaaataacttt

SEQ ID NO: 10813 - DNA, 443 bp, Homo sapiens
  misc_feature 346: n=a, g, c or t
  misc_feature 418: n=a, g, c or t
gcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaaccccaggttacagttcctctgagtcatctcatcaatgccttccatacaccaaaaaacacttctgtttctctcagtggagtgtcagtttctcaaaaccagcatcgagatgtagttcctgagcatgaggctcccagcagngagttttcatacagtctcggggttttaaaactttgaaatcaggacacgacgtctccagtctacctccgagantttagctgaaacacagaatatagcg

SEQ ID NO: 10814 - DNA, 488 bp, Homo sapiens
  misc_feature 334: n=a, g, c or t
  misc_feature 335: n=a, g, c or t
  misc_feature 368: r=a or g
  misc_feature 375: r=a or g
  misc_feature 383: r=a or g
  misc_feature 387: w=a or t
  misc_feature 394: n=a, g, c or t
  misc_feature 396: r=a or g
  misc_feature 402: w=a or t
  misc_feature 405: r=a or g
gcggattgtctgtcgttgcagtagctgtaggaaggggaggccattttccgtttctgggaggagtgaggggcaacgggtcggagaaaaaggaaaaaagaagggctcagcgcctccccgccgggccgtggacagaggggcacagtttcggcaggcgggtgaggtcgctgagggcccgccggagatgttttccttgtcgagcacggtgcaacccaggttacagttcctctgagtcatctcatcaatgccttccatacaccaaaaaacacttctgtttctctcagtggagtgtcagtttctcaaaaccagcatcgagatgtagttcctgagcatgagnntcccagcagtgagccttcacttaacttaagggrccttggrttatctgraacwaaaattngrcaagawtgrtcaagctggtagaaaatctacttcctggattttgtaaaggcaaaaacatttcttcccattgggcatacatcccatgtctctgc

SEQ ID NO: 10815 - DNA, 412 bp, Homo sapiens
aaataagtcacaggccttggtcccttggagttcacagtctaatggggaagacaggatataagcaagtagtttcagcatagctttggaattgcatgcagagaagtgagtgaagtgagtgagggcccagccaaggctggagtaaagtggcatgatctcggctcactgcagcctccgcccccgccaggttcaagtgattctcctgcctcagcctcccgagtagctgggattacaggcgcaggccaccatgcccaggtcacccgtacttcatttaccagtccttgctaaggattattcattaaaacacacaacagcaacaataaccacaaaagcaacaataaaaatacctttgaactcactcaatcttgaactattgaacatgctaagtccgtgtcattggcctacttaatcagcc

SEQ ID NO: 10816 - DNA, 566 bp, Homo sapiens
  misc_feature 95: s=g or c
  misc_feature 523: r=a or g
aaatagcagtcccagaatgatttcactacagactctctggaaagcctgggagctgaattccggaagatccccacatcgatgaaagcaaagcgaascaccaagccatcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgtatccaagaatggacattcaaagaccaagtgagtttgtgagattctaacagatgcagcattttgctgctaccttacaagcttctcttctgtcaggactccaraaggctggaaagggaccgggactggaaagagaccaggactgaa

SEQ ID NO: 10817 - DNA, 410 bp, Homo sapiens
gactgtgtgatttttgttctttagtagaaggataacatgacatagcaggaataatactgccttttctttctggcatggatcaagagaaaagaaaatacaagaaaacagacagaagatcctatctgcgacaattaagagcactctaagaggaaaacacatcccaccacacaaggcaaggtacttctatggaagggtgagccctcacagatggagcaatggggcgcgcacacctgaacaagggaggggaaggagttcttatccctgatgcatgtgacccctgctgctgtgtccttcccctattggctaaggttagaccacacagcctaaactaattccgattggctaattcaaagagagcgacgggggcttctgacagctttggagattgtgacattggaataaaggaaaaa

SEQ ID NO: 10818 - DNA, 195 bp, Homo sapiens
agaataccaagactgtgtgtacacgcagatgtcagtggcagagaatgaagatcagcttcgtgcaaagggttatgacaaaacaccagacttcattttacaagtaccagttgtaatgctttgtccctagctgtagaagggcacataattcactggattgaaagcaaagcctcatttggtgatgaatgtagccaccac

SEQ ID NO: 10819 - DNA, 188 bp, Homo sapiens
tcacttaataaagcagtagaagttattaattttgttaaacctaggcccttaagcacatgtgtctttttaatattctagtgatgagatgggaagtacatataaagcacttttacaatgtggcaaagtgccatggttgtctcgaaaacaccagtatgattgagtttttactttgcagaatgattgacagg

SEQ ID NO: 10820 - DNA, 427 bp, Homo sapiens
agcagaatagaggcgccagaagatgcgccatgaggatacacattggccaatcagcttcagcaatggagcgtgcaaaacaccagtgagcttctgtcttgctggagggtcggctttgggcggaactggctttgttgaccgggagaaacgagatgggggtgaagctggagatatttcggatgataatctacctcactttccctgtggctatgttctgggtttccaatcaggccgagtggtttgaggacgatgtcatacagcgcaagagggagctgtggccacctgagaagcttcaagagatagaggaattcaaagagaggttacggaagcggcgggaggagaagctccttcgcgacgcccagcagaactcctgaggcctccaagtgggagtcctagcccctcccctgatgaaatatacatatactcagtt

SEQ ID NO: 10821 - DNA, 344 bp, Homo sapiens
  misc_feature 273: s=g or c
  misc_feature 274: k=g or t
  misc_feature 275: n=a, g, c or t
gactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtggctttctagaagatgaccatagaggaccttccagattttccattagaaggaaatcskntgtttggaagatacccatttatattttctgcttctgataccccagttatcttttccatttctgcagcac

SEQ ID NO: 10822 - DNA, 238 bp, Homo sapiens
  misc_feature 75: s=g or c
actaaagatggagaggcgccggggccttgcaggggagggggctcggcgttgacgtgggacgcggcggaggcgcasagccggtggtgatttgctaacctcgcagcagagaggagttgagggcgatgagagcgggtactgcgaactgccgggcgatgctgtcgctgccgccgtgatacggagagcaacagttcacactccccccagccttcacctggccatgaaggaccttttgaccaac

SEQ ID NO: 10823 - DNA, 430 bp, Homo sapiens
agtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggacct

SEQ ID NO: 10824 - DNA, 371 bp, Homo sapiens
  misc_feature 313: r=a or g
cttttctgacgatgcgaacaacatggcggcggaaagtggtagcgattttcagcagagacgtagaaggcgccgggacccggaggaaccggaaaaaacagaactcagcgaaagagagctggcagtagcagtggcggtgtcccaggagaacgatgaggagaacgaagagcgctgggttggacctttacctgtggaggcaacactggccaagaagaggaaagtcttagagtttgaaagagtctatcttgataatctccccagtgcatccatgtatgagcgcagttacatgcatagagatgttatcacccatgtggtrtgcaccaagtaagtctatcacatcttttttactttgttctgagtttatttaaaaaaaa

SEQ ID NO: 10825 - DNA, 382 bp, Homo sapiens
  misc_feature 117: n=a, g, c or t
ctagtgcgttacttacctcgactcttagcttgtcggggacggtaaccgggacccggtgtctgctcctgtcgccttcgcctcctaatccctagccactatggtgagtaagccgtgcgnctcccggctgctttcagggaagcagggaaaagcgagccggcggggcgctggggccctgtatacagccgggaagggctggcctcagagccgtccgtttggagggcggaaaacgaggcgagaggccagggcgggagtggtgagacctcggtgtgtgtaaatagcgggggcccggaaaggtcgaggggcgccaggatttcttctcggactctggaagggatggggggctcgggctgccctccgccgtatccggagctctcttttgtcg

SEQ ID NO: 10826 - DNA, 434 bp, Homo sapiens
gcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgta

SEQ ID NO: 10827 - DNA, 288 bp, Homo sapiens
  misc_feature 205: n=a, g, c or t
  misc_feature 216: s=g or c
gcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcgnagccggcggasaggttactcgcacgcggatttggctggcgtcccgcgtggtcttcgagggatagcacgaggtggtctgacagg

SEQ ID NO: 10828 - DNA, 324 bp, Homo sapiens
  misc_feature 171: r=a or g
  misc_feature 187: k=g or t
  misc_feature 214: r=a or g
  misc_feature 216: s=g or c
  misc_feature 239: k=g or t
  misc_feature 316: w=a or t
gcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcracaaaaccacaggggkattggccggctttttcggagccggcgrasaggttactcgcacgcggatttgkctggcgtcccgctaactggtatgaaccctctgtctccttatttaaatgtggatccacgatacctcgtgcaggatacwgatgagtt

SEQ ID NO: 10829 - DNA, 296 bp, Homo sapiens
  misc_feature 216: s=g or c
gcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggasaggttactcgcacgcggatttggctggcgtcccgcgatacagatgagtttattttacctaccggagctaataaaacccgg

SEQ ID NO: 10830 - DNA, 179 bp, Homo sapiens
aggtcaagtagtagcgttgggctgcggcagcggaggagctcaacatgcgtgagtgtatctctatccacgtggggcaggcaggagtccagatcggcaatgcctgctgggaactgtactgcctggaacatggaaattcagcccgatggtcagatgccaagtgataaaaccattggtggtgg

SEQ ID NO: 10831 - DNA, 217 bp, Homo sapiens
cagacaagatggctaggccatcaccaaccaacggacttaccttacatctttgtaggtaattccccccaaatcttgattttttttttcctcaattatcctttaaaaaataagaaaacacatttcaaacccaaaaggcacaaaacacgttcccttccaactttcccaaaacctcaaatttgttcccatttgaggtttattgaggtacacttctagcccc

SEQ ID NO: 10832 - DNA, 439 bp, Homo sapiens
aaaaatcacagccccttgtggagcccgagctctcattcacagctttctagagaaatctgagcccgaacctgccagaataggggatctcacccacccagttcagcagcgaggacacctgcagaaatacattcccaaagcaaggctgggcggccgtgtgaagtaagcaatggcctcagttttgcttctgttttggatgaacaccaccacatagggcctgaatgtgaaagaagaccctctatttgtctgttccggggcagcctggtagtaaaacactgttgaatgggccacagtttcagcagaccatcaggtgaatgggaccagtctctcttcttccaaaatatcagaagtaaacacttggaacggagatttggccaagatgacccatttacaggctggactcagtccagagactatagagaaagctcgcctggaactgaat

SEQ ID NO: 10833 - DNA, 343 bp, Homo sapiens
agaggagactcgggggccattttgtgaagagacgaagactgagcggttgtggccgcgttgccgacctccagcagcagtcggcttctctacgcagaacccgggagtaggagactcagaatcgaatctcttctccctccccttcttgggcagcaaggcgaaccccatccctactcactggagctcagctttgatttttaacctcccttccccacccttccagaacacacacattccattccaaaactgattttataaagacattttaaacataatgatgcaacttggtgtgcactacagcaaatgtacacacactagcctctgttttgaatcatgctttttcccc

SEQ ID NO: 10834 - DNA, 294 bp, Homo sapiens
  misc_feature 103: n=a, g, c or t
tttttttttgtgaagagacgaagactgagcggttgtggccgcgttgccgacctccagcagcagtcggcttctctacgcagaacccgggagtaggagactcagnaattcgaatctcttctccctccccttcttgcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaaga

SEQ ID NO: 10835 - DNA, 308 bp, Homo sapiens
  misc_feature 117: n=a, g, c or t
agaggagactcgggggccattttgtgaagagacgaagactgagcggttgtggccgcgttgccgacctccagcagcagtcggcttctctacgcagaacccgggagtaggagactcagnaattcgaatctcttctccctccccttcttgcagttgggttagaggaggaggagccttttagcctctcataaactgacctctctacttcctcgtgtatttttaagattgattgatgatgtggaaagggctttgcttgtctgctactgaaaactttatccttgcggtttttgtggaaactgcttttggaaaga

SEQ ID NO: 10836 - DNA, 438 bp, Homo sapiens
gcactcagtgtatcacaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcacaggaggcctacttgcttcaagaactgaaaatccagaggatgaattgctttatctgggaatggcaaaagccagcacaataaggaatgccaggtattctgaagattttctttttttcctctctttttacagagaagttggttacctccgagatgggctgtagctcttttgcacagattgccaattactgctgatgggtctctggtgaattacacaatggtcctcagagcctagaggccctcccccatccctatccc

SEQ ID NO: 10837 - DNA, 60 bp, Homo sapiens
  misc_feature 30: s=g or c
ctccttttagcataggggcttcggcgccasggccagcgctagtcggtctggtaaggcaaa

SEQ ID NO: 10838 - DNA, 269 bp, Homo sapiens
cttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtca

SEQ ID NO: 10839 - DNA, 403 bp, Homo sapiens
  misc_feature 309: r=a or g
agaaggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacrcaatcactgctgccagccaaaacccccatgctgcattcaggccaggtgctgtggtttggagaccaagcctgaagtctcaccccttaacatggag

SEQ ID NO: 10840 - DNA, 290 bp, Homo sapiens
atttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcc

SEQ ID NO: 10841 - DNA, 219 bp, Homo sapiens
tctatattagtggttaattgcagtttattaaagggatcattatcagtaatttcatagcaactgttctagtgttttgtgtttttaaaacagaattaggaatttgagatatctgattatatttttcatatgaatcacagctgttgacaatgtcccatatatttaagaaattatatcatactgatactatttgtaacattttgatttgatttaatctccagg

SEQ ID NO: 10842 - DNA, 252 bp, Homo sapiens
agctggaaccctcccacacttgactacagattaaccatcagacaggcttcactatacctggacaggcctcattatacccgcttcctttaggagtttccacatagccactgacccaccttcatgttaaaacagacatcagccaactggaaacacagactctctgtgacaataagaaaccaaattacaaacaagacctaaggccatgcaaggcaagaggtgactcccacgaccagtgcgggtcacagcacaggc

SEQ ID NO: 10843 - DNA, 437 bp, Homo sapiens
  misc_feature 281: w=a or t
  misc_feature 283: n=a, g, c or t
  misc_feature 314: n=a, g, c or t
  misc_feature 396: r=a or g
agaagaaatagcaagtgccgagaagctggcatcagaaaaacagaggggagatttgtgtggctgcagccgagggagaccaggaagatctgcatggtgggaaggacctgatgatacagaggtgagaaataagaaaggctgctgactttaccatctgaggccacacatctgctgaaatggagataattaacatcactagaaacagcaagatgacaatataatgtctaagtagtgacatgtttttgcacatttccagcccctttaaatatccacacacacaggawgnacaaaaggaagcacagagatccctgggaganatgcccggccgccatcttgggtcatcgatgagcctcgccctgtgcctggtcccgcttgtgagggaaggacattagaaaatgrattgatgtgttccttaaaggatgggcaggaaaacagatcct

SEQ ID NO: 10844 - DNA, 272 bp, Homo sapiens
  misc_feature 31: n=a, g, c or t
  misc_feature 32: n=a, g, c or t
  misc_feature 33: n=a, g, c or t
ttctttccccaagtctctatggtagcgtcannncggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggcgtcttccaaattgttggggtatttcatatgaagtagcccctacccccaccttgtcctttcccc

SEQ ID NO: 10845 - DNA, 227 bp, Homo sapiens
cccctccgctccaggcttccttctgcaacaggcgtgggtcacgctctcgctcggtctttctgccgccatcttggttccgcgttccctgcacaaaatgcccggcgaacacagaaaccgtccctgctacagagcaggagttgccgcagccccaggctgagacagctgtgctacctatgtcttcagccttgagtgtcactgctgccttagggcagcctggacctaccctc

SEQ ID NO: 10846 - DNA, 741 bp, Homo sapiens
  misc_feature 387: n=a, g, c or t
  misc_feature 394: w=a or t
  misc_feature 395: k=g or t
  misc_feature 396: n=a, g, c or t
  misc_feature 397: r=a or g
  misc_feature 708: n=a, g, c or t
  misc_feature 709: n=a, g, c or t
aggaatgggaaatgacgtgaggagtgcggaggggcgcgaggtttcaagatggcggtagctgaggggttgaccgagagacccagttgaaggcctttacgaagtgaaagaggccgggaatcgccccctacccgcttctcgtagtcctgggagcacagcagaagtgtttttctttttttaatgaacaagtaaaccatacaaattgtcaacatgggacggagatctacatcatccaccaagagtggaaaatttatgaaccccacagaccaagcccgaaaggaagcccggaagagagaattaaagaagaacaaaaaacagcgcatgatggttcgagctgcagttttaaagatgaaggatccaaaacagataatccgagacatggagaaattngatgaawknrgtttaacccagtgcaacagccacaattaaatgagaaagtactgaaagacaagcgtaaaaagctgcgtgaaacctttgaacgtattctacgactctatgaaaaagagaatccagatatttacaaagaattgagaaagctagaagtagaatatgaacagaagagggctcaacttagccaatattttgatgctgtcaagaatgctcagcatgtggaagtggagagtattcctttgccagatatgccacatgctccttccaacattttgatccaggacattccacttcctggtgcccagccaccctctatcctanngaaaacctcagcctatggacctccaactcggg

SEQ ID NO: 10847 - DNA, 374 bp, Homo sapiens
  misc_feature 370: n=a, g, c or t
taattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttntttt

SEQ ID NO: 10848 - DNA, 311 bp, Homo sapiens
ttttatttaaaatctatttttacactagttagaatcctgctgttttggccaagtacttgtcttgcatgtctgaccttgcagaagctggggtggatcatagcatactaatgaagagaattagaagtagtttacaaagctcgctcactcctcatttctctgtgatcccttctatccagtggccccaccaccacctgggaaaacagatttttcagtacaggtgggataaatgctctgaaaggctgtgcccagaggaatgagcaaataggcaagtgtttccaaactacttggaggtttacaaaaatatgtcccag

SEQ ID NO: 10849 - DNA, 216 bp, Homo sapiens
actctttcatcttcccatcatggccgccgcctgtgcgcctctgctgagtcaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcctact

SEQ ID NO: 10850 - DNA, 233 bp, Homo sapiens
ctctttcatcttcccatcatggccgccgcctgtgcgcctctgctgagtctgcttgagatgttttgcagaccctgcactcattggatcagctgactacctagaccagtaacctggctcaatcagttctgccattccacccaggaacagaaaacagcaagaaaacctcactttgactccctgtgattccgtcttcaacctgaccaatcagcactccccgcttcccaagctcccac

SEQ ID NO: 10851 - DNA, 555 bp, Homo sapiens
  misc_feature 16: s=g or c
  misc_feature 48: s=g or c
attcaccggcgacgcsaatacggttcctccaccgaggcccatgcgaastttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacat

SEQ ID NO: 10852 - DNA, 518 bp, Homo sapiens
  misc_feature 16: s=g or c
attcaccggcgacgcsaatacggttcctccaccgaggcccatgcgaagtttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacat

SEQ ID NO: 10853 - DNA, 226 bp, Homo sapiens
  misc_feature 142: r=a or g
taaattatccaattgtaggaaatcgattaacaaattcagagtacacctaaaaaataaaatactatgcagatgctaaaaatggtaatatagatgtataattaatattggacagaaagtcgctcatgatatattgatgtaaatratttcaaaacagcacgtacagcatgcatctgatttttaaagacatataatacagatatttattataggtgcatacatatatgcc

SEQ ID NO: 10854 - DNA, 163 bp, Homo sapiens
taggacagaagtgcatatgacacattgatgtgccgtatcacaaaacagcagttgggcctgtgggacggggctcaagacaagtcccatgctgggaatccacacttggaagctgccagctgatttttactaaagtcgccctgggataatggtcctctgccctgcc

SEQ ID NO: 10855 - DNA, 369 bp, Homo sapiens
  misc_feature 311: r=a or g
aagtagactcatagcatgctaggtcctcccttttcattatcttcctaggaaaacagttacccataggagcccagaaccttgcctagagtcaccctgccagcaagtggcagagctgcgatttgaatctggggcttatgcatctgattctgctgaggatgtcaaattaccaggctttggtctaagcagaagtcaggggacagcagtgaaaagagcacggttccacaccttgatgccgtctctcactttccctctgtgtgaccttggggcatcctggtattggagagaaggactcaggccccagaaatgaagtraaaacagcccaatttccaatactgattactttggaccagaaccgtacacagaaaaaga

SEQ ID NO: 10856 - DNA, 367 bp, Homo sapiens
cctctcccaattttattcccttattcatttcaagagctccaatggggtctccagctgaaagccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatgaaatggatcacatgagggtttcttgttgcttttggagggtgtgggggatattttgttttggtttttctgcaggttccatgaaaacagcccttttccaagcccattgtttctgtcatggtttccatctgtcctgagcaa

SEQ ID NO: 10857 - DNA, 204 bp, Homo sapiens
  misc_feature 135: m=a or c
  misc_feature 150: r=a or g
  misc_feature 191: m=a or c
aaaaacagccggggctccagcgggagaacgataatgcaaagtgctatgttcttggctgttcaacacgactgcagacccatggacaagagcgcaggcagtggccacaagagcgaggagaagcgagaaaagatgaamcggaccctgtgagtrtggctttcttccctctcccgccaccccctgccccacactgmagctgcaaacgcg

SEQ ID NO: 10858 - DNA, 464 bp, Homo sapiens
  misc_feature 349: m=a or c
  misc_feature 413: y=c or t
  misc_feature 414: y=c or t
aaggcctccaggctgctcagcttctgctcctgccttgcagaaccttccctgaaggctgtgaggcagccaggtctagccctctggagtagcagcagctgcgtggagcagctgaggcctcctggaccaaccagtcaggggcgggcgccagctgccagcctcatgagaggcattgccacatccagcccaggacagctgccagatggccaagctgcacagtaaccatagagaactgcccagctgagcccagcccaaaagcctgacccacagaatcatgagcaaagaaaattgtttaacccactaaatttgggagcagtttgctatgcagcaaaagatagctgatactccaggmctgcctagaaaacagcctggggcaagggttaagcgtgagtcatttactaagaaaatacaattcyyaggcagtagtgattcagggaagaattggcagcaaagccaggaacagcgtt

SEQ ID NO: 10859 - DNA, 347 bp, Homo sapiens
  misc_feature 19: m=a or c
  misc_feature 81: y=c or t
  misc_feature 85: m=a or c
accccatgtcctcttcttmtttgcaaattattgtctctctcaccacagcccttcccttttcctatgttacttcccattttyagcmctccattacaagtttacagatcacaaggtcactgaaataaatcactatgtgaaaaaaaacagctatgaaatagttgaagaattttccttctagtttaaaggaaaacctggaaaatattttcatctatatgtctagcaatctccttattcaacaacatttcacaacagggagctgtatcattcattttggaaaaaagcataaggagtactagataacaaagggccaaataaacaacagtttatgggaaatgtgccaccaactg

SEQ ID NO: 10860 - DNA, 361 bp, Homo sapiens
  misc_feature 100: s=g or c
  misc_feature 213: y=c or t
aggcattgaggcagccagcgcaggggcttctgctgaggggggacagaggggagacagaggcacggagagaaaggaatgtttagcacaagacacagcggastcgggattggctaaactcccatagtatttatggtggccgccggcgggggccccagcccagcttgcaggccacctctagctttcttcctaccccattcccggcttccctcctcytcccctgcagcctggttaggtggatacctgccctgacgtgtgaggcaagctaaggcctggagggtcagatgggagaccaggtcccaagggagcaagacctcgcgaagcagcagccccggcccttcccccgttttgaacatgtgtaacc

SEQ ID NO: 10861 - DNA, 260 bp, Homo sapiens
aaagaaggaaagcgggtccggttccttcaggacccgcttcagggggcaccgcggcggcttggggaccatttggagccccgtcctggggagaaaacagctcacgtctatggccctgactgcttaggcgggagctgcgtgcagtcagcttctccggggcatttttttctacacggttattgctctgtcacccaggctggagttcagcagtgcgatcttggctcattgcagccttgaacctcctgggctcaagtgatcctccc

SEQ ID NO: 10862 - DNA, 425 bp, Homo sapiens
cacaaaagcatacacttgtttttattatacattgattaacactgtttatgcaattaggagcagccagttgccctgggcaggagtatatgaaattatctaaaacataccagtaaagaagcctgccataatcttgacttctaggttcaaaagtcacttgtgaaggtaaaagaaaagatcaccaggagaacgcaaacagactcaagaggtccctctactcatcctttcctcccctcttccagtagagaaaacagctctagggtaggaagaagaaagagcaggtttgaagtggaaggaggagactcaggggtgagctggagctgcagttgatggaagtctgcatgcttcaagcttgggctcagggagaagagtggtgatccatgctggagacggctgcgggcagctcaaaggtctcaggaaatttccag

SEQ ID NO: 10863 - DNA, 535 bp, Homo sapiens
tagaattaaacatttcttttgtctttaaacaattatttttggagaaaaaggaacaatctagaggaatcctaagtcttctgtataagtagggtacaatatacaatgaaactaaaacagctcttgtcttttagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattcca

SEQ ID NO: 10864 - DNA, 445 bp, Homo sapiens
  misc_feature 279: w=a or t
  misc_feature 366: k=g or t
  misc_feature 367: n=a, g, c or t
gtttctgtggtgttgcaaagcagtatgtgctgagagaggaggattaagctcctggaggcagagctctcccacacacttgctggcttgctgggctccactgactggactgaaaacagggccaagaaaactgctgctgcagggggtcctgaaaacagctggaacccggcagtgatgtgggacctaacttgaagttaacctgtggtggtgaggttggaaccagttggattatgatttattttctacactcttgtacggaatgcagagctgttgtatcctgawgaatctactgctaaatatagtcatttggaataattttaagtattgatcttaaaacttgtaccacaacaagagtgtctaaaaagcackngaagctcattacgttcttacgaacattcatgaagtctcgtccaacaaaacagaagctgaagcagcggggaatcttgaa

SEQ ID NO: 10865 - DNA, 381 bp, Homo sapiens
  misc_feature 51: n=a, g, c or t
  misc_feature 252: n=a, g, c or t
  misc_feature 369: k=g or t
ggggtggaaggtgcctactagccggtgcaggtttcttctagcgcgtgtgcnggggtacctggtcgtcatggaggcggtattgaccgaagagcttgatgaggaagagcagctgctgagaaggcatcgcaaagagaagaaggagttgcaagccaaaattcagggcatgaagaatgctgttcccaagaatgacaagaagaggaggaagcagctcaccgaagatgtggccaagttggaaaaagaaatggaacaganacatagagaggaactggagcaattgaagctgactactaaggagaataaggtatgtgaaataaatgtttgtcgttgcctacaccatttgaaaacagctgtccacttctgttaaatgtkaaactgcttttt

SEQ ID NO: 10866 - DNA, 419 bp, Homo sapiens
gcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaa

SEQ ID NO: 10867 - DNA, 285 bp, Homo sapiens
gcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagaattaaaaaaggaataaactatgtgcttcttaaaatactatgcaaaacacaaaatgtcccaaaggacacaatgga

SEQ ID NO: 10868 - DNA, 466 bp, Homo sapiens
  misc_feature 27: s=g or c
  misc_feature 461: s=g or c
ctctagtgcgcactctcggaagcgcascgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacactctgcttgcaaccctgaagaaaacaggaaagactgtttcctaccttggccttgagtagcaggggcctggtccccacagcccacaggatggaccaaagggggcaggatgctgatcctcccgctggcttccagacagacctgggacttggcagtcatgccgggtgatggtgttcctgcggagaccctcagttgtcctattccttcctagsttccc

SEQ ID NO: 10869 - DNA, 444 bp, Homo sapiens
  misc_feature 27: s=g or c
  misc_feature 44: m=a or c
  misc_feature 133: w=a or t
  misc_feature 228: r=a or g
  misc_feature 229: s=g or c
  misc_feature 260: r=a or g
  misc_feature 439: s=g or c
ctctagtgcgcactctcggaagcgcascgaacccgccctccgamtccagagaggcgctgctgacaccgccgctgcctcagtcatgccgaagcacgagttctctgtggacatgacctgtggaggctgtgctgawgctgtctctcgggtcctcaataagcttggaggagttaagtatgacattgacctgcccaacaagaaggtctgcattgaatctgagcacagcatggrsactctgcttgcaaccctgaagaaaacaggaragactgtttcctaccttggccttgagtagcaggggcctggtccccacaacccacaggatggaccaaagggggcaggatgctgatcctcccgctggcttccagacagacctgggacttggcagtcatgccgggtgatggtgttcctgcggagaccctcagttgtcctattccttcctagsttccc

SEQ ID NO: 10870 - DNA, 455 bp, Homo sapiens
gtcaaatctcattacggatcccggctgaaagcattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggc

SEQ ID NO: 10871 - DNA, 221 bp, Homo sapiens
gtcaaatctcattacggatcccggctgaaagcattttgtttttcagctcacttcaagggtacctgaagcgaattggcaccaaagcagcagctgtattgccgcagttctagcttcaccttcacgatgtttcccttggtcaaaagcgcactaaatcgtctccaaggtgagcaaaaattatgacaaatcatttacaacaaccttatatcaatgtgtcctcgcgg

SEQ ID NO: 10872 - DNA, 268 bp, Homo sapiens
tactgttgtatgccaaaatctacaggataataatcgaatattgtaaattaatagtaggtagctctcaagtaagattagcgtatctgtctagtcacatgtctacccttgtaaaacaggacttctaatctgtctgcaaggagccattatctccaacaattttgtgagaagtgtctggggaggatcaacccccaatctcaacagaaaattaatttttatgacctgtgcaagttttggaggttgaacctccaaattttatatttatttgcct

SEQ ID NO: 10873 - DNA, 215 bp, Homo sapiens
aattatttttggcaacactttttgcttttgcaagccccagctgagtaacacaggaagctgaaagggtgggggcacccctggctcccatggttagaagaataagccaaacaagatcaaaacaggagctgcgagataccacttcctgcctctcccaggcaccctgaaactcactgagggaggcggacctcaaagccgagccccctcctctaccccca

SEQ ID NO: 10874 - DNA, 320 bp, Homo sapiens
gagtagttaggaaccaatgcagaggaagcaattcagaatgatcactgaatctgagcttctgctgtcacggaaggctaaaaggatagagatatagcttacagctgaaagtatgtacatagagatgaaataaagtaggcaagggagagtctcaaacacagtgggtctcgtagttgtaatgggagtttagatcagtatcagctgggtacatgggacagagtatggccaaggactggagagagctggggtgtttggtgctggagtgtggacttcatttatggaaaacttcatctagaggaaaacaggaggaaaagcagaggagg

SEQ ID NO: 10875 - DNA, 274 bp, Homo sapiens
  misc_feature 89: w=a or t
gttggactgtattaaaacaggagttttaaagaggtggttaagatagacagcagactttgcttctgaaggtgatagtgggatagcagatwatgtttcttgaactgtcacttggaaccaagtactgtgttaagaaagtactaggtttgttatcctaatcttcactccaaccctgtgaggtaggactgttatattaagtttatattaacttttttgttaccaccgttactttgttagcaaggtttaatattgatatcctttgatgtactaagagcac

SEQ ID NO: 10876 - DNA, 413 bp, Homo sapiens
  misc_feature 155: w=a or t
  misc_feature 159: r=a or g
  misc_feature 162: m=a or c
  misc_feature 166: n=a, g, c or t
  misc_feature 169: m=a or c
  misc_feature 182: y=c or t
  misc_feature 196: k=g or t
  misc_feature 202: w=a or t
  misc_feature 316: n=a, g, c or t
  misc_feature 317: y=c or t
  misc_feature 341: n=a, g, c or t
  misc_feature 360: k=g or t
  misc_feature 367: w=a or t
ctcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagatwaagraamaaanaamccaaaaaagcggyctgaatttaatagkgtttawaataaaaattttaaaaatgaccctcatagcacgcaaaacaggatggggaatttcccctcttctttctgtgacaatgcgcatcattcctgcattagtttttaacaccagactacnyacattcatcatttccctcattttncttttattttcttgcattkgtgaatwagttcaagaatgctagaaaagtgtcgagttgtgcacatccatttct

SEQ ID NO: 10877 - DNA, 382 bp, Homo sapiens
  misc_feature 4: m=a or c
aggmgcattcgttctctgttgttaggaatcatactgctctgttagggaagtgctgcaggaagggcagtttcctgaataaaaatctggctgcgaccagtcccatgtgtctggtaagtaagtaagtaagtaagtgccctttgaagggatcattaagacacagggagcatgaacctgagatcagaagcatttctttactaatttagattctgcgaaatagacggacctctccacccccaaacctaaaacaggccaggacttgtctctgtgctgaaagcaaatagcaagactaaagcaagccccagcctctttccacactccctgatacctaaggactgctttctcagctagaccagggtgggcatcagcgacgccttctcagcta

SEQ ID NO: 10878 - DNA, 185 bp, Homo sapiens
tgaatctgtgaggtggggacaattttaaccttttacaaatgacaaaacaggcccagagaggggtactaatctgccaagaccactacagcagaaagtggtgccagaaagaagtcaggccttgactccagggccctccctctgagcccggaaaccccctccacctccgcctaccatactccatcccg

SEQ ID NO: 10879 - DNA, 443 bp, Homo sapiens
  misc_feature 283: n=a, g, c or t
cagattttacttcttggttgacatctctctcaggttccaggcccctgtttattgtcagttgctttctgcatatcccacaaatctaagagtgtgaggcttagatgtcttaactaactttcataccagataacgtcatctggtaaatagctcgtttcccttccttccctgaggttctgtattgctcctatttttgcagttttaaaaaacagcttcactatcctgtcgtctaggctccagacttagccaaattgtgccggtgctattcaataacatcgcttgaacntcttgaatctttgtggcccatatccccattactagtactacaattattttaggaattaattttctttgacttgtttaccattttctctttatccccatcaagacacacgttcagaggacatctgagatgctcatttttcctagcttcataatcctagcca

SEQ ID NO: 10880 - DNA, 203 bp, Homo sapiens
  misc_feature 80: n=a, g, c or t
aaattctctctctgcgtgtgagaaaacaggcctggagaggctctgcgacccgcttaggaccacagaactcggtactaggnaaactcctattttaaaatccagccctgggtgggaagatttgggaagaatcgttaatattaagagagagagggagaaagaggattagatgagagtggcgcctccgctcatgtccgccccctccc

SEQ ID NO: 10881 - DNA, 389 bp, Homo sapiens
  misc_feature 146: r=a or g
  misc_feature 158: m=a or c
  misc_feature 171: k=g or t
  misc_feature 186: n=a, g, c or t
agccgtagccagatccgttgaaaggagtgcagagaggtctcattgcgctcccgaacagacctgacgtagatccgaagtggcccgcgccatctcaactatgaggggacacccgtaggcggcgggagagggacgccgcgagaagccartaaagctccagmaacccggaagtgkcttctgggaggggtngtacccggaagtgtggcacctcccgggccgcacccgggaagtgtgatgccaccgccgctacggggaagtaatggtatccggccaattgagattcggagttaaaacagggatgtgcagatggaggtcggaggagacactgctgccccggcccccgggggcgcggaggacttggaggacacgcagttccccagtgaggaagctac

SEQ ID NO: 10882 - DNA, 421 bp, Homo sapiens
  misc_feature 391: w=a or t
aaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtggggtgtwatcaagtgaattagtcacttgaaagatggg

SEQ ID NO: 10883 - DNA, 206 bp, Homo sapiens
atatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgca

SEQ ID NO: 10884 - DNA, 374 bp, Homo sapiens
ggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagccacattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagc

SEQ ID NO: 10885 - DNA, 397 bp, Homo sapiens
  misc_feature 337: n=a, g, c or t
  misc_feature 344: s=g or c
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggagagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccatnacccaasccactccccggggaggtccagaggagaccatcactcagcaaggacgaacgcca

SEQ ID NO: 10886 - DNA, 386 bp, Homo sapiens
  misc_feature 369: r=a or g
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctacgtratactctccctcccgca

SEQ ID NO: 10887 - DNA, 88 bp, Homo sapiens
tgttatcctattttattttttacggcaggagaccttttatgttagcctgtacacaatttcagggtagcctaaaacagtagttgacgcg

SEQ ID NO: 10888 - DNA, 390 bp, Homo sapiens
  misc_feature 207: w=a or t
  misc_feature 387: r=a or g
tgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcawttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattrggc

SEQ ID NO: 10889 - DNA, 163 bp, Homo sapiens
  misc_feature 129: w=a or t
  misc_feature 137: r=a or g
  misc_feature 138: k=g or t
  misc_feature 139: m=a or c
  misc_feature 144: w=a or t
cagaagagaacgctgtgccacttcagttttacttagttgtaagcgttttaatattaaaacagtcctgtaactattatagattagaatgcaaagtttgcatgaattgaagctaacacaggaaactttaawttaattarkmaattwatttatttttgagacaggg

SEQ ID NO: 10890 - DNA, 492 bp, Homo sapiens
  misc_feature 16: n=a, g, c or t
  misc_feature 489: k=g or t
gacgttagcgaagctncgcctctgggcccgccttcggggcccggatctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaaatgagtggtggattggctccaagtaagagcacagtgtatgtatccaacttgcctttttccctgacaaacaatgacttgtaccggatattttccaagtatggcaaagttgtaaaggttaccatcatgaaagataaagataccaggaagagtaaaggggttgcatttattttatttttggataaagctctgcacaaaactgtaccagggcaataaacaacaaacagttatttggtagagtgataaaagcaagcattgctattgacaatkgaa

SEQ ID NO: 10891 - DNA, 463 bp, Homo sapiens
  misc_feature 71: s=g or c
  misc_feature 72: y=c or t
  misc_feature 192: r=a or g
  misc_feature 197: y=c or t
  misc_feature 220: r=a or g
  misc_feature 223: w=a or t
  misc_feature 225: r=a or g
  misc_feature 286: r=a or g
  misc_feature 394: m=a or c
  misc_feature 398: r=a or g
aacgtcgaaagcagccgttgggagcccaggaggcggggcgcctgtgggagccgtggagggaactttcccasyccccgaggcggatccggtgttgcatccttggagcgagctgagagctcgagtacagaacctgctaaggccatcaaacctattgatcggaagtcagtccatcagatttgctctgggccggtrgtacygagtctaagcactgcggtgaagragwtrgtagaaaacagtctggatgctggtgccactaatattgatctaaagcttaaggactatggartggatctcattgaagtttcaggcaatggatgtggggtagaagaagaaaacttcgaaggcttaactctgaaacatcacacatctaagattcaagagtttgccgacctamctcrggttgaaacttttggctttcggggggaagctctgagctcactttgtgactgagtgatgtcaccat

SEQ ID NO: 10892 - DNA, 377 bp, Homo sapiens
tcaccattctagatgccatttaagaacatcatgcttcatgggaggacgttaaaatgtcagcattaacaggagtggaagaaattgattccaaccttcacagataactgagtcttgatttgacttcaagacttcagtggaggaagtaactacaaatgtggtagaaatagctagataactagaagtggtggagcctgaagatctgactgaattgctgcagtctcatgattaaacttgaacagatgaggatttgcttcatatgggtggatacagaaagtggtttcttgagatgaaatctactgctggcaaagatgctgtgaacatcgttgaaatgacaacaaaggacttcgaatatcagtaaaatcagttgataaaaccaa

SEQ ID NO: 10893 - DNA, 167 bp, Homo sapiens
ttaaataaacttggctgataaaacagtggctgggctcaagaggactgactccaattttgaaagaaatttctactgtgggtaaaattctatcaaacagcatggtatactacacaaaatctttcctaaaaggatgaaccaatccatgcaacaaactttgttttcttttc

SEQ ID NO: 10894 - DNA, 453 bp, Homo sapiens
  misc_feature 245: k=g or t
  misc_feature 349: n=a, g, c or t
  misc_feature 350: n=a, g, c or t
cctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttakgaaaagtaaaaaacatagaacatggcaaaagatacacgaaccaattatgttgaaatacttggaactttgcgtggatcttcgcaagagccacttggcaaaggagnngttataccagtataagaacatttgtcaacaggtgaacataaaatctctggaaggatgttgttagggcatatttgaaaatggcagaaggaaaaaactgaagctg

SEQ ID NO: 10895 - DNA, 416 bp, Homo sapiens
  misc_feature 126: s=g or c
  misc_feature 202: n=a, g, c or t
  misc_feature 203: m=a or c
  misc_feature 204: w=a or t
  misc_feature 274: n=a, g, c or t
  misc_feature 275: n=a, g, c or t
  misc_feature 276: k=g or t
  misc_feature 303: n=a, g, c or t
  misc_feature 399: n=a, g, c or t
  misc_feature 400: w=a or t
tttgttataatcaaatttgacttcctagcctgtggataatttactattaagtaaattattaccacagggagccagtgaggtcccagtagtctaaaacagttcatgtgttcacaaaaattgcctcgscggcagagattatgcagtaagataatttaactgaataatactatgtgcatgtatcttgcctcagatatactcatcnmwgtatgaatatacctctgatatggtttggctctgtgtccccacccaaatctcatcttgaatgtgtactccnnkaattcccacattttataggagggatcnagtgagagataatttgaatcaagggggcggtttcccccatattgttcttgtggtagtgaataagtctcacaagatctgatggttttatcaggggcnwctgcttttgcatcctt

SEQ ID NO: 10896 - DNA, 411 bp, Homo sapiens
caataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggg

SEQ ID NO: 10897 - DNA, 183 bp, Homo sapiens
  misc_feature 7: n=a, g, c or t
cgttaangtatttcattagtgttcctgagtgtaaaacagttttttcccaaatacttatggcagataagagcatttttgtaaataataaactagcaccgtttgggtaaatttgcattattttttggacaggttcattgtcatgtaaaacaaatatctcaaaattcattttacatttagcaaagg

SEQ ID NO: 10898 - DNA, 324 bp, Homo sapiens
  misc_feature 303: s=g or c
tattgataaccaccacccctttactaataaagaagctataattcaggaagaagataggtcccatgcaacccgttagtttccatctatccaccagagaacgttagtttgtcgagggaaacactggctgatggatccagtagtaggaaaacataatagacattcaggttttggtaaccaaagttgtgctaatcttgtagagtgagtaggagaatgttcctgcctattcttttcttggaagggtgtgtataagattggtaaaatttgccatttaagtgtaccatttagtggcattaatacattcasattgtttaatagccatcaccg

SEQ ID NO: 10899 - DNA, 451 bp, Homo sapiens
  misc_feature 136: w=a or t
caaaatatttcacccctaatactaccttgaattaatcagaatgggaactgggtaagttgatgataatggggttatgatttatctgatttaaatcatatacaatttataaaacataatcagatagaagtacatctawtggctgtcgtctctggtcgttggataagtcagcctgggctcaatgttgcaccattatggattccaaccccacaaactgaatataatgttatgacaatgtggaatgagattgagtctatcagagtctatcagacatctggcagcctagatttaatagaaggccctcggtgatttgggtccgagacatttgcagatcatctctcacactgggtaccattaaaagaattgattacatctggcctcttctgcctcagccatttcatattttccatagtgaggtattggccatgattggtccttgtttacagaattttcc

SEQ ID NO: 10900 - DNA, 251 bp, Homo sapiens
tggaagttaattaaagtagtatttcaccttgtaaggctgtaattcttggcacttgttatcctcattttctacatccaaagaccatggaccagaatatctcttaggaggtaagggagagtgaggctatcagccaaagaaaaagtctccagggggaaggggagaatcacttataatttaatactttgtggaaaaaacatctctgccacctatggccctccaataacaatggaagacagaatcaacaggtgaga

SEQ ID NO: 10901 - DNA, 233 bp, Homo sapiens
tacaatagaaagttaaaacataatgacttacctgtgttctattctttatgatggctgctggctttatcaggcctacttcttttttaagtatttgtggggtaatgaatatttaaatatgtaacctttttacctcaaagtaatctaagtataaatatggtcactaactgcacaaccaggtctcacagaactgacaggttttatttaatgacccattttcctttatttgaactcag

SEQ ID NO: 10902 - DNA, 143 bp, Homo sapiens
ttttattactgaaatttattctcaaagcaaatgtattttgtagatgtttcatttgggagattttgctttgccttaaaacatacaaaataaacctgtcttgtggtctgcccacctcaaaacctctgttacttgacatgtagaag

SEQ ID NO: 10903 - DNA, 222 bp, Homo sapiens
  misc_feature 121: n=a, g, c or t
tgtagattgagattagggtgtactggctgaactgtggaaaacatacaattctgtgttcctcagtaaatgagattagcgtctaatgagtagcacccctttactaacttagtagtagtataanatcatttttatttagttaattaccagagagatttagcataattttgttctggattcagtaaatcaagtcagcttggatcattcaccttaacttttccttta

SEQ ID NO: 10904 - DNA, 393 bp, Homo sapiens
  misc_feature 203: s=g or c
  misc_feature 230: s=g or c
tatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgattttagttctsacatgtatatattgcttcagtagagcsacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaccctgtctct

SEQ ID NO: 10905 - DNA, 1038 bp, Homo sapiens
  misc_feature 777: y=c or t
  misc_feature 798: k=g or t
  misc_feature 995: r=a or g
  misc_feature 999: w=a or t
  misc_feature 1026: m=a or c
  misc_feature 1027: m=a or c
ccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtccatttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaagggagagaactctggaggaacgctgagctgagcagcaccgaggacagcgcccggcagcgcccgcgcccaggtctccctccgcagccctgactcgcgcacacgctgagcttttgctcactccccytcgcgcggacacagacacackcatattcacacacccagacacacaccccgctgtacagtggcagaatcccacctgcagtcatccctcatcacagcctcacagtttttcgagatctggctccatttcgacgctgacggaagtggttacctggaaggaaaggagctgcagaacttgaatccaggagctccaaggcaggcgcgaaaagaaggctggattgragtwatcacctgaaatgaaaacttttgtggmmtcagtatgggc

SEQ ID NO: 10906 - DNA, 673 bp, Homo sapiens
ccaggagatgctgtgttccccgtgatgcagctggaacccaagctgcagcaggagatgcaagtttcaggatgttccccactgagctggaggaatatctacagcagtgatgcttgaaatttttgtatgaattattttgtcgtccatttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattctttaaaaggagagaactgaaactagcc

SEQ ID NO: 10907 - DNA, 355 bp, Homo sapiens
  misc_feature 117: r=a or g
  misc_feature 118: w=a or t
  misc_feature 124: y=c or t
  misc_feature 128: s=g or c
  misc_feature 293: v=a or c or g
  misc_feature 295: r=a or g
  misc_feature 311: b=c or g or t
ccctttccgtctggcggcagcatcaggtaggctgcgttgaggatctttgctcttccatccgcctttgatcgtcttcctcttcagccatccaggtccggggaccctgcgtcctcggarwtaggtytccstcctgtgcggccagagtttggtcaggatgcgggacagcaaaggggtggagaggcggcccccggggcgggttgagcgaagatgtgatggcggcgcgaattcgagctgggcccggatcctggaggaggcgtgggactgacgaatggggcgcccgggacaaggcagcvtraagtgaggctgctggbtgggtggggtagatgcattttcctcgagagttaatcctcggtgg

SEQ ID NO: 10908 - DNA, 429 bp, Homo sapiens
  misc_feature 105: s=g or c
aatgaattttgtgtcattgtttttggggcttatatttttaaaacatagaaattgccttttgttcatttgaaaagtaagtatgttgtatctgaaaaagggctctgsctcctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagcgcgagagccagcaagaaggccccactcagccttgagactggtggtcacacctccctgtcagagtcgcctgctgggctgaaggggcaatggattgtcattgttgaaattgtttggctcaggttataaggaggaacttgggaagtagaaagtgacttgaccatgtgca

SEQ ID NO: 10909 - DNA, 269 bp, Homo sapiens
tgaaatgaaagtgctttgattagtattagcattccccagaaacatacagggtaggtcaatctcagaatgaaatactatgaaatgagaactactgttgagttattacatccaatctctttgcttcttccttgtttccttacaatctagtgctccttttaaaacatagtcagattatgtcatttctgtgcctaaaacccttccgaataaaaaccaaagccctttatctttgctacctgtaaaacttatgtccacagctccttcccctaccc

SEQ ID NO: 10910 - DNA, 464 bp, Homo sapiens
gttgcgcatgcgcagtcccccttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgt

SEQ ID NO: 10911 - DNA, 400 bp, Homo sapiens
  misc_feature 20: m=a or c
gttgcgcatgcgcagtcccmcttgaacgcacctcaggatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacaggggcgtgatctcggctcactgcaacctctgccttctgggttcaagcgattctcctgcctcagcctcccaagtagctgggcctacaag

SEQ ID NO: 10912 - DNA, 337 bp, Homo sapiens
caagaaactggataggactaagcttcagtgttaaggccctctttctgcagaagggtaggcagcaactgacacaatcatacgattgggacagtaatctagcataccagtttactgtcccaatcctatgttctattgctcaaacttcatagaaatactgccctaatgatgtttgggcaatataacatttgagcaaagaatggtataaactggtcttttagtaggattaatttagcagtgatactcagcatgttttagagtggaaaacatatagaggcagagagatcagttaaggttttcagtttccctggcatgatcataagggagcctggttcacagg

SEQ ID NO: 10913 - DNA, 410 bp, Homo sapiens
  misc_feature 342: n=a, g, c or t
  misc_feature 349: s=g or c
  misc_feature 392: s=g or c
gagttccgagcgaccgatggagatggcggctgcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcgattataaattgagatgagtgctgtgaaggagaagtccattctgatgctctgagtgtcttacaagtatcaagaacttactatatgtggttgaataaacaatcaaggtaaagagcatcaagtaaanacttctsttgttgataagtacttcagacattcccccagtggctgaagtgsatatgaattatgaagttg

SEQ ID NO: 10914 - DNA, 110 bp, Homo sapiens
tgtcacagtatgtggcctccagcatgtaacatgaggaatcctttatttcattaattaatggctttttgacttgagccaaaacatatgtaaaggaaacagaagtaccgcac

SEQ ID NO: 10915 - DNA, 174 bp, Homo sapiens
atacaaccttaatttccctttgccgtgtaacctaacgtatttgcgggttctgaggattcggatgttgacatccttggtgggggcgggtggcggggggcattattttgtctaccacagtccaccccctggctccccaaaattcacctctattccacatgcaaaacatattcaccc

SEQ ID NO: 10916 - DNA, 575 bp, Homo sapiens
ttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaattttttttttt

SEQ ID NO: 10917 - DNA, 427 bp, Homo sapiens
  misc_feature 25: m=a or c
  misc_feature 44: w=a or t
tatttgtactaagaagtaacttgamccaaaacaccttttatgtwtgcttagggtatattttttcagtgtctgaaagtcaaaggtattcctgtcacaactgtaaacaaacttatcctaaatgtgttaaaacatattcttgggtactctatttatgtatctttcatgccttgaaaatctgaaggttaatccaaactcacatgttttagcatatttgagaaaaaaaaactaccttcaatatcagccttttaaatttcatgaagattttggtgaggaataatagtatatagtttaagtattgacaaaactttgaaagtttctttctttaaaatgggaaatactcaatatctaaatccaggtcaggcatgggatatcagtatttaacattggatgttttatgttttatatttataatgttcaaaatgcaagc

SEQ ID NO: 10918 - DNA, 156 bp, Homo sapiens
catatttctttaatagtctaaattaaattgataatgcaacctagaataattcaaactaaaacaatcaggtcacaggttccttgtgtcatttaaagcatgcaccctctgctgtatggatttggaactatccacagacaaaacatatttaaacagcgc

SEQ ID NO: 10919 - DNA, 489 bp, Homo sapiens
  misc_feature 86: w=a or t
caggaaattaaaaagagcaaccataaagagtctcatgggagcaatgcatgaacaaactgagaattttcataaagaaataaaatatwaacaaaaagtataaagttgaagaatacaataactggactcaaaaatttaatgtgtccaacagaagaatcgatgaagcagaagaaagggctatcaaacttgtagataggccattggaaatcatgtaatgtgaggagaaaaaagaaaaaagattgaagatagtttaagagacttttgagacatcctcaaaggggaataatttatacattaccagatggagaagatagagggaaaaggacagaaaacatatttgaagaaataatgtcagaaaacctcataattctggcaaggaaatagaaatttagatctaagaatctcgaacatcaggtatgatgaatccaaggagactcacaccaaaccatattgtaattaaataaaggttaaagacaatcttcagagcagcag

SEQ ID NO: 10920 - DNA, 268 bp, Homo sapiens
  misc_feature 134: n=a, g, c or t
  misc_feature 169: n=a, g, c or t
tggtgatcacatgttggtgagcaaacttaactggtagctcaaaacatatttttggttctaagctatgggtgcttcccagccaggtgtcaggacactctgcaaagacctaatatgtcacagcatgccaggcttancccctgtccagggtctggcccacccccttaatggnttcccaccagggttgtttctggttctatgacccactttgctctttccatcatttcatgtcctgccatttgcccttccgtaacaaaagtcaccttcatga

SEQ ID NO: 10921 - DNA, 374 bp, Homo sapiens
aattaaattctcagaaatgtgctccctggaattttgccaaacaaatttcttagtttacctcagtactgtgaagggagtgttacgttaaaacatcaatctcattttgaagacttcacttttacattaatatcattaatgtgggctaggaaaaaaggatataaataaattcaaatagaactattctgagtatcttacatgtggaaggtggagacacagctgagagagaatgaacctcgaaattccacagacctaaatttgaatcctcgtcccattctgtaactgggggactctgagtaagatatttactagatagaacctcagttttcttaactgaataattaggatctcacatatgtcagaaggtcagaaagcca

SEQ ID NO: 10922 - DNA, 339 bp, Homo sapiens
  misc_feature 265: w=a or t
gagatattgatgttctgaaataagattttatgaatttggatacccttttgaggaacttgatgtaaacatggtgttcagaaatctcgtgtctatctcaatgggatatttcttgtattacaccttgtcatttttttcacaatttatttacatctacttttgtttgaactggaatgaagagatgaaacactatggatatgttttccattcaaatggcactttagcatattgttctgttttcctgtaaaacatcatgggtgtgattttwatactgctgctgcttgtcacaattattataacttctctgtaatttcctctgaaataaaattgaatcacctgagg

SEQ ID NO: 10923 - DNA, 608 bp, Homo sapiens
  misc_feature 72: n=a, g, c or t
  misc_feature 73: n=a, g, c or t
  misc_feature 90: n=a, g, c or t
  misc_feature 93: n=a, g, c or t
  misc_feature 525: n=a, g, c or t
cattccgcattggcaatgccaaaggagatgatgctttagaaaaaagatttcttgataaagctcttgaactcnntatgttgtccttgaaanggncataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagtngcgattaattatttctggagtcatgggaacacacagcacagagggtaggggggccctctaggtgctgaatctacacatctgtg

SEQ ID NO: 10924 - DNA, 488 bp, Homo sapiens
tggatcggcatgcaaatacaatcagattatttgttttgctacctgaacaatccccagtatcttattccaaaaggacagcataccagaaagctggaggcgattctggtaatgtggatgatgactgtgaaagagtcaaaggacctgtaggaagcctaaagtctgtggaagctattctagaagaaagcactgaaaaactcaaaagcttgtcactgcagcaacagcaggatggagataatggggacagcagcaaaagtactgagacaagtgactttgaaaacatcgaatcacctctcaatgagagggactcttcagcatcagtggataatagagaacttgaacagcatattcagacttctgatccagaaaattttcagtctgaagaacgatcagactcagatgtgaataatgacaggagtacaagttcagtggacagtgatattcttagctccagtcatagcagtgatactttgtgcaatgcagacaatgct

SEQ ID NO: 10925 - DNA, 269 bp, Homo sapiens
  misc_feature 206: r=a or g
aagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacrtgaagatgctgcggctggcactaactgtgacatctatgaccttttttatcatcgcacaagccc

SEQ ID NO: 10926 - DNA, 321 bp, Homo sapiens
  misc_feature 289: r=a or g
agctatacgtacttacattgaaataaagaattatttgtctatattgtattgcaagccactaatttctttagacactatcatagtgtggcagtgctatagatgtatattttatcttgttttgataataaccaaaattatgatgaattgaactttagaaaatatatctgaagatgtggtgaaatggtttgcagtttattgttttgggaaatttgtaattttatatatcaaatttataacactattaaaacatcgtatgatagtctttttcatagtatagtgttttaatgarttttgaggtgttctaatgaaagtgtacaaacc

SEQ ID NO: 10927 - DNA, 183 bp, Homo sapiens
agtgcagcctgtccttaggcgtagggtaatggtgggcgacctggcagttcttgggctccttgggatcccctcgagaagcccccttgttagtgtatgaaaccgtcagttcactgccagtaatgaaaacatcgtgtccttagtcacctgccattagccttttcgaaaccattttttctgttccct

SEQ ID NO: 10928 - DNA, 343 bp, Homo sapiens
  misc_feature 71: y=c or t
gtccttcctctcctagcctaaggcgtgcaaacagagcgccactgggaggctgaaacctttaggccgatgcytgcttgcaaggtcaggcaagctggattctggtccccacctttgcagagagaacagcgatgttgtgcgcccatttctcagatcaaggaccggcccatcttactacctccaagagtgcttttctctctaataagaaaacatctactttgaaacatctactgggcgagaccaggagtgatggctcagcctgtaattctggaatttcgggaggccgaggcaggaagattccttgagcacaggagttccagaccagcctgggcaatgtagcaagacg

SEQ ID NO: 10929 - DNA, 477 bp, Homo sapiens
aatttccgcttccggtagtgagaacccttccggtgggctaggtactgagcgcgcgaggctctacagagtgaaggtttaaatccaaggtcatggcaaaacatctgaagttcatcgccaggactgtgatggtacaggaagggaacgtggaaagcgcatacaggaccctaaacagaatcctcactatggatgggctcattgaggacattaagcatcggcggtattatgagaagccatgccgccggcgacagagggaaagctatgaaaggtgccggcggatctacaacatggaaatggctcgcaagatcaacttcttgatgcgaaagaatcgggcagatccgtggcagggctgctgaggcctgtgggtgggacaccagtgcgaaaccctcatccagttttctctccatctcttttctttgtacaatcccatttcctattaccattctctgcaataaactcaaatcacatgtctgcaagaag

SEQ ID NO: 10930 - DNA, 360 bp, Homo sapiens
  misc_feature 203: k=g or t
  misc_feature 342: r=a or g
agccgccgtcagagccgccatcttgtgggagcaaaaccaacgcctggctcggagcagcagcctctgaggtgtccctggccagtgtccttccacctgtccacaagcatggggaacatcttcgccaacctcttcaagggcctttttggcaaaaaagaaatgcgcatcctcatggtgggcctggatgctgcagggaagaccacgakcctctacaagcttaagctgggtgagatcgtgaccaccattcccaccataggcttcaacgtggaaaccgtggagtacaagaaccatcaacgtccccctgcgccgggaccagaccatccgcttcgaccacgtgatcaccarcatgaacaacaattatga

SEQ ID NO: 10931 - DNA, 199 bp, Homo sapiens
tgagtataataaactttggtttttcctgatctctcacctcactgaccatatcataaaagaaaacaaaatggagggtaaaaggccacagagggtccactgcactgtctcatcacttacgttaatcactaatccttaagggtttaaattttcgtgcagtaaaacatcttccttttcattcctttcacctaggtataccgga

SEQ ID NO: 10932 - DNA, 293 bp, Homo sapiens
ccttacagtccaatggtagagacagatatatttgtctataccttagcaaagtaaaacatgaaaagatctgtactaatggaatgagctggatactgtgagtgtatttaggaggagtgattagttacgccttattagaacaacaaaaggctcagagaggagcatgccactagagctgggttttaaaagttaagtaggacttgattaggtagagaaggggaaagagaggccattctaagcagaaggaacaacgtgagcacagactcagactcaaaagtacatattgtatccaagga

SEQ ID NO: 10933 - DNA, 216 bp, Homo sapiens
  misc_feature 12: s=g or c
aggaagcggaasactaatgaccgaagcttcaagactttgacatgtgtgaaaacatgaaatgacccttggctcttattgttcttgctggtgtggtatgttcacggctgaaaagatggtcagaaggggaaaggaggaagtgagaagaaagaaacagggaaatgcaggctgaggaattaccaaggaggcaggaggtggagcaaaacacaccaagcctgg

SEQ ID NO: 10934 - DNA, 177 bp, Homo sapiens
cctggttggtacatgccgtcatgatgaaggatgactttggtttgagataatttgtcactccacattccatggagaaaagtgtttcattttgatgttggaaaacatgaccagagaagcatgtgactcagataatgttccccggaagttgcagagcaatctgtggtgtctgtcatagcc

SEQ ID NO: 10935 - DNA, 210 bp, Homo sapiens
  misc_feature 169: k=g or t
caacaatggactatgccttggtttttcactaatcaaaatcaaaattactctttaacatgataaatgaatttaccagtttagtatgctgtggtattttaataagttttcaaagataattgggaaaacatgagactggtcatattgatgaatattgtaacatgtgaattgkgatccatttctgatatgtcttgaactactgtgtctagtggg

SEQ ID NO: 10936 - DNA, 389 bp, Homo sapiens
  misc_feature 385: r=a or g
  misc_feature 387: n=a, g, c or t
  misc_feature 388: n=a, g, c or t
aaaaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgaatgagttccagaaagcagggttctcaacctcgtggacagcaatctgcagaagaagagaacttcaaaaaaccaactagaagcaacatgcagagaagtaaatranna

SEQ ID NO: 10937 - DNA, 305 bp, Homo sapiens
agggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaaggcctgaaccaaaatggaagttattccttgcgtctgaagtata

SEQ ID NO: 10938 - DNA, 207 bp, Homo sapiens
  misc_feature 9: w=a or t
  misc_feature 149: y=c or t
acatgtgtwtctgttttgtgttgtagcatttgttctggaagctcgtatttacattttaagtgtatctggtgagtgggctggagccctcgtctgggccggaaaaaaaaaagccctccgatccgtcttttagttgcttctcttcctttttyctctccggtttctcatcactccaaccagccgcgaccatgcccaggaagaaggcgacgg

SEQ ID NO: 10939 - DNA, 136 bp, Homo sapiens
cagaaaacatgattatgtgtcactttaatacaggaaatttaggtgttttttggtgtttttgtttttgtttttgttttctttccaaagctcacctcggggacaattccttgggcttctcctgaggtaatgatttacc

SEQ ID NO: 10940 - DNA, 539 bp, Homo sapiens
  misc_feature 108: r=a or g
  misc_feature 251: s=g or c
  misc_feature 519: k=g or t
  misc_feature 520: k=g or t
gaggggcggacggcgcggctgaccgggttgggtttaccgtctttccctcgaggtatcggggctgcttgggcccagaggaagtccctgaggaccgcagcagtgcctttrccgctgttgcagaaggagaaggcttgcagtcgagccccggggcctggggacggtccttcctctgccagcccccgccctccccactcaggcgcacacctccctcactgacgcattttgccgcacaagctgtaacatggcggcasgactgcggcctgaactctagggcagccgggttgatttttaaagcttcaaaatcctaagactcagcactgttgcggggagcacagggatcagttgtccttgtttttttttggtcttttcttcatttgaagattaagtattggagccatgggaataaaggttcaacgtcctcgatgtttttttgacattgccattaacaatcaacctgctggaagagttgtctttgaattattttctgatgtgtgccccaaaacatgcgagaactttcgkkgtctttgtacaggtgaaaa

SEQ ID NO: 10941 - DNA, 253 bp, Homo sapiens
  misc_feature 103: n=a, g, c or t
  misc_feature 174: w=a or t
gacgttgctcttgtgttctcgcgagaggcgggaaagggcgcagggtttgaaacatggcggacgacgtagaccagcaacaaactaccaacactgtagaggagcncctggatcttatcaggctcagcctagatgagcctgataagatccaggggctcctctacagtgttggtagtwtgtagctggggctttgatgttccttccagtgtcatttctcatccacataccctgacctggccccctcagtgttgtcacc

SEQ ID NO: 10942 - DNA, 245 bp, Homo sapiens
ctcaaacatggcggcgcccagcgcgcgaggacgtgatccgcttctgctccggcttggattgtagccttgacgaggtctgagcgaccatggaccggccggggttcgtggcagcgctggtgctgctgcattttttatcacctatgaatatgtgaagtggtttttgcatgctgattcatcttcatatttgacacctatgaaacatatgttggctgcctctgctggagaagtggttgcctgcctgattc

SEQ ID NO: 10943 - DNA, 406 bp, Homo sapiens
gcactctgccggcaacgccgaggcgcttctgcatctgtgggccgagcattcttcaggtcatctgaaccttctgagaaaacatggtcaacgtcttgaaaggagtgcttatagaatgtgatcctgccatgaagcagtttctgctgtacttggatgagtccaatgccctggggaagaagttcatcattcaagacattgatgacactcacgtctttgtaatagcagaattggttaatgtcctccaggagcgagtgggtgaattaatggaccaaaatgctttttcccttacccagaaatgaaaatactcaatatggaccatttaggaattataagcagcaactgtgaaagacttgccactcaatatcttaggtgactgattagacatagagggttgttttaggagcatgcc

SEQ ID NO: 10944 - DNA, 384 bp, Homo sapiens
agagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtgtgagtagctcggccgagatgggccttttggggccggacaagacggggctgggttggggatgatccgagcctttccaacaactaccccacgcagtcttcatctcttcacttcatctactttcctggctcgcgcccttccaggagcctttcccaccggagcctgcgaggagaggtccgtacttgctcgctaagtgtcagcttggcaggcttggccccg

SEQ ID NO: 10945 - DNA, 426 bp, Homo sapiens
acactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcagaactgcggattattcctagagatcgtgttggaagttgttaatatctgctacttggaacatacgattgcctttcagaataaatattggtattttttgttgttgtaaaattgaaatcaggcatttaacatactatgaaaacacca

SEQ ID NO: 10946 - DNA, 245 bp, Homo sapiens
tttcttttttatcagtgtgcttacttgttcagtaaaacatgtagatcctgaagtatgccaggccccgttctagacactagtaatacaaagatggatagtctcttaccctggaaatgtttgccaactcttcctagggggaagacaagtaataacgatctagccaatgtgttgcccatttatcattaactttatgtatattatgcatattacctcatgtcatcttcaaacttcatgagatggtagac

SEQ ID NO: 10947 - DNA, 174 bp, Homo sapiens
atttttccattgagatggtgaaatatcttttatcagtctcttgtgatacttcactacatttgatctgaaggaaactagttgttagcttccagatattctctgtaagtataatcacataggatgggctaaatcccccaaataacaagttgcaacaaaacatgtgaaatattatct

SEQ ID NO: 10948 - DNA, 442 bp, Homo sapiens
  misc_feature 330: n=a, g, c or t
atctagtggcagactcgagaggtataaaccttactcacagaactttctggaaaattaacagtgcgtatttgcctgaagaaggtcagtgtgcttgcttggagatcaggacgcaaaggtcaccatcagaaaagctaagtttgctgtatagtgaggatcaggagatctgatcctgattgcagaaccttccctgattacagaatcttggtggttggaataaaaacagggttgaatgagttccagaaagcagggttctcaacctcgtggacagcaatctgcagaagaagagaacttcaaaaaaaccaactagaagcaacatgcagagaagtaaantgagaggggcctcctcaggaaagaagacagctggtccacagcagaaaaatcttgaaccagctctcccaggaagatggggtggtcgctctgcagagaaccccccttcaggatc

SEQ ID NO: 10949 - DNA, 155 bp, Homo sapiens
taggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttcccc

SEQ ID NO: 10950 - DNA, 490 bp, Homo sapiens
  misc_feature 46: n=a, g, c or t
  misc_feature 322: y=c or t
  misc_feature 447: r=a or g
  misc_feature 482: y=c or t
tgtgtccccgggccaagatggctgcgcggtgctccacacgctggtntgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgctgctgacattgagacctggtgtcagcctcacaggaacaaaacattaccctttcatttgtactgcctccttccacacgagtgcccctttggccaaagaagattattatcagatattaggagtgcctygaaatgccagccagaaagagatcaagaaagcctattatcagcttgccaagaagtatcaccctgacacaaataaggatgatcccaaagccaaggagaagttctcccagctggcagaagcctatgargtaatatgacttcggtgcatgcggtcactgctgtycagctatg

SEQ ID NO: 10951 - DNA, 175 bp, Homo sapiens
tatcaaactttttaactgcagtgttttaatttaatctaatgatttgagttttttaaaagttacagtgttttatttacattttgagagtaaaagttaaaacattcctgagcggagaataacaataaaattgcatcttgcaagtttataacctttaagcactgagtaaaaggatcat

SEQ ID NO: 10952 - DNA, 537 bp, Homo sapiens
  misc_feature 364: w=a or t
agttgaatttatcagtgtgcctgtcccagagtttgcagatagtgatcctgccaacattgttcatgactttaacaagaaacttacagcctatttagatcttaacctggataagtgctatgtgatccctctgaacacttccattgttatgccacccagaaacctactggagttacttattaacatcaaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtattcagaaacgtgaagccagcaawttgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacag

SEQ ID NO: 10953 - DNA, 146 bp, Homo sapiens
tgtagagcaggatgagctgtttctctcaacaagagaaatctggttcctattgcaggtgagaaaatagtattaaaacattgccacaaggaccagtgctgtccctaggctaagccccacatttcagaccctagactctttcccccctg

SEQ ID NO: 10954 - DNA, 364 bp, Homo sapiens
  misc_feature 15: r=a or g
agggtagtgtcctargctgggagaatgggatggagcctccacctcatgaagtagcttcctttggaggtggctatggcaggtcttcggagagaatatgcttttaaggctattaaccagggtggccttacatcagtagctgtcagagggaaagactgtgcagtaattgtcacacagaagaaagtacctgacaaattattggattccagcacagtgactcacttattcaagataactgaaaacattggttgtgtgatgaccggaatgacagctgacagcagatcccaggtaatatctgttttgatgaatttgaaggcaattgatttgtaaccaaaccatagaagccatatccaatcccattcactgg

SEQ ID NO: 10955 - DNA, 422 bp, Homo sapiens
  misc_feature 386: k=g or t
  misc_feature 394: k=g or t
acgggctttccacagcgcgggggaacgggaggctgcaggatggtcaagctgacggcggagtgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttktctttttkatttatattttgaaaaaatattttttcc

SEQ ID NO: 10956 - DNA, 226 bp, Homo sapiens
  misc_feature 60: s=g or c
acgggctttccacagcgcgggggaacgggaggctgcaggatggtcaagctgacggcggastgatcgagcaggcggcgcagtacaccaacgcggtgcgcgaccgggagctggacctccgggggtataaaattcccgtcattgaaaatctaggtgctacgttagacccccggaggtccagccccttttccaggaaccttgccacacccacacctgcagcctcccctcc

SEQ ID NO: 10957 - DNA, 266 bp, Homo sapiens
atttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcac

SEQ ID NO: 10958 - DNA, 195 bp, Homo sapiens
agtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacatgaaaagtttggaaattgtttgccct

SEQ ID NO: 10959 - DNA, 446 bp, Homo sapiens
  misc_feature 7: w=a or t
  misc_feature 282: n=a, g, c or t
  misc_feature 291: m=a or c
  misc_feature 414: n=a, g, c or t
  misc_feature 415: n=a, g, c or t
  misc_feature 424: w=a or t
  misc_feature 427: w=a or t
  misc_feature 428: w=a or t
acgcctwtaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataaaacatttccccagaggagctcaaaatggagttgccggagagacagcccaggttcgtggtttacagctacaagtacgtgcatgacgatggccgagtgtcctaccctttgtgtttcatcttctccagccntgtgggctmaagcgggaacaacagatgatgtatgcagggagtaaaaacaggctggtgcagacagcagagctcacaaaaggtgttcgaaatccgcaccactgatgacctcactgaggcctggctccaaagaanngttgtcttwctwwcgttgatctctgggctgg

SEQ ID NO: 10960 - DNA, 413 bp, Homo sapiens
  misc_feature 7: w=a or t
  misc_feature 265: n=a, g, c or t
  misc_feature 381: n=a, g, c or t
  misc_feature 382: n=a, g, c or t
  misc_feature 391: w=a or t
  misc_feature 394: w=a or t
  misc_feature 395: w=a or t
acgcctwtaagacagcggaactaagaaaagaagaggcctgtggacagaacatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggctgcaagcggnaacaacagatgatgtatgcagggagtaaaaacaggctggtgcagacagcagagctcacaaaaggtgttcgaaatccgcaccactgatgacctcactgaggcctggctccaaagaanngttgtcttwctwwcgttgatctctgggctgg

SEQ ID NO: 10961 - DNA, 317 bp, Homo sapiens
acaatttaattgcaacttcaaggcattcagcatgagctgtttcttctccacgaccgagaaagggtttccagagcatggctagatttacacagtgtcccagaagcttttgttgacaattccagtttccgaacaaaacatttcggcaatggtgagggcttcgatcccttctctgatttgctgtcagccatgaacggatggatgtgatgcctgctagccaaaaggcttccctctgtgtgttgcagtcctgtggcattatgcatgccccctcccagtgaccccaggctttttatggctgtgagacacgttaaaatttcagg

SEQ ID NO: 10962 - DNA, 211 bp, Homo sapiens
tggaccatataggttggtagccccataagattatataacacctaaaacatttctatcaaccgcaatttagtagcagtagtaacaccatagtgcagcacattatttaagtgtttatggtgctggtgtaaacgtgctgcactttcagttgtataaaagtacaagacagcggccggggacggtggctcacgcctgtaatcccagcactttagga

SEQ ID NO: 10963 - DNA, 171 bp, Homo sapiens
aatccctggacctctgaggagaggagaggggctgaaggttgagttgctcaccaatgccagtgacttaatcaatcatatctatgtaattatgcctccataaaatcccaaaatgactaatttcaaagaacttctcggttagtgaaaacatttgcatgccagaaggcgctcgca

SEQ ID NO: 10964 - DNA, 383 bp, Homo sapiens
  misc_feature 97: r=a or g
  misc_feature 98: s=g or c
  misc_feature 126: s=g or c
  misc_feature 322: n=a, g, c or t
agtaaaggtgatggaacctgcctggacaacctcatacgattgtcatcaggaatcagggaagtgtgaatagacaagaaaacattttgcaagcagtgarsccaagtcgcctgaggaattgtattattsatagccaataggcagacaggatgtctgtgtcttcattcttggaggaagtgggagaatgcaagagggtgtcgggggggtctgacaggtctggttccaattgccgcactgagacttactagataaggtcatcatgaggcctcttggcaccctgccaggcatcttttcctggagatgttgccctgggtcatcttgggtnatatgccagaatattgaaattgtaaaaagcatttttataagcaacactttcttccaattct

SEQ ID NO: 10965 - DNA, 459 bp, Homo sapiens
ttcttctcttccaaatgcattccagtttccactattcaaggtggcgagaatgatccacggatgtcccacatgagccacctttcaccttctcatgccgaccaacaactgacgaatgaaacacaccccaagagaaaatacgaaaccgagtcccctgcaattacctcacacgcaaacctacacgtcggtaggtcatattcagaaatacacactgaatgtcacctatcatgaacacaaacactcagagagtcccaccagaggttcggaagactcacgaccccaaaacttgatgtttcccatatgcgggctcatcctgagatgtagccatcactatccagttgtccctgttgtagagacagaaacttgggctcctcattagtttatgtaggattgacggtgttcgtgtttgtgtgggtgtgtgtgtgtttgcgtgcgcgcttctgggtgtaggggggatcacta

SEQ ID NO: 10966 - DNA, 644 bp, Homo sapiens
  misc_feature 35: w=a or t
  misc_feature 74: m=a or c
  misc_feature 107: n=a, g, c or t
  misc_feature 121: r=a or g
  misc_feature 128: s=g or c
  misc_feature 130: n=a, g, c or t
  misc_feature 151: n=a, g, c or t
  misc_feature 186: n=a, g, c or t
  misc_feature 251: n=a, g, c or t
gtgtggagctgccagagtaaagcaaagagaaaggwagcaggcccgttggaagtggttgtctacttgcaatatgmgctctgggctggacgcggtggctcacgcttgtnatcccagcactttrgggaggscnaaggcaggcggatcacgaggncaaccccagcaatgtggagaagcctggggcttgcnctggctctctgtctcctcccatcgggaggaacagagagccaggaccaaagctccttatgtaagcnacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaaga

SEQ ID NO: 10967 - DNA, 388 bp, Homo sapiens
tcgccatcttttccggcgctggctccgcatggtcagtgccatttcgcctttatcgtggtggagtccaccctggctgtggacctattcaaactcagtctgtctcttgactggaggaggagaaggaaaagttgagcacattgccaaccggagttccccaagaatggcaagttaaaaccaaagtgtcagcacctcaacaacatttttttttggcttaacaaaacatcaaacggcatacaaatggcagaaatccacaatggaggggaactctgtgactttatggaaaatggagaaatcttcagtgaacactcatgccttaatgcacacatgggaactgaaaatacaggggacacttatgactgtgatgagtatggagaaaactttcccatgt

SEQ ID NO: 10968 - DNA, 432 bp, Homo sapiens
  misc_feature 352: y=c or t
  misc_feature 353: s=g or c
  misc_feature 405: r=a or g
aaactacctacctaagcgatgaaatccaaaggtgaatcttttggttggtgattttgatgatagccacaaagcaagcagggtaatgctgatgcttcaagtcttggaaccacacttcgagaatcactgttataatgtacagcagaactgcatgatcagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgcystgtatgaacagcccccatcttcccatgcttgtcaaaaatcagaggcaactarcactgcggcttcctgagagtctcactc

SEQ ID NO: 10969 - DNA, 355 bp, Homo sapiens
aaactacctacctaagcgatgaaatccaaaggtgaatcttttggttggtgattttgatgatagccacaaagcaagcaggctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactc

SEQ ID NO: 10970 - DNA, 252 bp, Homo sapiens
  misc_feature 13: s=g or c
  misc_feature 26: r=a or g
  misc_feature 66: n=a, g, c or t
  misc_feature 152: s=g or c
  misc_feature 217: s=g or c
  misc_feature 219: m=a or c
  misc_feature 222: y=c or t
catatcccctgtsacctgcacgtatrcatccagatggcctgaagcaactgaagatccacaaaagangtgaaaatagccttaactgatgacattccaccattgtaatttgtttctgccccaccctaactgatcaatgtactttgtaatctccsccacccttaagaaggttctttataatttcccccacccttaaggaggttctttgtaattctccccsamccyttgagaatgtactttgtgagatccaaccct

SEQ ID NO: 10971 - DNA, 362 bp, Homo sapiens
  misc_feature 94: m=a or c
  misc_feature 326: k=g or t
aaaaactaacccctctttttctccaaaggagtgcttgtggagatcggatcttttctccagcaattgggggaaagaaggctttttctctgaattmgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgtkcaagaagatcaccatcttgactgatcaatgtgcttt

SEQ ID NO: 10972 - DNA, 466 bp, Homo sapiens
  misc_feature 94: m=a or c
  misc_feature 325: w=a or t
  misc_feature 415: s=g or c
aaaaactaacccctctttttctccaaaggagtgcttgtggagatcggatcttttctccagcaattgggggaaagaaggctttttctctgaattmgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgwtcaagaagatcaagtcttttgaggtggtctttaacgaccctgaaaaggtgtacggcagtggcgagaaggtggctggccgggtgatagtgsaggtgtgtgaagttactcgtgtcaaagccgttaggatcctggcttgcggag

SEQ ID NO: 10973 - DNA, 387 bp, Homo sapiens
  misc_feature 282: n=a, g, c or t
aggacgggcagggcacgcactggccccggcgcccacccgcacccctccccagagcactgacacggctcccgggacctcggcaggatggaagagaagctgaagaaaaccaagatcatctttgtggtgggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctngttccactggagacagtgttggacatgctccgggatgccatggtggccaaagtcaatacttccaaagcttcctgattgatggctaccgcgggaggtgcagcaagg

SEQ ID NO: 10974 - DNA, 300 bp, Homo sapiens
  misc_feature 113: k=g or t
actcagagagctgggctggagctccaagcggaaaccgcgggagccgagcccagctaggaatgcagacctcctgaaaaccaagccgaggactgcggggtccggtgtccacgcakagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagccaaaaagcctacccaag

SEQ ID NO: 10975 - DNA, 194 bp, Homo sapiens
  misc_feature 117: r=a or g
ctttaagaggtatggctttaccaggtatggtttcagctgggtgcgccaggcccctggacaaggacttgagtggctgggctggatcagcggttatagtggagacacaaagtatgcacrgaaggtccagggcagactcaccgtgaccacagacaaaaccacgagcacagtctacatggagctgaggagactcagag

SEQ ID NO: 10976 - DNA, 384 bp, Homo sapiens
  misc_feature 92: n=a, g, c or t
  misc_feature 125: y=c or t
  misc_feature 140: n=a, g, c or t
  misc_feature 167: r=a or g
  misc_feature 252: s=g or c
accacccaaaaaccacacccctccttgggagaatcccctagatcacagctcctcaccatggactggacctggagcatccttttcttggtggncagcagcaacaggtgcccactcccaggttcagytggtgcagtctgganctgaggtgaagaagcctggggcctcartgaaggtctcctgcaagacttctggttacacgttggacagttttctattagttgggtgcgacaggtccctggacaagggtttgastggatgggacggatcaccacttacaatggagacacaatccatgcacagaagttccagggcagactcagcttgaccacagacacatccacgagcacagcctacatggagttgaagagctgcgatctgacgaca

SEQ ID NO: 10977 - DNA, 303 bp, Homo sapiens
  misc_feature 19: r=a or g
  misc_feature 20: s=g or c
  misc_feature 126: y=c or t
  misc_feature 136: n=a, g, c or t
agaacggcttccggcggarstgtgcagctccttatcatggggacaattcatctctttcgaaaaccacaaagatccttttttggcaagttgttacgggaatttagacttgtagcagctgaccgaagyctggaagatntgctctttggtgtaataaacttgatatgtactggcttcctgcttatgtggtgcagttctactaatagtatagctttaactgcctatacttacctgaccatttttgatcttttagtttaatgacatgtttaataagtactgggtaacattgaggaaacctagccctgt

SEQ ID NO: 10978 - DNA, 265 bp, Homo sapiens
  misc_feature 165: r=a or g
  misc_feature 166: s=g or c
actctcggggagggagttggggaagctgggttggctgggttggtagctcctacctactgtgtggcaagaaggtatgggtcatgaacagaaccaaggagctgcgctgctacagatgttaccacttctgtggctgctaccccactcctgggccgtccctgaaggtarsatggtactcctatttacttccatcctgaacctagggagcccactcagctttgtgaggaaaagcgctgtgctttgtgagtggtgggaagtcttatgaggc

SEQ ID NO: 10979 - DNA, 280 bp, Homo sapiens
ataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtcc

SEQ ID NO: 10980 - DNA, 436 bp, Homo sapiens
  misc_feature 346: s=g or c
  misc_feature 415: n=a, g, c or t
aacaggcaggcccggggctcgtgtgaagaacacagtggaagcatcctccaagccagccaacaaatttccgttttctactgccctttcgggccaggggttattttatgagcatctccgatgttgcacacgtggcgtgtgaaccgagagaaagaagatggagagatcaccctccagacgtcgtcgcctggaagaggccccaaaccaagatccaattccctggagaatttttaacccctcccactccacccatcactttcctggctaacatcagacactggatcaaccctaaaaaggagtccatccacagcatccaaggatccatagtgtcccctcacactgcagccascaatggaggctactcccgaaagaaagatggtggcttcttctccacctagtgttgacagatccctgaacnattatagtgaaacataccgcg

SEQ ID NO: 10981 - DNA, 433 bp, Homo sapiens
  misc_feature 250: y=c or t
aaccgaaaccagcgctccaaacaattgggacccgggatcttatgccagtgaggctgtgctgcggctgagcgggcctcccatccctcttaaaagagttaggcatttagccatgcctcccacccgggaccctttccagcagcctacattagataacgatgattcctacttaggagaactgcgggcttccaagaaccaagatccaattccctggagaatttttaacccctcccactccacccatcactttccyggctaacatcagacactggatcaaccctaaaaaggagtccatccacagcatccaaggatccatagtgtcccctcacactgcagccaccaatggaggctactcccgaaagaaagatggtggcttcttctccacctagtgttgacagatccctgaactaattatagtgaaacatactgcggccca

SEQ ID NO: 10982 - DNA, 851 bp, Homo sapiens
  misc_feature 760: r=a or g
tcatactcacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagccagatctgccagtgagcctcaggctttaggaactgaagagtgtttctgaaagatctatccagcactccgatggccagcaacaacaccgccagcatagcacaagccaggaagctggtagagcagcttaagatggaagccaatatcgacaggataaaggtgtccaaggcagctgcagatttgatggcctactgtgaagcacatgccaaggaagaccccctcctgacccctgttccggcttcagaaaacccgtttagggagaagaagtttttctgtgccatcctttaagtctttgagaggggcctgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaaatcctcatgtttctgcttcatattttgaaaartaacaattaaaacagacagctgtactgaggtaagatatgtgtgaccttcttggaatgaatattgtctttagaataccctttgataagctga

SEQ ID NO: 10983 - DNA, 587 bp, Homo sapiens
  misc_feature 426: m=a or c
gggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaaggtaagtgatgactcagtggaaagcatgtttattgacttattttttttgtgccctmccagctccttttaaaagcagtgtgtcatttttaccttttaaattacttacattttagaattaggatcttattactttagtgaagttgttttattcatttatttttttaagtaatttcaaacttgtcaaaagttgcattaaataatacacagaagtccctgc

SEQ ID NO: 10984 - DNA, 427 bp, Homo sapiens
cagaatgaatctatgctggatagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttccc

SEQ ID NO: 10985 - DNA, 517 bp, Homo sapiens
gatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaaataacaaggtcctaagggagggcatgccacaggctccaggccacagaggcaaagacatggaccctgttccacctgcccctgcaagtctcaagtgccaccagaccccttctca

SEQ ID NO: 10986 - DNA, 424 bp, Homo sapiens
  misc_feature 407: n=a, g, c or t
  misc_feature 408: m=a or c
  misc_feature 409: m=a or c
gatcttcttcctgcgtggagagccttcgcgggtgaggcttaacgcgcaggaggtctcacgagagtggaagcaactctcgcgaattttaaaatttatctttttgcctagcgactgacaacaggctggttgcttggcgtggaatcctaaagtggcctggctttgagactggagtgagaccccagccctaggctggggttctttccattatagaggagacggattcagaagggctacagaccaaggttgttgaaaaccagacatatgatgagcgtctagagattaacgactccgaagaggttgcaagtatttatactccaaccccaagacaccaaggacttcctcgttctgcccatcttcctaacaaggctatggctgataacagcagtgatgagtgtgaagaggaaatnmmcaaggagaagaagaa

SEQ ID NO: 10987 - DNA, 369 bp, Homo sapiens
  misc_feature 185: r=a or g
catttgtaaattttcaagcagcaatagagaaaaaaattcatgcatctcaacaaaggtggcagcagttgaaggaagagattgagctacttcaggacttaaaacaaaccttgtgctcttttcaagaaaatagagatcttatgtcaagttctacatcaatatcatccctgtcttattagggattaccrtttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacattc

SEQ ID NO: 10988 - DNA, 170 bp, Homo sapiens
  misc_feature 87: r=a or g
ttccgcttctactggtgatatgggaagggcgcactcactgaactaactccctatccctctactcccagagcccgcccggcaggaccrccgagcaaggccttggaaaaccagagagattagagcgaatggggaaatggagagagaacctgaaagagccccaaactcgagga

SEQ ID NO: 10989 - DNA, 453 bp, Homo sapiens
  misc_feature 126: m=a or c
  misc_feature 240: y=c or t
  misc_feature 393: n=a, g, c or t
cttctcttaccgccatcttggctcctgtggaggcctgctgggaacgggacttctaaaaggaactatgtctggaaggctgtggtccaaggccatttttgctggctataagcggggtctccggaaccmaaaggggagcacacagctcttcttaaaattgaaggtgtttacgcccgagatgaaacagaattctatttgggcaagagatgcgcttatgtatataaagcaaagaacaacacagtyactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaagnatttaaactaacgaaaaatcaataaataaatgtggatttgtgctcttgtatttttaagtg

SEQ ID NO: 10990 - DNA, 335 bp, Homo sapiens
  misc_feature 36: s=g or c
  misc_feature 37: r=a or g
  misc_feature 129: s=g or c
  misc_feature 131: m=a or c
agggcttcgtgcggtgaggctcgctcgcgcggcagsrgatggccgaggcctcttggttctgcggcacgtgacggtcgggccgcctccgcctctctctttactgcggcgcggggcaaggtgtgcgggcgsgmaggggcacgggcacccccgcggtcctcgggaggctagagatcatggaagggaagtggttgctgtgtatgttactggtgcttggaactgctattgttgaggctcatgatggacatgatgatgatgtgattgatattgaggatgaccttgacgatagcagttccaagcaccagtaacatacacagcaaccacttccctttgttcct

SEQ ID NO: 10991 - DNA, 257 bp, Homo sapiens
  misc_feature 139: s=g or c
agccacgtctcatcctattcatggcagagcggggactctcaccctctcccagcaatgtctaaagtcaggcatctgaaaaccagcagtaatcctgcctctgaagtttatcaggaaaggagcttaaaagagaaccaaattsagcctgtgttggaactctcagtcccagaggggtgtggtttgtagctctccggcctgctgttggacttaggctgtgacccacagaaggacgccagaaagtactcaagacattcacggtg

SEQ ID NO: 10992 - DNA, 228 bp, Homo sapiens
  misc_feature 129: r=a or g
agtgtgcaggcttagaggaacaaatataacttagtatcatttagtcaaaaccagctggagccacagcactagggatttcattgttgcccttcccacaggctgcttcttggggcttagagcagcatggaragtgggtctggaggggcaaacagggacctggcacaccaggaaagctatccaacctctctgaaccaaggcttgcagcatgaaggggctgagacatctgag

SEQ ID NO: 10993 - DNA, 312 bp, Homo sapiens
  misc_feature 277: k=g or t
  misc_feature 278: y=c or t
aaaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagaataagactgattttatgggaaaattaagcagatgctccagtttgagaaacctggatctgcgatctgtttgtggcacagcactttgggagkytgaggcgggcgtgagattgggagtttgagaccag

SEQ ID NO: 10994 - DNA, 226 bp, Homo sapiens
  misc_feature 151: w=a or t
  misc_feature 152: r=a or g
aaaaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctwrttcgtggccggaggagtctcaagagctgtcagaaagaataagactgattttccacacctgcctggccccctccc

SEQ ID NO: 10995 - DNA, 432 bp, Homo sapiens
  misc_feature 3: n=a, g, c or t
  misc_feature 298: y=c or t
  misc_feature 299: w=a or t
  misc_feature 317: n=a, g, c or t
  misc_feature 343: m=a or c
  misc_feature 344: m=a or c
aanaccagcttgtcggcgccattttgtctcggcagcggtggccgtagctccatcgcattttatgtttctggcgagaagggaacggagttttcatcaggtagattggtttttgtgcggccgtcctccaccgtttcctccaggacagcacctagtcgtggccggaggagtctcagagctgtcagaaagtcacgctctgtcgccaggctgaagtcagtggcaccatctcggctcactacaacctctgcctcccgggttcaggcaattcttctgcctcagcctcccgagtagctgggactaywggctcgtgccaccacacnagctaattttttgtatttttaatagmmgccaaggggcttcaccatgttagccatggtggtctcgatctcctgacctcatgatctgcctgcctcggcctcgtagagtggtgggatt

SEQ ID NO: 10996 - DNA, 228 bp, Homo sapiens
tttcaaaaccaggctgaagattggaaggaagttggccagcctcggctgcaggacaggtgcttccaggctccattaggggtgtccagcgccttcttttgccctaggcagcgccctgaagaacgcgtcggggcctcggttcgcggacttgaggagtggaccgaccgagcgctgtgcgtaaaaggaccgctggggcacacgcccgagcgccaccggagctaggagaccgcg

SEQ ID NO: 10997 - DNA, 452 bp, Homo sapiens
  misc_feature 69: r=a or g
cttttctttcgcgtctgcggtgctcggagtgtggtacttctcctagttgcagtcaggcttcatacgctrttgtcctgcccgttagagcagccagcgggtacagaatggattttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagtccacaaggttactgtatacatagcctggtttaaaaggctgtgccacttcaagaatgtcattgttagactttgaaatttctaactgcctacct

SEQ ID NO: 10998 - DNA, 308 bp, Homo sapiens
  misc_feature 6: m=a or c
  misc_feature 122: w=a or t
cttttmtttcgcgtctgcggtgctcggagtgtggtacttctcctagttgcagtcaggcttcatacgctattgtcctgcccgtaagttcccgttttgtgtgtggttagagcagccagcgggtwcagaatggatttttggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgcattcagatggctt

SEQ ID NO: 10999 - DNA, 166 bp, Homo sapiens
  misc_feature 71: n=a, g, c or t
tagagatgcttcttgataagactggagaagaatagatttttttcactttgtttttgtttttacaatttttntcttctgaaataagttccagaagttgcaaaaccagtataaagaaatttgttttgattatttgagagtaacttgctaacatgaggtcccatcaccc

SEQ ID NO: 11000 - DNA, 198 bp, Homo sapiens
ttgatcgtcagtatcgaacaatagactacgcacagaagtttcagggcagagtcaccatgaccgaggacacatctgcaggcgtggcctatatggagttgaccggcctgacatctgaagacacggccgtctattattgtacagtgggtaagattgttgtgattcaccggcgtctcatgaagaggcccgattacgtctgct

SEQ ID NO: 11001 - DNA, 706 bp, Homo sapiens
  misc_feature 355: k=g or t
gccgcactttcactctccgtcagccgcattgcccgctcggcgtccggcccccgacccgggccgagaggtggttacattcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgaktggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctg

SEQ ID NO: 11002 - DNA, 758 bp, Homo sapiens
  misc_feature 407: k=g or t
agagacaggaatcggaagggcgggatttggagccatagccaatcgtcgcattaggccgaatcgcgggggccggctaaacgcgtgcggggggaggtggcttcttccggccgggccgagaggtggttacattcgttgaaggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgaktggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctg

SEQ ID NO: 11003 - DNA, 471 bp, Homo sapiens
agagacaggaatcggaagggcgggatttggagccatagccaatcgtcgcattaggccgaatcgcgggggccggctaaacgcgtgcggggggaggtggcttcttccggccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctg

SEQ ID NO: 11004 - DNA, 419 bp, Homo sapiens
gccgcactttcactctccgtcagccgcattgcccgctcggcgtccggcccccgacccgggccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctg

SEQ ID NO: 11005 - DNA, 138 bp, Homo sapiens
gccgcactttcactctccgtcagccgcattgcccgctcggcgtccggcccccgacccgggccgagaggtggttacattcgttgaaggacaccagctgcggaatttgcggctttggcagtgtgtactggccacatatgg

SEQ ID NO: 11006 - DNA, 190 bp, Homo sapiens
agagacaggaatcggaagggcgggatttggagccatagccaatcgtcgcattaggccgaatcgcgggggccggctaaacgcgtgcggggggaggtggcttcttccggccgggccgagaggtggttacattcgttgaaggacaccagctgcggaatttgcggctttggcagtgtgtactggccacatatgg

SEQ ID NO: 11007 - DNA, 274 bp, Homo sapiens
  misc_feature 131: s=g or c
atctggtaggtgcagggcaggggtggcatgtcgcctctcggatctcggcgtgcccgatggccccctgccttgaggagcagcctttttgctttctttctttgggataggatgcctctggggttctttctccsgcagccggctgtgttttagagcactttgctgcaagggaccaccacctgcacgaccagaatatgacctggtttgcataggcctcacaggttctggcaaaaccagtctgttgtccaaactctgcagtgaaagccccgataacgtc

SEQ ID NO: 11008 - DNA, 416 bp, Homo sapiens
  misc_feature 385: s=g or c
ctctcctcgctcggctgcgctccgtgacgggaacccaggctcccacgcacggggaatgcctagaacggagctagaatggaggcccctttgtgtgactaaatttggcaagaatatggatctgagccagtctttccacgtgtgctcccagctcccagctgagaaggccaagggttctcttccgggaaaaccagtttggctattaagggaacctgtcgacacagagcagagcaagataaggccaggtttcagaaagaatagctgtttaccatcaaagcaactgggttccacacagacatggtatattatacacaaagacgaaggatatgggtccactctccgtcaaggaatgttataaatccacgtggtgtccctgggtcaggcttgsccagaacatctgtggctggagaagccaatgt

SEQ ID NO: 11009 - DNA, 158 bp, Homo sapiens
aagacactcctagccttggggcagctgccgggcgagtcagcggagtagcggccctactcgctcaccacaaaggtctttgccattcagttcataaacagcatcatctgcatcacgcagatcatcaaactccacaaaaccatatctttgtcctaacaccc

SEQ ID NO: 11010 - DNA, 386 bp, Homo sapiens
  misc_feature 170: r=a or g
  misc_feature 304: n=a, g, c or t
  misc_feature 346: r=a or g
tatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagraacatgttaaaggccggacaaaggaaagacaataaaatcataaattatcggtcctgtttacatttttgttgggagaggtgattactttttagttttatcactcaattataagatcagtgtgttttggttttgtnttgttttgttctgtttaggcagggttttgctgtgttgcccargctggagtgcagtgcagtggtgcgatcttggctcattgca

SEQ ID NO: 11011 - DNA, 466 bp, Homo sapiens
  misc_feature 273: n=a, g, c or t
  misc_feature 309: r=a or g
  misc_feature 310: k=g or t
  misc_feature 311: s=g or c
atttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgccgcacaggaaggacatttatgaatcatattaaaatactacattttaaattggtgtccccanctttacgctatgaatggtattcaagtatttttgaarksttcctaaggaatagtggaaagccctccaacaaatatttgtggtcttttaaaataaattttcaccataaaaaattcctttagtcagccggacgcggtgtctcatgcctgtaatcccagcactttgggaggcccaggcaggtggatcactgaggtca

SEQ ID NO: 11012 - DNA, 221 bp, Homo sapiens
ctatgagaagttcaagggaaaaggagagtgtgccactcatgtgctgtgtggctcctctccaagcaaaaccatcctcagctgcataaatgtgcagcttggccaggtgatcctggagtctcttctcacccttcaaatcttgagaatttgcgggtgcattttccactgataattcaactgttgggtacttcagaataaaatttgatgttaatttgaagagcagg

SEQ ID NO: 11013 - DNA, 195 bp, Homo sapiens
attttgggcttcgcttccaccgcaccagccggcctacccagtccttccggtatcgcgttgctcaggggcttttcaaccctctgtcagtcggaaaaccatcgccgaggccgtggggggactcctatccatggtgttgaagcgtcgagccgactagggaacctccttccccgccaggatggaagtcgcatcagtcgc

SEQ ID NO: 11014 - DNA, 337 bp, Homo sapiens
  misc_feature 125: r=a or g
  misc_feature 141: w=a or t
  misc_feature 167: r=a or g
  misc_feature 228: r=a or g
  misc_feature 245: w=a or t
  misc_feature 247: r=a or g
  misc_feature 249: r=a or g
  misc_feature 253: r=a or g
  misc_feature 257: m=a or c
  misc_feature 284: n=a, g, c or t
  misc_feature 303: w=a or t
  misc_feature 305: r=a or g
tatcctgaacatcaaactatcccaggaaaaccatctagagtagtttgtttcaaaatattagccacagaccacctacatcacaataactcagggagcttatagaagtgaagattcctgaatataarcatagtaataattcawcctactgaatggaaatctctgctgaratccacagttttcataagctccccagatgattcctgtgtacattaaatctagaaaccattrgtttgagatctctcaawartraggrtgamaattgctttcagagagtagcccatganatttcccattcttcaaggwcraattccttctgttcagccttggtcctccaact

SEQ ID NO: 11015 - DNA, 275 bp, Homo sapiens
atataaatacggcgcctcccagtgcccacaacgcggcgtcgccaggaggagcgcgcgggcacagggtgccgctgaccgaggcgtgcaaagactccagaattggaggcatgatgaagactctgctgctgtttgtggggctgctgctgaccccgggtaaatgagtgcgaacggccggcaagcccccgctccccgggctctcgcggtcgcacgaggatgcttggcacgtaccccgtctacatacttcccaggcacccagcatggaaataaagcaccca

SEQ ID NO: 11016 - DNA, 275 bp, Homo sapiens
agaagtaaggaaaaccatcttggacgcatgatgatggcagtggatcagagtcccaaggacactggtgaagatcagagcaggactcacacaacctcagatccctgtggagtcagggtggaaccagagggaaggctgaaggctggagggtcctgagaggccttgcagaaagagaggacattggagctggggctttgatggatgaagaggaactagggaaaggcatttcaagcagagggaacagcctgtgcaaccacagcaggcagatcccggagatc

SEQ ID NO: 11017 - DNA, 255 bp, Homo sapiens
  misc_feature 49: r=a or g
  misc_feature 185: k=g or t
  misc_feature 188: k=g or t
  misc_feature 253: w=a or t
acaagaaaagatactaaatgatgttatttcttactttatgatttagaartccagttataatattaaaactctgtgacatagtttcttttaccaaaaccatgaacctactccccgtatcaggtattttcgatggtttagaagtactcaagtcacatcacattcaagttagaagttttttttttgtkgtkgttattttaaatttttaacaaatataaacaccagcagatactattacttgcttaaaaaattgggwgg

SEQ ID NO: 11018 - DNA, 434 bp, Homo sapiens
  misc_feature 40: s=g or c
  misc_feature 120: s=g or c
  misc_feature 216: s=g or c
agggattccctctccagccaatccagtcagagcagcggastgcgccgaacaaagatggcgcgggaagcgtctgtgagggcagactgatccgagcacccaaaccctcggcggacagcggascagtggtagccgcacggccctaaaaccatggaggagggcggcagcactggcagtgctggcagtgacagcagcaccagcgggagtggcggggcgcasaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggc

SEQ ID NO: 11019 - DNA, 428 bp, Homo sapiens
  misc_feature 349: y=c or t
  misc_feature 378: s=g or c
  misc_feature 400: r=a or g
acatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtycgagaggatgaaccaggaagattccagtsccgcccgattttggaactaaargagaagatcagccagaaatcttagagct

SEQ ID NO: 11020 - DNA, 272 bp, Homo sapiens
gagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccg

SEQ ID NO: 11021 - DNA, 422 bp, Homo sapiens
atctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaagttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagact

SEQ ID NO: 11022 - DNA, 268 bp, Homo sapiens
ataaggagagatataactgcaaagcataagagacactggggtggcctggccagagtgtctgttctcagcaggaaagtctggaaaaccattttatttcagaagtgaatagatgagtggagagtctacacaggaggcacagcagaatagctggatttacacatctttcctctaggcaagatgagtccacggaataggccagtgtgcaccttctcctgcctgtcctttagagaaacactgacagattcttgtctttggcttatctttctcc

SEQ ID NO: 11023 - DNA, 121 bp, Homo sapiens
caggcataagctaccatgctgggcctgaacataatttcaagaggaggatttataaaaccattttctgtaatcaaatgattggtgtcattttcccatttgccaatgtagtctcacttaaaaa

SEQ ID NO: 11024 - DNA, 378 bp, Homo sapiens
  misc_feature 370: n=a, g, c or t
  misc_feature 371: k=g or t
caacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagnkgaacagc

SEQ ID NO: 11025 - DNA, 164 bp, Homo sapiens
gcgcatgcgtcctagcagcgggacccgcggctcgggatggaggctggacacctgttctgctgttgtgtcctgccattctcctgaagaacagaggcacactgtaaaacccaacacttccccttgcattctataagattacagcaagatggaaataccaaatcccc

SEQ ID NO: 11026 - DNA, 337 bp, Homo sapiens
  misc_feature 47: w=a or t
  misc_feature 107: y=c or t
  misc_feature 119: r=a or g
actttcctttcagcgtgtagaatgtggggcgcctgtaaagttaaggwtcacgattccttggccaccatttccatcactctgagacggtacctgagattgggggcgaycatggcaaaaarcaagttcgagtacgtgagggacttcgaggctgacgacacctgcctggcacactgctgggtggtagtgcggctggacggccggaatttccatcggtttgctgagaagcacaactttgcaaaacccaatgacagccgtgctctccagctgatgaccaaatgtgcgcagactggatggaagaactagaggatattgtgatcgcgtatggacagagtgatga

SEQ ID NO: 11027 - DNA, 266 bp, Homo sapiens
  misc_feature 240: n=a, g, c or t
aaaaaccttgctttttattccctggtaatgatcttcaagtgcttagacttgtctgagaagctgttttgaaactaacatggtttagtccactaactgcatgttgggtaaattcaaaacccacatgctcgtcctcttgcagtggaataagtcacatctgatggacattttctgtgcttatagcatagtaatgaacgtctgacaggcgcgacctttcataagacaacccacactattggcttnctgcccagaaatattgctgcaacaac

SEQ ID NO: 11028 - DNA, 199 bp, Homo sapiens
tgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgaca

SEQ ID NO: 11029 - DNA, 419 bp, Homo sapiens
atacacacacgcgcgcgcgcacacacacatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgtt

SEQ ID NO: 11030 - DNA, 146 bp, Homo sapiens
  misc_feature 101: n=a, g, c or t
  misc_feature 102: n=a, g, c or t
agattcatcccttggatcagtgaagcttgatgtcagctccaataaagctccagcgaacaaagacccaagtgagagctggacacttccggtggcagctggannggggcaggacacagataaaacccctggggttttatctgtgtcct

SEQ ID NO: 11031 - DNA, 309 bp, Homo sapiens
agccattttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcaggatgccttctccgggacagattggatgttggagaaaatggatttgaaggagttcgacttggatgccctgttgggtatagatgacctggaaaccatgccagatgaccttctgac

SEQ ID NO: 11032 - DNA, 406 bp, Homo sapiens
  misc_feature 9: y=c or t
  misc_feature 303: n=a, g, c or t
  misc_feature 304: n=a, g, c or t
actcacttyctgacttaggccacaggtcgttttaccatgtctggacgtgcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcnncgacgaggagctcaacaagctgcttggtaaagttaccatcgctcagggcggtgttctgcctaacatccaggccgtactgctccccaagaagactgagagcca

SEQ ID NO: 11033 - DNA, 437 bp, Homo sapiens
attccggtaccggacgccgagagcggtttgtctccgtctctggagttgtaggcgagaggtgatcatgtccggtcgcgggaaacagggcggcaaagtgcgagcaaaggccaaatcccgctcctcccgcgcgggcctgcagttcccggtgggccgagtgcacagactgctgcgcaaagggaactacgcggagcagtgggcgccggggcgccggtgtacctggcggcggtgttggagtaccttacggcggagatcctggagctggctggcaacgccgcgcgtgacaacaagaagaccaggataattccccgccacctgcagctcgccatccgcaacgacgaggagttaaacaagctgctgggcaaagtgacatcgctcagggcggcgtcctgcccaacatccaggccgtgctgctgcccaagaagacggagagtcaggac

SEQ ID NO: 11034 - DNA, 448 bp, Homo sapiens
  misc_feature 346: n=a, g, c or t
  misc_feature 347: r=a or g
cctctagtgccttagattccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggcatgaagaactcttgactgacagaaacggagggtgtgtccaaagttttgaggacggccgagcggcgctccaaaacccgtcctcacagcctcgccccgttcgcctcagctacaacaatcatcgtcaacctgttccaccttctccagtctggtagcaaaaaggggtgtctcagnrtctccggcctgtgaaactgtgaggggattcggccaagacgtcctcttccctctgcctcccacccaggccactcttcacctccaccatgagcctggacatcc

SEQ ID NO: 11035 - DNA, 252 bp, Homo sapiens
acgttcaacccgttctgctggctcgagaacgaagtaggccgtctcgctctgggtctccaggcccgcgaccgtccgccagtcgtcccgaggcatgaagaactcttgactgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaagg

SEQ ID NO: 11036 - DNA, 449 bp, Homo sapiens
  misc_feature 171: r=a or g
gtcgttggtgtgttgcgcgactggccttgagggagagctggggcctgctcccggagagatacggctatgtcgatcgaaatcgaatcttcggatgtgatccgccttattatgcagtacttgaaggagaacagtttacatcgggcgttaccaccttgcaggaggagactactrtgtctctgaatactgtggacagcattgagagttttgtggctgacattaacagtggccattgggatactgtgttgcaggctatacagtctctgaaattgccagacaaaaccctcattgacctctatgaacaggttgttctggaattgatagagctccgtgaattgggtgctgccaggtcacttttgagacagactgatcccatgatcatgttaaaacaaacacagccagagcgatatattcatctggagaaccttttggccaggtcttactttgatcct

SEQ ID NO: 11037 - DNA, 385 bp, Homo sapiens
  misc_feature 274: w=a or t
  misc_feature 343: s=g or c
acacaggaaagggccctgacaagaggatgggactgcagttgtggctgccaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgwtggataaggacctgcaaggaagaatgaggaagcctgggacagtgcaggaggggagagcactggtggtasagaggagtgatgacaagggtctccgccaaaagggaaatggag

SEQ ID NO: 11038 - DNA, 331 bp, Homo sapiens
  misc_feature 128: n=a, g, c or t
  misc_feature 133: n=a, g, c or t
  misc_feature 320: m=a or c
agttggccagcacaccactacgcatgtgtgtcaactctagggttgggtgctggggttgcggctttcggttaacaccgcaggcaccacacctgttggtgttcagatggagcggcacactagtcatcctnaacangaaaagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttmagacccagctc

SEQ ID NO: 11039 - DNA, 340 bp, Homo sapiens
  misc_feature 240: w=a or t
  misc_feature 293: r=a or g
  misc_feature 320: n=a, g, c or t
agttggccagcacaccactacgcatgtgtgtcaactctagggttgggtgctggggttgcggctttcggttaacaccgcaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgawcatccagacaacaaagctgccctcggttgatcacaagcccaaggaatgcctargactcctggaatgtatgtatgcaaacntccagcttcagacccagctc

SEQ ID NO: 11040 - DNA, 473 bp, Homo sapiens
  misc_feature 420: s=g or c
aactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccsaacaacagatggctgttttggaacatttacaggcatctgtgacacactggctc

SEQ ID NO: 11041 - DNA, 435 bp, Homo sapiens
  misc_feature 356: w=a or t
  misc_feature 357: n=a, g, c or t
  misc_feature 358: s=g or c
aactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaagttccagccaaagaggaagctaatgctgtgcctctctgtagagcaaaaccctcccccagctatattaatcttcaagcaagttccccaccagccacttttctgaacatccagacaacaaagctgccctcgggtawnsatgtagggagggttttctaatggactcaacagggggaagggttgcatggaggaggtggcttgagctgtcgcctattg

SEQ ID NO: 11042 - DNA, 565 bp, Homo sapiens
  misc_feature 512: s=g or c
aactacgcatgtgtgtcaactctagggttgggtgctggggttgcggctttcggttaacaccgcagattggaacaggctgagatctgctggagacaacttaggaaattatcatagtgaaaatactaacatggattgttgatcatctgatgctatgattctttcccaggcaccacacctgttggtgttcagatggagcggcacactagtcatcctaacagaaaaggcttgttttttatgaagaggcccttcttaatccttcagatcccagctgagatattatttcctcaggacatgttttccagctctacagactagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccsaacaacagatggctgttttggaacatttacaggcatctgtgacacactggctc

SEQ ID NO: 11043 - DNA, 589 bp, Homo sapiens
  misc_feature 14: r=a or g
  misc_feature 39: k=g or t
  misc_feature 292: s=g or c
  misc_feature 304: k=g or t
caggacatgacatrgtccggtgtgacggcgaggacagakgaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctsgaaggtgaagckagaggaaccagacctcatcagcccaacatcaaagacaccatcggaacagcagcgcccgcagcacccaccccgcaccggcgactccatcttcacggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccg

SEQ ID NO: 11044 - DNA, 521 bp, Homo sapiens
  misc_feature 241: s=g or c
  misc_feature 405: w=a or t
  misc_feature 435: r=a or g
  misc_feature 461: y=c or t
gcgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtaagattgttctgtcagaaaaccctctcccagttcccctgcagctcttcaggaatccacatctctscagagctctttgttctcatgggtggcacctccagagtgaagaagatccttttcaagaagggaaacaggggaaatgagagggtcctgcaggcagagctggaatcaacttccactctgcctcttgcaagctgtgtgaccctgggcacaatttctccttcctctggwaacctctgttttcttagatttggagcaggrtggtcacactgaccttgcagagttcygagaatcagagacagaacataaaaggcctggaaaacattctccaaaaagaagctgcaaca

SEQ ID NO: 11045 - DNA, 236 bp, Homo sapiens
  misc_feature 142: s=g or c
acactccgcccagaggggcctcagcttttccaccactgctttctagtcctttaactcctagaggcaaacttttgggggataagaaagcctgggaggggcctgtgccaaaaccctctctgcctggggactgggcggtgattcsgcttctgcctgggctcctgccatggcccccgagaggggctgacactttagctcccggtgcaggtgagaacccgcccggaggaagaaggaaggcg

SEQ ID NO: 11046 - DNA, 427 bp, Homo sapiens
caaagttcaacttttcctgttgcattagagtctcctttgttccacagttctctgtgtgacctcttccttgcatttttttttaaccttgttatctgtttgactaatccttgactttaacttggtctttaacctgccaggttctgcacatgtattaaaattgtttcatatgcaaattacttggcctgctttagctgttgtatatgtatacaaatatgtgtatgtgtaaatatatgtgtgtgcatttgagtgtgcagtgagtgacatagacaaagaaaaccctctgagacactagccttatagggcattattttgttcacaatcctactaatctcttgggaatttagatccatctttaaacagctgaactttctggaagatcagtgactcagattatcagagtttacagagagcaaatgctggaagaaga

SEQ ID NO: 11047 - DNA, 386 bp, Homo sapiens
gagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggaggtggaggacacgaccctcaaccgttgctcctgtagcttccgagtcctggtggtgtcggccaagttcgaggggaaaccgctgcttcagagacacaggctggtgaacgcgtgcctagcagaagagctcccgcacatccatgcctttgaacagaaaaccctgaccccagaccagtgggcacgtgagcgacagaaatgagggactgggatctgcacag

SEQ ID NO: 11048 - DNA, 417 bp, Homo sapiens
  misc_feature 162: s=g or c
  misc_feature 340: m=a or c
  misc_feature 405: w=a or t
gagttttccagcggaagtggctcctgtaagcagcaaggtagcgtggccggcgcccgagctggggttgtgtccctgctgggctgccgttccagctggactgccgccatggaactcagcgccgaatacctccgcgagaagctgcagcgggacctggaggcggasatgtggaggtggaggacacgaccctcaaccgttgctcctgtagcttccgagtcctggtggtgtcggccaagttcgaggggaaaccgctgcttcagagacacagcttggatcctagcatgactatacattgtgacatggtcattacatatggattagaccaactggagaattgccagamttgtggtaccaattatatcatctcagtcttgaatttactcacgctgattgttgaacagataaatwcgaaactgccat

SEQ ID NO: 11049 - DNA, 464 bp, Homo sapiens
  misc_feature 157: n=a, g, c or t
  misc_feature 223: k=g or t
  misc_feature 387: m=a or c
  misc_feature 452: w=a or t
gagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggangcggagcatgtgcttccgagtcctggtggtgtcggccaagttcgaggggaaaccgctgcttcagakacacaggctggtgaacgcgtgcctagcagaagagctcccgcacatccatgcctttgaacagaaaaccctgaccccagaccagtaggcaccttggatcctagcatgactatacattgtgacatggtcattacatatggattagaccaactggagaattgccagamttgtggtaccaattatatcatctcagtcttgaatttactcacgctgattgttgaacagataaatwcgaaactgccat

SEQ ID NO: 11050 - DNA, 116 bp, Homo sapiens
ttgggtcaaaaccctgagcacctggggttttgcaatcaaaagccgaccttaggtatttcaactcttcctcaagtaagaataagtaagccacagaaagatgcaatcataaggttttc

SEQ ID NO: 11051 - DNA, 298 bp, Homo sapiens
  misc_feature 102: s=g or c
  misc_feature 103: k=g or t
  misc_feature 170: n=a, g, c or t
  misc_feature 291: m=a or c
  misc_feature 292: w=a or t
acccaacaaccacacccctcctaagaagaagcccctcagtgtgacctggagcgaaacggacagggcgtgaccgccagaaacttcccacccagccaggatgcskccggggacctgtacaccacgagcagccagctgaccctgccggccacacagtgcctagccggcaagtncgtgacatgccacgtgaagcactacacgaatcccagccaggatgtgactgtgccctgcccagttccctcaactccacctaccccatctccctcaactccacctaccccatctccctcatgmwgccact

SEQ ID NO: 11052 - DNA, 329 bp, Homo sapiens
  misc_feature 121: r=a or g
tttttttttccgtgctacctgcagaggggtccatacggcgttgttctggattcccgtcgtaacttaaagggaaattttcacaatgtccggagcccttgatgtcctgcaaatgaaggaggargatgtccttaagttccttgcagcaggaacccacttaggtggcaccaatcttgacttccagatggaacagtacatctataaaaggaaaagtgatggttagtcattgctttaattttttgttactccagctgtaagtacaaattttgagcttgctattctcgtggttagttctgggtaatttctttctatcttccttaaatgaagccaga

SEQ ID NO: 11053 - DNA, 336 bp, Homo sapiens
  misc_feature 287: y=c or t
cccgtgttagatgaggtggagcaagtgtccacagagtcaatggcagtcctctagggcctgtctttaggagccggtttggagtaataaaaggcagccctctgctgagctcctgtgtcgtgcctgctaggtattacatacactcttttcctcagcattcccgaggcaagtgggcgttaccctcatatgacaggcagagaagcaggcctgagtggttatgaggcagtgaggtgtgtttccttgggcaagttgcttagcttctctgagcctcagtagctcctctgtctgtyaaatgggatcatgaaaacccttcaccataagctgcacaagcgcaagaac

SEQ ID NO: 11054 - DNA, 393 bp, Homo sapiens
aacatttttggtcaattttctaggctacagttttgatgtgttttttaaaaatcttgaattaactgaataacagttcatattgaaggtggattctcccattccctgcacccaggattttccgttgttccatcaaattctgtaaatcggtatgccctaacagtttcttatatttgagttggcttcagcttcgagaaattcttcaggcaggtttaggcagagggctgaggaagctagagaagattccgaagagaaaggatgattatttgttgcatgattatagcttcttttaaaacttctaataggaaaacccttccactttcctggaccaaatgcagagtaaagtcattttctattatctgttgcaataattaataataaatatgtaaatgcaga

SEQ ID NO: 11055 - DNA, 418 bp, Homo sapiens
  misc_feature 395: y=c or t
tgcatgtatatgccattatttttgtagttagacaatagtttttaaaagaatttcatagatattttatatgtatggatctatattttcagagcttatctctgaagatctaaacttttgagaatgtttgaaaattagagatcatgaattatataattttccagtataaaacaagggaaaaatttttatgtaaaaccctttaaatgtaaaatatttgagaataagttcatacaatcgtcttaagttttttatgcctttatatacttagctatattttttcttttgacataactatctttttgaaagcaatattatactgacagaggctcactgagtgatactttaagttaaatatgtagatcaaggatgtccaatcttttggcttccctgagccacaytggaagaagaattgtcttgggcc

SEQ ID NO: 11056 - DNA, 192 bp, Homo sapiens
  misc_feature 12: y=c or t
  misc_feature 94: s=g or c
ctctctgcttcyggtcagctgggttgtcctgcatggtgacgggtgtcatcccgaacaaatcagatggcatcagaggcactccatcaagtgggasatggggaggaggctgtactgaagaaagaaaacttcaacatgatgaatgcccttgaccaactgccaaaacccttttcaaaccccaagtctatgaaccgg

SEQ ID NO: 11057 - DNA, 465 bp, Homo sapiens
  misc_feature 324: n=a, g, c or t
  misc_feature 325: s=g or c
ttatttgtcctcgtccctgccagtctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctnstaaacagtggactctgctttttcccctcctcttatccctaatcctaggagctttctgtctggcttccctcctggcccctcgtgtatgcattctctctagcggtggggattaaggagaaaactcacgtggccagtgggtag

SEQ ID NO: 11058 - DNA, 413 bp, Homo sapiens
ttatttgtcctcgtccctgccagtctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgttggagtgcagtggcacgatctcggctcagtgcaacccccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattgtgagccatgttg

SEQ ID NO: 11059 - DNA, 534 bp, Homo sapiens
  misc_feature 367: s=g or c
  misc_feature 472: n=a, g, c or t
  misc_feature 476: r=a or g
  misc_feature 485: k=g or t
tttccgccgctggtggccacccgcaggtagtgatgtcgagcgtcgagctcccaaaaccgagctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggsctataaggaactctcaagagcttaaggcctcgaaaggtcaacaccccggctggtagctctcagaaggcgcgagaagagaaggcactactgccattagaactacangatrccggctctkacagtcggaagtctatgcgtcagtctacagctgagcatacacgacaaac

SEQ ID NO: 11060 - DNA, 408 bp, Homo sapiens
  misc_feature 146: r=a or g
  misc_feature 147: k=g or t
  misc_feature 346: n=a, g, c or t
  misc_feature 350: r=a or g
  misc_feature 359: k=g or t
tttccgccgctggtggccacccgcaggtagtgatgtcgagcgtcgagctcccaaaaccgagctggtgaggggctgcaggtggcggcgcagtctcggaatccggagatgatgagtatcaaggggaccagtcagacacagaggacgarkggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacangatrccggctctkacagtcggaagtctatgcgtcagtctacagctgagcatacacgacaaac

SEQ ID NO: 11061 - DNA, 166 bp, Homo sapiens
cttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgaccccccagc

SEQ ID NO: 11062 - DNA, 196 bp, Homo sapiens
agagtcttaaaaccgagggcccgcagggtccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgagttccgccctccggg

SEQ ID NO: 11063 - DNA, 276 bp, Homo sapiens
aatgtgtatctgccatggtcaatgtcatttcagaagtttgtaagggctattccttgaagcttacacctgcccccctcaatgtgactaacaagtcttttcagttagtaacatacttgctgagggtttgacaacaaagacttaatgaagattgtgataaattcacacagacacccaagtaaatactcaatgctattaattcaacaataaaaggaattcctcaggaaaaccgagggcctgcaggctgcctgcgtcttgagtaaaagaaggaacaatcca

SEQ ID NO: 11064 - DNA, 214 bp, Homo sapiens
  misc_feature 36: r=a or g
  misc_feature 70: m=a or c
  misc_feature 102: y=c or t
  misc_feature 141: m=a or c
  misc_feature 142: m=a or c
  misc_feature 145: s=g or c
  misc_feature 156: s=g or c
  misc_feature 197: s=g or c
  misc_feature 198: m=a or c
  misc_feature 208: s=g or c
aaaaccgcccactccctgagacggctaggtcacagragcagtgggtcagaagccagaggggacgtggggmgtgccaccctggagcctaccggcacacctgcygagatggaggcctcagatgggcaagggggtgaaggggammagscactagagcasgtgacaaatgtgtcatgcctggagacaagctccagcgccasmcctgctagasactcgc

SEQ ID NO: 11065 - DNA, 118 bp, Homo sapiens
gtttgttttgttttattttcattatgaagccatagctgtaaaaccgcttgatttgttttcagtccgttaccgttgtaattctttctgatgtttaatgtgccactgctggccggtggga

SEQ ID NO: 11066 - DNA, 328 bp, Homo sapiens
ggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcag

SEQ ID NO: 11067 - DNA, 209 bp, Homo sapiens
ttttcggaggctgccagcgtcccacaccagccgcagtgaaaaccggcagaaagacattaagagattttcctgcagtcactgctggcagatgatagagccaggatttgaaagcaggcagcctggctccagaccctgtgctcttaactcccgttttgcatcaagaacagaatcctatgaaaggcttgtacagtgcttggtactgagtaggc

SEQ ID NO: 11068 - DNA, 428 bp, Homo sapiens
  misc_feature 79: r=a or g
  misc_feature 373: m=a or c
  misc_feature 374: n=a, g, c or t
  misc_feature 375: n=a, g, c or t
  misc_feature 376: k=g or t
agacgcgccgcggtccccgcctgccgctgctccgccgcagtcgccgctccagtctatccggcactaggaacagccccgrgcggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcgtaagtgacacaccctgcagccgtccccttcccttcctccattcccccccgcaggctgctgmnnktagactgcacatccgcaattcccgggagaaaagtgaaagctcggcggggagg

SEQ ID NO: 11069 - DNA, 282 bp, Homo sapiens
  misc_feature 142: r=a or g
  misc_feature 221: s=g or c
acacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacratcctgcaccatgactcaacagccacttcgaggagtgaccagcctgcgtttcaaccaagaccaaagctgcttttgctgsgccatggagacaggtgtgcgcatctacaacgtggagcccttgatggacgaaggggcatctg

SEQ ID NO: 11070 - DNA, 50 bp, Homo sapiens
acgcgatttccgggaacccgtcaggaaggacataaacaaaacaaacccga

SEQ ID NO: 11071 - DNA, 220 bp, Homo sapiens
  misc_feature 27: k=g or t
atctaaacatagataagtatggttatkactcgtggagacagttccaaggctgggagggactttggagtttgatccttcaaccaacaaacgtctgcattgctccagagaagagtaagagaaacctctgcatttaaggcacattacagtctaattctctaggctctagaagattagaagataaataattgcaataagattactcttgtctctgctgctcctg

SEQ ID NO: 11072 - DNA, 437 bp, Homo sapiens
acaagggtgcgaggaagtcagtgagcaaatcgcggaccaccggggctgccagctcgcctgactcccggcctcttgcgctcctaggggcggagaagggtgcgggctcttcgccctttgtgtcctccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaaggtatgggaaaggtaggggagaagccgtggcttctaatgaaggaaaagaaagcaccgtgcttggtgccgttgtgagctttgaataattatctcttgttaggttgtgttctagtacgcctgtaaattcaccttagtaataatgattattact

SEQ ID NO: 11073 - DNA, 269 bp, Homo sapiens
caggtactgttttttgtttgttttgtttttttgtttgtttgttttgccttaagatgaataacaatactttgatctactttggtataataacataaagaggaaaagccttataatcacagtacttttggctctggaatataatgtgcagttctagtggctgcccacgatgaaaacctaacagctaattgaactagaaagctagccacagggaattattaagttttcacctgatgccaagaaaatcagatcttccttaggaaagacacagg

SEQ ID NO: 11074 - DNA, 578 bp, Homo sapiens
atccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatgccgatatcttcagaaaacctaagcaaacttacaggtcctgctgaaactgcccactctgcaagaagaaatcatgatatagctttgccatgtggcagatctacatgtctagagaacactgtgctctattaccattatggataaagatgagatggtttctagagatggtttctactggctgccagaatctagagcaaagccatccccgctcctggttggtcacagaatgactgacaaagacatcgattgatatgcttctttgtgttatttccctcccaagtaaatgtttgtccttgggtccattttctatgcttgtaactgtcttctagcagt

SEQ ID NO: 11075 - DNA, 363 bp, Homo sapiens
  misc_feature 32: k=g or t
atgtttagatacacaaatatttaccattgtgktacagttgcctacagtatttggtacagtaacatgctgtaagggtttgtagcctaggagcaatagactgtatagatcatctagcctacgtgtgtagtaggctgtaccatctaggtttgtgtaagtacactgtgatgatcccatgacagaatcacctaatggctcatttctcagaacatatccccatccttaagtgattgatgactatatttttattttgtacaaagatgtacttctgaaaacctaagtttaagtcaacttttgtgagttgtataatttcaaatatcttagctaggtgtgttagagaaattctgtgataattttgtagaacaa

SEQ ID NO: 11076 - DNA, 102 bp, Homo sapiens
catctaaacttcctaaaatatagcccgatcccaccctaaaacctaatatcctgctttttaacatttctgagtagacagatgtatttttttttctggtttccc

SEQ ID NO: 11077 - DNA, 454 bp, Homo sapiens
  misc_feature 12: y=c or t
ttacctcacttyactaaagtatacccagtgattttgttttgatgacttcattcattataatgatttctgttcagcatctccagtattccagggaacagtggtgagcaacacaagctcttccctcttggagctttcatttactaatgaggaacaaatgatagtcatgttatgacaatgtgttataaattaacaatcctcttttaaactagatttataaaacctacacacttgagggtttccatttgttctatctagatgtattttgagaaatctgaaacaaaagcttgtttttttgtttgtttgtttgttgtttgaaacggggtcttgctctgtcacccagcctggagtgcagtggtgcgatcttggctcactgtaaactcggcctcccagattcaagcgattctcctgcctcagcctcctgataagctgggattgcaggcgcgcatcaccacgc

SEQ ID NO: 11078 - DNA, 220 bp, Homo sapiens
acaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgacca

SEQ ID NO: 11079 - DNA, 311 bp, Homo sapiens
  misc_feature 129: w=a or t
  misc_feature 135: r=a or g
taaagccaggagaaatgtagtaagattttcttgtaggtagaatacgcaggcacgcagacactatgggaaccgaatctggaaagacacttttgcattctgttgtcaatttaggcagctgttaattggtcwattgaraagctctagtggatgatttcattgtggagatggagttgtcagatttacagttcgtaaatctagtagccatcaccgatccttaaataaaacctagaccctgaattgcttatgtactttgcaaggagcttctgcattcctagtgtatcaaaatgttctcgggtaatttggcatccaag

SEQ ID NO: 11080 - DNA, 248 bp, Homo sapiens
aagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaa

SEQ ID NO: 11081 - DNA, 439 bp, Homo sapiens
  misc_feature 337: m=a or c
  misc_feature 395: n=a, g, c or t
agtgagccatgccaatgtggtttggctggactgtgagtgcttgatgcagtctgataggaggatgggggtggcgcagagaacattgaaatcagaaaggattctgctctgtagagacaaaggaaacacagagacatagacatggatctgggaaatacaccttttgctactcgttcagttttagcaaggaggtttcttgcatggctaagcaaaacttaaacttcctctgagaattacaggaattacaggacctgacaaagctatgaagattaaaacctataggaagaaaatctgaaccagaaacagtatggcagaattgggatctgactcacagagggamgaacttataattcttcacaggtcacatagaagcatgagaatttgggttcaagcaagtnaattctaaatcagaatccatacataaagtgtttgcaatgtccag

SEQ ID NO: 11082 - DNA, 288 bp, Homo sapiens
  misc_feature 139: r=a or g
  misc_feature 140: m=a or c
  misc_feature 142: n=a, g, c or t
  misc_feature 144: m=a or c
  misc_feature 255: n=a, g, c or t
gtgtggaacctgttcctggtcgccaatggtggcgactcagaaggtgtctcatcctgggcattcgggccgaagtgtgaagattgctcctggagcagttgtatgtgtagaaagtgaaatcagaggagatgtaactatcggrmcntmggacagtgatccaccctaaagcaagaattattgcggaagccgggccaatagtgattggcgaagggaacctaatagaagaacaggcccttatcataaatgcttacccagatnatatcactcctgacactgaagatccagaaccaa

SEQ ID NO: 11083 - DNA, 396 bp, Homo sapiens
agcacgtcaacggtcggctcagcaaatatccagcccaaaatacaccactagtggtctgttcttaaagaccaaaaaaccaggccctttttcttcctcctttcttgctgctacgcctcaactatttcattgcttgtcaatgctcagcaaggaagacagcctaacagcagccctcccacctgtgaattcctcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaac

SEQ ID NO: 11084 - DNA, 449 bp, Homo sapiens
  misc_feature 378: m=a or c
  misc_feature 379: m=a or c
  misc_feature 382: r=a or g
  misc_feature 383: r=a or g
  misc_feature 406: n=a, g, c or t
  misc_feature 407: n=a, g, c or t
  misc_feature 408: r=a or g
gcctactctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacagggcggtgcggcctccaagctctctaagatgtaagtgaggcggccggatcacagccctcgtgggtggggagcacgtgtgcatcgggatcgtcggaggatttcaaagttggcttaaggagctggccgcttagatgcccactccgtgcatcctggcgcgcatgggagacccgttgtgtgcttagcctcttacctgccttgaccttgcggtccttgtgcmmggrrtgcatccccggagaccccatcannratgctgccttcaaagcctacccggaacccttccttccgctt

SEQ ID NO: 11085 - DNA, 97 bp, Homo sapiens
  misc_feature 45: k=g or t
  misc_feature 46: y=c or t
gcctactctttccctcggagcgggcggcggcgttggcggcttgtkyagcaatggccaagatcaaggctcgagatcttcgccattgctgcacaagccg

SEQ ID NO: 11086 - DNA, 547 bp, Homo sapiens
tttgacccggtgtcgccgcagaaccgaggtcgccgagtgatgatgttgtgaagtcgcccgcctgtccctgccacgcccgggcggttgctggcagtgggagcagcggcagagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaac

SEQ ID NO: 11087 - DNA, 297 bp, Homo sapiens
acactcgaaggaagttgcacgccaaatgcaaaacctccagcgagctggatttctttgcacttttttttattattatgattaaggaaagcagggggcggcaggcttaaaagcaagttgcaggcgaaatagtaagttgctggcgaaatatagccccccttccgaaactcctgacctcttcttccaccccggccagggcccgcgtccaagttcccggtgcaggccccacccccgaatcttgacatttgctgccctcgactctgtgcgttgctcaccctatcacgttcataggacccctac

SEQ ID NO: 11088 - DNA, 124 bp, Homo sapiens
aaaaccatgttgggatactgccttgattcttggtttttagctttcttatcccaaaacgaaaaaaccatttactgtatctgtatttctgttctgaaccttctggatgtatactagtcttccccac

SEQ ID NO: 11089 - DNA, 455 bp, Homo sapiens
  misc_feature 7: m=a or c
  misc_feature 8: w=a or t
  misc_feature 373: w=a or t
  misc_feature 375: r=a or g
  misc_feature 381: r=a or g
  misc_feature 383: n=a, g, c or t
gtggggmwggttaattcttgttttgggtgcttttcttcaccgctctaaggaactaccacagtcagaaggtgcattcttactgcgatctttttatttgctaccttgggcttaaggagcctgcctatatctactgaggtgaggttaggtcagtctctgtaaccgttcgtcacttaggccttgatgggtgacatggatggggatgacttcctgggctaactcttctcttgctaaaggatgatttttcaccaccttgaatgcccatgattaaaacataaacaagaaaatagatatctgagacagcccacctgaggatattgaccataaggactcatatctcattacaagaagcatcatggccgagccagactacatwgragatgrcnatcctgaactcattaggcctcagaaactgatcaatcctgtaaaacctcccggaaccatcaagatcttcacag

SEQ ID NO: 11090 - DNA, 342 bp, Homo sapiens
  misc_feature 321: n=a, g, c or t
agctttttgcctccaaggctttgctggcttgtgcggcatcctgctccgtctgcaggttgtgcttccggtgcggaggtcagggacaagatggtgccaccggtgcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttgnaccagcagcggatgaataaag

SEQ ID NO: 11091 - DNA, 124 bp, Homo sapiens
taaagttccagagcatgcaaaactaaatcattttgtataaaaaacccaacaaatgtgatgagacaataatgggaaggaagggaatgagaaatattaaattctggatggtggttatctttgagcg

SEQ ID NO: 11092 - DNA, 428 bp, Homo sapiens
  misc_feature 77: s=g or c
  misc_feature 99: m=a or c
  misc_feature 108: y=c or t
ctttcccatctggcggccgcggctcctgtccagaccctgaccctccctcccaaggctcaaccgtcccccaacaaccsccagccttgtactgatgtcggmtgcgagagyctgtgcttaagtaagaatcaggccttattggagacattcaagcaaaggttggacaactacttttccagaacagaaaggaaactcatgcatcagaaaagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaa

SEQ ID NO: 11093 - DNA, 402 bp, Homo sapiens
  misc_feature 290: r=a or g
  misc_feature 354: s=g or c
ctttagggagttcccttgatctcttgaaagagacacagccccatttacattatttcgtggatttcaccagcatagtatagtttttttctgtaagtccctcattcttatgtaataacaggtggaactgaggtttgaagaacctcagtggcccatcctgatgacattggagactcaaagagacaagagagagtagggtttaaaacctgagctttaagactcccactagcttcgtgtcctttggcatgttaacgtgcctcagtttcctcatctgtataatggggatatatgaraggcaccagtcctaaggtgaacattaagtgagatgattctagttacagacttagaacaatttcsggcacatagttaaatatccaggaaattctggtactgttatgtgtgggt

SEQ ID NO: 11094 - DNA, 311 bp, Homo sapiens
cgattctatcttgatttggtcaacccgtccagctgtggggcagaaaagcagaaaggagccaagagttcagcagactgtgcttccctggtccctcagtgtgcctaattctcacctgaaggcagagggatgaaatgccaagactctatgctctggaaaacctgaggccaaatattgatctgtattaagctccagtgctttatccacattgtagcctaatattcatgctgcctgccatgtgtgagtcacttctacgcataaactagatatagcttttggtgtttgagtgttcatcagggtgggaccccattcca

SEQ ID NO: 11095 - DNA, 230 bp, Homo sapiens
tatttatttgttacgaattgtcccttcatcaggaaaatgattcctttttccctatttaaggtatttgttacgaattctagttttatattatctactatatcttacccttaacttttctgagtcattttcagtgtatcttttatagaaggctatggttggaatttttttaaaacctgagtatcattgtcttctgatacagaatctgaaaaccttttaaaaattagtgaggc

SEQ ID NO: 11096 - DNA, 410 bp, Homo sapiens
  misc_feature 66: w=a or t
  misc_feature 68: y=c or t
  misc_feature 80: y=c or t
  misc_feature 85: r=a or g
  misc_feature 90: m=a or c
  misc_feature 106: n=a, g, c or t
  misc_feature 110: r=a or g
  misc_feature 119: y=c or t
  misc_feature 155: y=c or t
  misc_feature 164: r=a or g
  misc_feature 168: r=a or g
  misc_feature 171: w=a or t
ttctcgcatttgtcagctcttgccaaaacggtgacgcagtggtgtgttacctgccgacagcataawgygaggcaaggtcyagctrttccmcccggcatacaagctntatrgagcagccycctttgaagatctccaggtggacttcacagagatgycaaagtgtrgagrtgwtcgagtgtggatcaaggactggaacgtagcctctttgtgcccatggtggaaaggaccccagactgtcgtcctgatcactcccactgctgtgaacgtagagagaatcctagcctggatccatcaaccgtgtaaaacctgcagcgcctgaatcctgggaggcaagaccaagtctggacaacccctgcagagtgaccctgaagaagatgacaagccctgctccagtcacacccagaagctga

SEQ ID NO: 11097 - DNA, 303 bp, Homo sapiens
  misc_feature 127: r=a or g
  misc_feature 166: s=g or c
  misc_feature 167: s=g or c
  misc_feature 223: n=a, g, c or t
aaacgcaaaacctgctctttagatttcgagcttattctcttctagcagtttcttgccaccatgtcggaaaccgctcctgccgagacagccaccccagcgccggtggagaaatccccggctaagaagraggcaactaagaaggctgccggcgccggcgctgctaagssaaagcgacggggcccccagtctcagagctgatcaccaaggctgtggctgcttctanggagcgcaatggcctttctttggcagcccttaagaaggccttagcggccggtggctacgacgtggagaagaataacagcc

SEQ ID NO: 11098 - DNA, 335 bp, Homo sapiens
  misc_feature 2: y=c or t
cytttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatca

SEQ ID NO: 11099 - DNA, 413 bp, Homo sapiens
  misc_feature 98: n=a, g, c or t
  misc_feature 137: y=c or t
  misc_feature 138: y=c or t
gaggaccttgcctgcaagtccgggggcggggcctgagtcagtctcgccagctgccggtctttcgggggctccgtaactttctatccgtccgcgtcagnccttgccaccctcatctccaatatgcctggtccgacccyyagtggcactaacgtgggatcctcagggcgctctcccagcaaagcagtggccgcccgggcggcgggatccactgtccggcagaggtaaggaaccgtgcagttcgttcgcttccagactcggagataggacccagaacctcgctgattctggggtggagaccctagcatgtgaagattgacaaaggcaaaatgagcttctagtgacgtggccgtgggagtagttaaaggccttttgggaggaaggcgacattttttttctcgttgctcagtttaggg

SEQ ID NO: 11100 - DNA, 558 bp, Homo sapiens
  misc_feature 98: n=a, g, c or t
gaggaccttgcctgcaagtccgggggcggggcctgagtcagtctcgccagctgccggtctttcgggggctccgtaactttctatccgtccgcgtcagnccttgccaccctcatctccaatatgcctggtccgacccccagtggcactaacgtgggatcctcagggcgctctcccagcaaagcagtggccgcccgggcggcgggatccactgtccggcagaggaaaaatgccagctgtgggacaaggagtgcaggccgcacaacctcggcaggcaccggggggatgtggcgattctacacagaagattcacctgggctcaaagttggccctgttccagtattggttatgagtcttctgttcatcgcttctgtatttatgttgcacatttggggcaagtacactcgttcgtagattcagttacatccatctgtcatctgaagaaggaggaaaaaacccaacatttcttggaccaaaagtatagtgactatctgttcatgagagaaattttctgtaagcttgctgttttacaggggatttatcaataattgattttgagga

SEQ ID NO: 11101 - DNA, 128 bp, Homo sapiens
tctgaattattattacaggttacagtttcaaataaagacaaaacctggatttttgtgataaaagcacaggatggtgtcagatgagtaaactgttatactgaatatgattcacagaaaggatagtaaaa

SEQ ID NO: 11102 - DNA, 499 bp, Homo sapiens
  misc_feature 8: k=g or t
  misc_feature 9: n=a, g, c or t
  misc_feature 217: w=a or t
  misc_feature 460: s=g or c
accaacaknacctccggttctaggtgtcatggctgccccaagagtctaggtaagagtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcwggaagctcagagtatcgatgaaatctacaaatacgacaagaaacagcagcaagaaatcctggcggcgaacctggactaaggatcaccattactttaagtactgcaaaatctcagcattggctctgctgaagatggtgatgcatgccagatcggaggcaacttggaagtgatgggtctgatgctaggaaaggtggatggtgaaaccatgatcattatggacagcacactatagttggcatgaasccaggaggcagagcttacagtgagccaagatcgcgccac

SEQ ID NO: 11103 - DNA, 476 bp, Homo sapiens
  misc_feature 113: w=a or t
cttcttccggtgcggaagactataccactcccataccctataactttgtttgttctatttcacacatataattttccgagacaagatgttctcatttaagcaacaagaagatwcgtctctcgctattactgtaactgctgtttatatcgtcatgtcccggaaaggtccctgtcttccctgaatggtctctaccaacttcacctccggttctaggtgtcatggctgccccaagagtctagagacgacaacttctccgcttcctcggcgatggcggcgtccgggagcggtatggcccagaaaacctgggaactggccaacaacatgcaggaagctcagaagtatcgatgaaatctacaaatacgacaagaaacagcagcaagaaatcctggcggcgaacctggactaaggatcaccattactttaagtactgcaaatctcagcattggctctgctgaagatggtgatgcatgccagac

SEQ ID NO: 11104 - DNA, 204 bp, Homo sapiens
aggagttctcagcccccaaaacctgtcaccgatcctcaccaggctgtttgctctaccctctcccccaactcaagggctcccgtcctcacctccctgcaacactgctcctagaaccatgtctgtctacctggagacagccaggcctattcccttctgggtctccagtgtccctttttctcacaggtgacagtgctggctacaatg

SEQ ID NO: 11105 - DNA, 326 bp, Homo sapiens
agtctcctcctcaggtcaggctgatatcacatagctcaaagttccctccctaaactatgattggtctttctagtgtcattataccccaccctaagactgactagtgtagaaggccctgccctgagacatctcattagcataagctatcaggtgtaatttaagggagcagcatagataagaaaacctgtgtaactcataaaattccaactgtttagatgttgcctcccagaaactgaaaacaaaggtcagatatctctttggatgaagcaaattctttactacaaagtatcctttatcaggactgcatcaaaacatgtaaacaagga

SEQ ID NO: 11106 - DNA, 182 bp, Homo sapiens
gatgtctctttcaataaaaggctgtttcatctacatttaaaacctgttgttagtgtagtcaccttcatcactgaagttaggtagatcttctgggtaacttgctgcaccttctgcatcagcccttgccattgtttcaccttgtacttttatgttatggagacggcttctttccttaaacctca

SEQ ID NO: 11107 - DNA, 185 bp, Homo sapiens
ctaaattggcatctttaaaactattcatttcatgcccaggatttatcattttgatgtgtgtatataagtatttctgtgattagatgcaaaagggggacatgtcttagcatctcaaataggcatttattgaatgtccagaaaaaaccctaggtttgctcattgtcttccccatctctatcccttac

SEQ ID NO: 11108 - DNA, 233 bp, Homo sapiens
aactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacc

SEQ ID NO: 11109 - DNA, 468 bp, Homo sapiens
  misc_feature 406: n=a, g, c or t
ctttcttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctnggtataatctcacaaatcgatgggactgcaggattgtaaactgaaatgaacatgattatact

SEQ ID NO: 11110 - DNA, 165 bp, Homo sapiens
cttttttttcgaggtcggccgcgtggctggaagacatggccactccagtcggtgttgagcacggcgagcagtctcaggcctttagtgatgatgggtggttaggagggttaaaagtactggatgagaaaatgctttccaaacgttgagaaaatgttactatgtgaa

SEQ ID NO: 11111 - DNA, 571 bp, Homo sapiens
  misc_feature 133: r=a or g
  misc_feature 310: k=g or t
  misc_feature 509: n=a, g, c or t
cttttttttcgaggtcggccgcgtggctggaagacatggccactccagtcggtgttgagcacggcgagcagtctcaggcctttagtgatgatgattaaaggtggtggctgtggccttgaaaacagtcatgtgraaactcatcaccttaaggtgttaagtgtaaggatcttcacgatgaaatttctgtaaatggtgcagtcagcctcagtttccaaagccggaaaaggatcctctagtagccacggtgtggcagctgctctgaaccaggacctggacccggacccaaagtgccatgtctttaatgtgagtkagctcccagcgatgccagatgggatcagcacagccctgcctctgctgctaattgttcctctaaagtaatcgccatgcgttcttcgggcttcatctttaaaggaatgaagcaactgagattattctggaaaaccttttggcagttagtgaaattagagtacaactaagaacattttcagacctccactgtggatgacctnggtataatctcacaaatcgatgggactgcaggattgtaaactgaaatgaacatgattatact

SEQ ID NO: 11112 - DNA, 183 bp, Homo sapiens
acacagtgtcggggcctttgcaagggggaagagccccgcctagggcccggttctccagaccacccctcagccccacccatagtccctgactggacatactaaggctcacctcagcctcacatcaactgacccccacaaagcctcagaaaacgacccctgagttctcctacacctccgaacccc

SEQ ID NO: 11113 - DNA, 323 bp, Homo sapiens
  misc_feature 145: s=g or c
attatctggtcacctcaccggctgcgcaaacgtgtccacaacgggtccctccccgagaggccacatctcgcctaaggtggagccagcaggtatttgcctgtggaaaactgcagtggatcctgccccgtctgcgtagactgcgcastcggagtcaaagattcgttctggccagagaggagaaaacgaccttcaggaatcagcctgagtgttcgcgcccgagcccgattggaagcaggtgcgtggtcgcttcactctccccgtgcacaccttgagttatagctctcgctgcgcacagagggcaccacacggggcccgacacacac

SEQ ID NO: 11114 - DNA, 246 bp, Homo sapiens
  misc_feature 171: y=c or t
aatcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacytccaggaacggtgcactctcccttcggggagagaacaaccgttgtttaatggaagatttcgatcagttagggtac

SEQ ID NO: 11115 - DNA, 187 bp, Homo sapiens
  misc_feature 88: s=g or c
  misc_feature 91: r=a or g
aatcgcttctcggccttttggctaagatcaagtgtagtatctgttcttatcagtttaatatctgatacgtcctctcttggacctctascaraacatatgatacagaaaaccaggtacgttttaagagttagtgacatccttagtatcatttgatcacatctgctgattagaacttaatttttttttt

SEQ ID NO: 11116 - DNA, 348 bp, Homo sapiens
  misc_feature 68: m=a or c
  misc_feature 263: n=a, g, c or t
  misc_feature 299: n=a, g, c or t
  misc_feature 325: n=a, g, c or t
  misc_feature 326: n=a, g, c or t
aatcgcttctcggccttttggctaagatcaagtgtagtatctgttcttatcagtttaatatctgatamgttctcggatacatgtgcagaacatgcaggtttgttacataggtacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaanagtggagggaggtgagagacggtagcacctgcgggncggcttgcacgccgagtgcctgtganngcgccggcttgacttaactgct

SEQ ID NO: 11117 - DNA, 490 bp, Homo sapiens
  misc_feature 143: r=a or g
  misc_feature 224: s=g or c
aggttctcgcgagaggacccgtcagccccagtcaggcgtcgtgcgaacagcagctggtaccgaagcggaggtggagcccgagagggaaccagcggggaaactgaggctcggggtggagcgcaggattgtgggacgcgccaagrctgctgtctttcccagcagcagcggaagatgtcggacagcgaggacagcaacttttccgaggaggaggacagcgagcgcasagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagc

SEQ ID NO: 11118 - DNA, 415 bp, Homo sapiens
  misc_feature 149: s=g or c
aggttctcgcgagaggacccgtcagccccagtcaggcgtcgtgcgaacagcagctggtaccgaagcggaggtggagcccgagagcagcagcggaagatgtcggacagcgaggacagcaacttttccgaggaggaggacagcgagcgcasagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagc

SEQ ID NO: 11119 - DNA, 577 bp, Homo sapiens
  misc_feature 230: r=a or g
  misc_feature 311: s=g or c
gagaggtaagtgcgtgtgcagaggtggcagttccgggcgccggggaggtgtagagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaagrctgctgtctttcccagcagcagcggaagatgtcggacagcgaggacagcaacttttccgaggaggaggacagcgagcgcasagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagc

SEQ ID NO: 11120 - DNA, 330 bp, Homo sapiens
acaatttggtttgtgctgcaaggggagggtccccatcatctggccccagtggtgtaaggagctgactgggattcagtcactgacttggagccgctcgggggaagtcccgaacaacccatacaggcggtgggtgggaatgcctcacttcagtttgaagagggtccggatccaaaggggttaaaacgagcgaaccccgatccccgaccacacttcccgcctccctaaaacgcacaccccgctagccatgggcagccgcgaccacctgttcaaagtgctggtggtgggggacgccgcagtgggcaagacgtcgctggtgcagcgatattccca

SEQ ID NO: 11121 - DNA, 180 bp, Homo sapiens
gagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaaatgccgaaaccagtaagttgcccagtttctgggccggg

SEQ ID NO: 11122 - DNA, 165 bp, Homo sapiens
agggattttttaattttaagctatttgtctgttaagtatataataccaaaacgcaggttgtttaaattaggatttccaagtaatttacgtcgtcttcaaaattcctggggtctatcaatcagaaacgccagaaagtttgtgtactagtttcacattgttaaggga

SEQ ID NO: 11123 - DNA, 441 bp, Homo sapiens
  misc_feature 378: w=a or t
  misc_feature 382: k=g or t
gatgagtcctaggaggcgctggctctttggcggctcggaggagcggctgctgctgctgctgctgctgctggtggcccctttgcagatgtattgctgtccttgaatattagcccatttgaaaacgcctgggaagttcagccatcagtatgtccaagtacaaacttattatgttaagacatggagagggtgcttggaataaggagaaccgtttttgtagctgggtggatcagaaactcaacagcgaaggaatggaggaagctcggaactgtgggaagcaactcaaagcgttaaactttgagtttgatcttgtattcacatctgtccttaatcggtccattcacacagcctggctgatcctggaagagctaggccaggaawgggkgcctgtggaaagctcctggcgtctaaatgagcgtcactatggggcttgatcggtctcaa

SEQ ID NO: 11124 - DNA, 231 bp, Homo sapiens
  misc_feature 21: n=a, g, c or t
  misc_feature 33: k=g or t
tttttaaaacagcagcgcggnctctcagggatkactctgtgagactgggaggatcatagctgggggaggctgagcgtgggagcggtgctgccagtcctgcctgaaaacgcgaaatgagtcttgcttggttctccctccactgggcgtgagagcccctgcccaggaggcccaggacaaatggccccatagtggaaactgggaagcttttaggcatctgatcagagcgggagc

SEQ ID NO: 11125 - DNA, 255 bp, Homo sapiens
  misc_feature 27: s=g or c
aaaaacgcgactctgccccggacccgsgaggcgcccgaggccttcgccgcttctgcagccaccggcgggggggggaacgaggcagtactgccgcggacgctcaccaaccgcttcggcttttcccccctccgggtctcctcgatttcctgagagccggaatccgactgtagggggaagaaagactcaagagcagatgcttgaactgaaataactttattttggggggttactttgctgacccttagcgcagggctt

SEQ ID NO: 11126 - DNA, 278 bp, Homo sapiens
  misc_feature 241: n=a, g, c or t
  misc_feature 242: n=a, g, c or t
agattttagactggagtcagcaatcacgggtgtttagtctgcagccgagcagctaaagggagaaagaatcgctcaggaaagacacactgcagactccaccggcaccctgcaatagatggattccgactacacaagggagaaaacgcggaggtgacactctcctgcctggaaagaggacgaacgaccaaacaaacgcaaggactggactccatgccgaagtatctggaagtcgtgacacggnntgtataaaacaaaagtttgcgagctgttaattgctg

SEQ ID NO: 11127 - DNA, 199 bp, Homo sapiens
atttttaatcatctacatgcagtgtatgtaggcccaattcttctcttttaaaataaaatctcatttggaagtactgaagctggctgaaaagaagaaatttagaaaacgcgttggagaatcggacctgacattttccgccttggcactcactcatcatcttgacaactctgactctctgtccccagtgttcttcataccc

SEQ ID NO: 11128 - DNA, 314 bp, Homo sapiens
agttctctcgcgacctctagccacttccggttgctaacggttcccaaacagcccccgaaaacgctacgtgagctgggccctgggccagaggcagaaaacggacggaagaaaaggtctggccggagatgggtctcactctgtcacccagactggagtgcagtgagtggtgcgatcatagcttactgcagcctgaaactcctgggctcaagtgatcttctcgcctcagcctcctgagtagctggagctacaggtgtgagctacccagcatggctcatttgagatttctgagtagagaagtaacatgattaaacctg

SEQ ID NO: 11129 - DNA, 479 bp, Homo sapiens
ctcttgtggtcagtaaaatcatctgacaaatgcctttccaaggatgtcgaatgtatatataaagaaaaagcttaggattgctaagggagtggtattttggtgaggatttcattttcttctactccatggaaacgagccttttgagcttttgcttgtctgctgatttgtccggtgatccaggtttcccctcaaaaaacctataaggcatggaagtattttgaaccgagagtcaccaacagataagaagcagaaagttgagcgcattgcatcacatgattttgaccccacagatagctcctccaagaagacaaagtctagttcagaggagagtagatccgagatatatggtcttgttcagcgttgcgtaatcatccagaaagatgacaatggatttgggctgacggtcagtggagacaatccagtcttcgtacagtctgtcaaagaagatggagcagccatgcgtgctggagtacagacag

SEQ ID NO: 11130 - DNA, 740 bp, Homo sapiens
  misc_feature 126: m=a or c
  misc_feature 149: r=a or g
  misc_feature 361: y=c or t
  misc_feature 365: k=g or t
  misc_feature 419: r=a or g
  misc_feature 456: n=a, g, c or t
  misc_feature 457: n=a, g, c or t
  misc_feature 460: r=a or g
  misc_feature 484: k=g or t
  misc_feature 485: n=a, g, c or t
  misc_feature 514: r=a or g
  misc_feature 515: w=a or t
  misc_feature 623: r=a or g
  misc_feature 674: m=a or c
  misc_feature 713: r=a or g
  misc_feature 725: r=a or g
ataaacaaaacaaacccgaggcagcatggagaggggccgtggcccctgcagcggaaccggacccagtccctgagccgcccctacacccacagacagcatcgcacagaattattttaaaaaaaagcmgtgatccaagcaattgaattggragcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcagcctagtgtaagcggaatggatccgcctttcggggatgcctttcgaagccacaccttttcggaacaaacycgakgcagcatggagaggggccgtggcccctgcagcggaaccggacccagtccctgarccgcccctcaccacagacagcatcgcacagaattatnntaraaaaaagcagtgatccaagcaatknaattggaagcactctggggaaacctgctrwttattgtggaaatcatcttcgatcttggaattgaaagtaaagctggaaaggaatttacaaacaagaaaaaaaagaagtttggaatcggattcacaggatctgggcttrgaaatgcctcaggtaaatcatacagacctagtgtaagcggaatggatccgmctttcgtggatgcctttcgaagccacaccttttcggacraaatctgatgarcacagatctcttagc

SEQ ID NO: 11131 - DNA, 361 bp, Homo sapiens
taattttgctttcaatatgacggctgtcaatgttgccctgattcgtgataccaagtggctgactttagaagtctgtagagaatttcagagaggaacttgctctcgagctgatgcagattgcaagtttgcccatccaccaagagtttgccatgtggaaaatggtcgtgtggtggcctgttttgattctctaaagggtcggtgtacccgagagaactgcaagtaccttcaccctcctccacacttaaaaacgcagctggaattaatgggcggaacaatctgattcaacagaagactgccgcagccatgttcgcccagcagatgcagcttatgctccaaaacgctcaaatgtcatcacttgtaa

SEQ ID NO: 11132 - DNA, 813 bp, Homo sapiens
  misc_feature 651: n=a, g, c or t
  misc_feature 780: m=a or c
  misc_feature 782: k=g or t
acacacactcttggagagagagcgcgaggcagggagatgatctcctcctcctttttccaaggctgcacttcttggaagtgaagccggtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttttaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctnggttcgctacaacaatgtcttccacaactcaaactcccaccgcgctcacacaaccggtccactcctgccttttcactcacacagctcccgactgcttcttgcagaggctgagagtcccccacccccacmtkttttttcatttagatgtaacaaacctagtag

SEQ ID NO: 11133 - DNA, 450 bp, Homo sapiens
  misc_feature 111: r=a or g
  misc_feature 124: r=a or g
  misc_feature 345: r=a or g
  misc_feature 346: n=a, g, c or t
gtctttctagcatgttgccctttttcaaccacatttgtgtttcaggtgtagagaggagagagagtgaacagggagcggggcttttgtctgttggtctccctggactgaagrgagggagaatagragcccaagactaagattctcaaaatggtttattacccagaactctttgtctgggtcagtcaagaaccatttccaaacaaggacatggagggaaggcttcctaaggtttctgatactgtccttcctgaaatgaagagctcctctaccttaacccagcctgctaagactgctacagcaagattgacagctggtcagattgctgtcctcataaaagcatggtcrncaccttcagctgggctctcaaatggaacagcctggcaatctttgtttccctggtcagtttgtcttcccatttccatgtcaaaattcctgtcaaacttctgaatc

SEQ ID NO: 11134 - DNA, 324 bp, Homo sapiens
gtctttctagcatgttgccctttttcaaccacatttgtgtttcaggtgtagagaggagagagagtgaacagggagcggggcttttgtctgttggtctccctggactgaagagagggagaatagaagcccaagactaagattctcaaaatggtttattacccagaactctttgtctgggtcagtcaagaaccatttccaaacaaggacatggagggaaggcttcctaaggtaagatccttagatgccattttgttaacactattttcaatatagaaacaattgttttaaaatagcagagctttttcatttgaatacccattatag

SEQ ID NO: 11135 - DNA, 712 bp, Homo sapiens
  misc_feature 290: k=g or t
  misc_feature 291: n=a, g, c or t
  misc_feature 679: m=a or c
  misc_feature 681: k=g or t
gtctttctagcatgttgccctttttcaaccacatttgtgtttcaggtgtagagaggagagagagtgaacagggagcggggcttttgtctgtttattacccagaactctttgtctgggtcagtcaagaaccatttccaaacaaggacatggagggaaggcttcctaagggaagacttcctgtcccaaaggaagtgaaccgcaagaagaacgatgagacaaacgctgcctccctgactccactgggcagcagtgaactccgctccccaagaatcagttacctccactttttknaatcgtaacacctccatttgtattacatatggtgtatgggtattgatgaggtcatggtatcatatatgggatttttttctgtgtaaatcatcaagtataagaagaaactatgggactctgagccttgctttagagaatttacagtggacaaataggtgtcatcaaaccagtttttaatcattctgactcaagtgaaaacgctcagaatttcacactgtgaatccacgtttacaacccttacaggtgggccttcaggcctggttcgctacaacaatgtcttccacaactcaaactcccaccgcgctcacacaaccggtccactcctgccttttcactcacacagctcccgactgcttcttgcagaggctgagagtcccccacccccacmtkttttttcatttagatgtaacaaacctagtag

SEQ ID NO: 11136 - DNA, 357 bp, Homo sapiens
  misc_feature 310: y=c or t
  misc_feature 311: n=a, g, c or t
aaaaaaacgctctcggaattatggcggcggtggatatccgagacaatctgctgggaatttcttgggttgacagctcttggatccctattttgaacagtggtagtgtcctggattacttttcagaaagaagtaatcctttttatgacagaacatgtaataatgaagtggtcaaaatgcagaggctaacattagaacacttgaatcagatggttggaatcgagtacatccttttgcatgctcaagagcccattcttttcatcattcggaagcaacagcggcagtcccctgcccaaggtaaaatgtgtaaacyntaggcattgttttctttttaaaataccataatttatttacttcctg

SEQ ID NO: 11137 - DNA, 380 bp, Homo sapiens
ataggcccggactcgcgtgagtgcgcgtgcgttggggcctcagcctttatctccactctgcggagattcacgcctggaaaacgctcttctgagaggatctgtggaggtcaacccaggagagagaagacaggactgaagcactgaaagggtcctgccgttaagggcgcaggattgtatagaatatataatagcagtagcagctctgtttacggagcattaaccttacgtggagttatttcctgcatttcctcctttcgtctttacaaggtagccgtttggcgtcgtgagagattgggtctctccacattgccccggctgctctccaacccctgagttcaagtgattcacctcccttggcctcccaaagtactgggattaca

SEQ ID NO: 11138 - DNA, 512 bp, Homo sapiens
  misc_feature 491: s=g or c
agcgaaattccttgtcggctaaatactgacctgcacgaaaggcgcaatgatctctcaactgtctcaacactagactcggtgaaattatggtcccagtgaaaacgctgggtacccgcatcaagacgaaaagaccccatggagctttactacagtttcgtattggaacttggtctaacatgtgtaggataggtgggagactttgaagcgaggacgctagttctcgtggagtcatccttgaaataccacccttggtatattgagtttctaacatgccatcatcatcaggtgggtggacagtgcgtgacgggtagtttgactggggcggtcgcctcctaaagagtaacggaggcgttcaaaggtacactcagtacggtcagaaaccgtatgtagagcgcaaaggtagaagtgtgcttgactgtgagacttacaagtcgagcaggtgcgaaagcaggacttagtgatccggctgtacattgtggaatggcagtcgstcaacggataaaagttaccct

SEQ ID NO: 11139 - DNA, 406 bp, Homo sapiens
  misc_feature 235: w=a or t
  misc_feature 243: y=c or t
  misc_feature 244: y=c or t
  misc_feature 251: m=a or c
  misc_feature 255: y=c or t
  misc_feature 261: r=a or g
  misc_feature 294: m=a or c
  misc_feature 323: k=g or t
  misc_feature 334: m=a or c
aacgatggccacactgtctcctctcgggactcagcgaagttgaaatgtttgtgaagatgcaatctacccgcggctagacggaaagaccccatgaacctttactgtagctttacattggactttgacaagatttgtgtaggataggtgggagacgttgaagcggagtcgctagatttcgtggagtcaaccttgaaataccaccctgatgttgttgaggttctaacctaggtccatwatctggayyggggacmgtgyatggtrggcagtttgactggggcggtctcctcccaaagmgtaacggaggagttcgaaggtacgctagktacggtcggamatcgtgacgatagtgcaatggcataagcgtgcttaactgcgagactgacaagtcgagcagatgcgaaagcag

SEQ ID NO: 11140 - DNA, 429 bp, Homo sapiens
  misc_feature 11: m=a or c
  misc_feature 16: n=a, g, c or t
  misc_feature 17: y=c or t
  misc_feature 414: y=c or t
ggtctagaggmataanyaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgtygtatttcaattgtgg

SEQ ID NO: 11141 - DNA, 478 bp, Homo sapiens
  misc_feature 80: k=g or t
cccacttctaggcttggttgaaccgtgcagataccttctcgaaacaaaagattttcctacctgcttatacttggtaacckagggaattactaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccaggttgaagattattctctcttctaaagaaaatagaagaatattaggagaaaagacacttg

SEQ ID NO: 11142 - DNA, 473 bp, Homo sapiens
cccacttctaggcttggttgaaccgtgcagataccttctcgaaacaaaagattttcctacctgcttatacttggtaaccgagggaattactaagacttcttgctcatttctgagtattgtctttatatcctgacactatgaatgctacttggatgcctcttaagggtctcttctgcagggtccccatgaattgtggctgaagttgtgcacaaacaagtatctccagtgacaggagtgccttctgaggcagccattgcatcttcatctgctgacactctgctaggctgacttctgtagttttcaccactgatcttcagtccacctcacagagctctataaaacgcttaaatcctctttacatcatagactttcagctacttgaagatagccatcagccgctacgtgactcttttctccagacaggttctcactctgtcacctaagctggagtgcagtggcaccatctcggctca

SEQ ID NO: 11143 - DNA, 173 bp, Homo sapiens
tatgctttcattacctggctgacttctgggcctcatctccttaggggctggaaagccttcaagatcagtgccagcatccaaggaaatgctcttcctcatgtcagctcccctccagagccaaaagaagactactgtctcttcctgtttcaaaacgcttcatacccctaatgggc

SEQ ID NO: 11144 - DNA, 140 bp, Homo sapiens
  misc_feature 126: s=g or c
cacaattgtggaacccacattggcctgagatccaaaacgcttcgaggcaccccaaattacctgcccattcgtcaggacacccacccacccagtgttatattctgcctcgccggagtgggtgttccsgggggcacttgccg

SEQ ID NO: 11145 - DNA, 217 bp, Homo sapiens
  misc_feature 66: r=a or g
gagggcgcctcgcggcaggagcgggatttccggggtcacgggaaccggcaggggaacgggataaarttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtagggga

SEQ ID NO: 11146 - DNA, 242 bp, Homo sapiens
  misc_feature 169: n=a, g, c or t
gcagatgggggagtctcgggaccaacggcagcctaacggtttgtgtttaaggagaaactaacaatgaaaacggcctcgttgacggaggaaaagttggaatgcagcctctggtgctgtttgagcgatccctctccccggggcctggccgcgcgctgctgtgttctggaangggctcattgtacagtcaaggcggcaggaatcctcttcatctatctcaccaatatgttttgtggactctgacg

SEQ ID NO: 11147 - DNA, 419 bp, Homo sapiens
  misc_feature 346: n=a, g, c or t
tgactccagactttttaacactgatctgctgctgttgaggcatatgccgttttgttaggcctcctcaagtgggagtcaggaatgctgctgtgttccagagaggttttgttcttcctgtagggctgaagcagtgcctactcaatagaaccagtcatcgtgcaaagaaatgccacctgactcaaaggcaaagccagagtgcagcttggagcaaagaagtttgtgttgaaggagaaactaacaacgaaaatggacttgttgacggaagaaaagtaggaatgcagcctctggtgctgtttgagtgatccctctccccggggcctggccgcgcgctgctgtgttctggaangggctcattgtacagtcaaggcggcaggaatcctcttcatctatctcaccaatatgttttgtggactctgacg

SEQ ID NO: 11148 - DNA, 137 bp, Homo sapiens
aaaacggcgagggcgtggctaccagccgctgcgctccgctctggggtctcctcaccccagaaggccctcaggtggaggaagggcctcaggtggaggtaggacctgtgctggccgcgggagaggtaaacagaacacca

SEQ ID NO: 11149 - DNA, 150 bp, Homo sapiens
gcagggcgggagctgtttatctcccggaagaaaacggctcctgtcacagaagtctcgtgattgctctgggagctttgcttagacacttgaaactacaggagaaagaaggatctagcgaaatatggctacagagagccctgctacgcgtcg

SEQ ID NO: 11150 - DNA, 331 bp, Homo sapiens
  misc_feature 243: r=a or g
gaaatgttagtgagactgtagggtgggcggtgcgagcggcggttagctcccagttcggcctctgaggaaaacgggcgttcgcctgcggttggtccgactgttagcaacatgagcggcctggatggggtcaagaggaccactcccctccaaacccacagcatcattatttctgaccaagtcccgagcgaccaggacgcacaccagtacctgaggctccgcgaccaaagcgaggcgacacaggtratggcggacgggtgagggaggctcggagaccgtcgcgctcccgccttcaccgccttcagaggaggggggcgtaccccaggatcccgcg

SEQ ID NO: 11151 - DNA, 224 bp, Homo sapiens
ttacatagatatttacatatctactatcttaaaacggtgtccttttaagaatttcaaatgatgctttatagtttctaatatggtgcactgggtatactgttgatatttaaagttttgtgaatgataaatttccctacttcagtagtgccatagaattaattgattcttgtatctgaaatttaatgagtgcttatgaagtatgctggactgtgctaggttctgac

SEQ ID NO: 11152 - DNA, 353 bp, Homo sapiens
  misc_feature 119: w=a or t
  misc_feature 124: w=a or t
  misc_feature 138: k=g or t
aagaaaatgatagtaataattgcagtagttgtattgtattgtatttttgcacgtgtggtaagcataggcttgaagaggtgggtaggcaggtacatgtacttcctaaatttggagataawtatcwttctgtaagttcgktatgcttgactgtttccatgttctcccaataatgattttatagttacttatcactttactcatggagaattaaaacgtaatgtttttcaactgtatctttctttaactggataatactgctatatgatatgcttactacagactgcattaattcacgaaacgaattctgttatgctgtaatttgaactctcctcaccacaacttattaaaaaggc

SEQ ID NO: 11153 - DNA, 219 bp, Homo sapiens
  misc_feature 46: n=a, g, c or t
ggatgcgcatgcgcaggcgccgtgtggcactcggcggtcgaaatgngagttcaaggagacgggggcgacgcggctgagggcttctcgtcggggtcggggctgcagccgtcggattattaattactgattttccgtagaaaatttggaaaatgtagagaagtgtaaaggaggagagaaaaactactcctcctatccccaggcaaagccagctgccacgag

SEQ ID NO: 11154 - DNA, 221 bp, Homo sapiens
  misc_feature 44: k=g or t
ggatgcgcatgcgcaggcgccgtgtggcactcggcggtcgaaakgggagttcaaggagacgggggcgacgcggctgagggcttctcgtcggggtcggggctgcagccgtcatgccggggatagtggagctgcccactctagaggagctgaaagtagatgaggtgaaaattagttctgctgtaccaattttttctcatcctttaaaaagaaaaaaaaaagcc

SEQ ID NO: 11155 - DNA, 273 bp, Homo sapiens
ggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggcagataaaacgtcactgtgcagagccttttacagaatattggacttgcattgattatactggccagcagttatttcgtcactgtcgcaaacagcaggcaaagtttgacgag

SEQ ID NO: 11156 - DNA, 605 bp, Homo sapiens
  misc_feature 268: k=g or t
gtacctttcgggctcctgactcctgccgcttctcttccccttccgtgggtcagggccggtccggtccggaacctgcagcccctttcccagtgttctagttcgcccgtgacccggaataatgagcaaggagggtgtggtgggttgaaagccatcctactttactcccgagttagagcatggattcagttttagtcttaagggggaagtgagattggagatttttatttttaattttgggcagaagcaggttgactctagggatctccakagcgagaggatttaacttcatgttgctcccgtgtttgaaggaggacaataaaagtcccaccgggcaaaattttcgtaacctctgcggtagaaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaaatggagtctgagcagctgttccatagaggctactatagaaacagctacaacagtataacaagtgcaagtagt

SEQ ID NO: 11157 - DNA, 199 bp, Homo sapiens
ggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgtcggaaacaaactggtactcgagaacgcggccgctatcggg

SEQ ID NO: 11158 - DNA, 212 bp, Homo sapiens
  misc_feature 101: y=c or t
  misc_feature 111: k=g or t
  misc_feature 152: y=c or t
  misc_feature 155: m=a or c
  misc_feature 202: r=a or g
  misc_feature 203: s=g or c
gtttgggcgctgcaccgcctgcgccgtgcccgtgagtccggcgcgcagaggaggaggagaaagctgaccgcttaggcccgggtagtggtcgtcgtggtttyccttgtagtkcgtggtctgagaccaggaactacaaggaaaaccacgacgaycamctcccatggctcattaaagtcacctgagtagacctgctaagcactcrstcctccacg

SEQ ID NO: 11159 - DNA, 213 bp, Homo sapiens
  misc_feature 153: s=g or c
caataaaaataaacattttgtttttctaatatcttaacatatcctcccctttaggaggaagaacgtgcaaaacgtgaggagctagagcgaatactggaagagaataaccgaaaaattgcagaagcacaagccaaactggccgaagaacagttsagaattgttgaagaacaaagaaagattcatgaggaaaggatgaaactagaacaagaacga

SEQ ID NO: 11160 - DNA, 127 bp, Homo sapiens
aaatgtgaagagctaaagaaaaaacctggcacttcactagagagaacacctgttcccagcgctgaagcattccgatggttcttttaaagcagtagtatatcttattttcaaggcatttggaaatgaa

SEQ ID NO: 11161 - DNA, 395 bp, Homo sapiens
  misc_feature 325: r=a or g
tttggctggggcgggcgggtgcgcagtccgctgggcgaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctrgacgggagggaggtctagggaggcctctgccgcgggcactgtgagtcctggccgatgatgacgagaccac

SEQ ID NO: 11162 - DNA, 299 bp, Homo sapiens
aggaaagcaacgcccctgaatgcttatgccggtggttggtagaggaaatggaattccccagactgtacctcttgacttgctactggtacctggaagagatgtaacacctgaccatgggacatcaagtgactgtgtgaatcaaactgcccatcatgaattgttgttatttgactcatcaaactgtacaactggatgaacacaggagcagtgcactacatatgggactggaaccatgaatgagcaggtgactcagactcctatagtacctgcctctactccttcagcacttctccctcaac

SEQ ID NO: 11163 - DNA, 386 bp, Homo sapiens
taaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtg

SEQ ID NO: 11164 - DNA, 475 bp, Homo sapiens
gacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggttgataaattgctatcattctaaagtcatggacttcactttcggcaacaaaactaaataaggatggaacatttattgaatgaaaaatgcacttttgtttttccatttttttaaataataaaaatcagacaaa

SEQ ID NO: 11165 - DNA, 411 bp, Homo sapiens
  misc_feature 345: w=a or t
gacgtggaagcggaagcgctggtctgggggcgttctctcgagtccgggccgcaagtcccagacgctgcccatggaggcgtccagcgagccgccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggtgtgaagacggattctttggtwgataaattgctatcattctaaagtcatggacttcactttcggcaacaacttgctctgcagtttcta

SEQ ID NO: 11166 - DNA, 418 bp, Homo sapiens
  misc_feature 221: n=a, g, c or t
  misc_feature 350: k=g or t
gacgtggaagcggaagcgctggtctgggggcgttctctcgagtccgggccgcaagtcccagacgctgcccatggaggcgtccagcgagccgccgctggatgctaagtccgatgtcaccaaccagtaattaaaatgaagatactttatgtaaatatgaccagcgttgaaactaaaagttgagtgtaactgcagtaaaattgaataaatatctgcattccagnatttctacagacagttcaaggaaattgctgcagttattgaaacggtgtgaagacggattctttggttgataaattgctatcattctaaagtcatggacttcactttcggcaacaaaactaaataaggtkggaacatttattgaatgaaaaatgcacttttgtttttccatttttttaaataataaaaatcagacaaa

SEQ ID NO: 11167 - DNA, 322 bp, Homo sapiens
  misc_feature 256: k=g or t
gacgtggaagcggaagcgctggtctgggggcgttctctcgagtccgggccgcaagtcccagacgctgcccatggaggcgtccagcgagccgccgctggatgctaagtccgatgtcaccaaccagaatttctacagacagttcaaggaaattgctgcagttattgaaacggtgtgaagacggattctttggttgataaattgctatcattctaaagtcatggacttcactttcggcaacaaaactaaataaggatgkaacatttattgaatgaaaaatgcacttttgtttttccatttttttaaataataaaaatcagacaaa

SEQ ID NO: 11168 - DNA, 270 bp, Homo sapiens
  misc_feature 124: r=a or g
aggaaatgccgatgaagaagatccacttggacctaattgctattatgacaaaactaaatccttctttgataatatttcttgtgatgacaatagagaacggagaccaacctgggctgaagaaagragattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggattccg

SEQ ID NO: 11169 - DNA, 287 bp, Homo sapiens
  misc_feature 113: s=g or c
  misc_feature 246: y=c or t
tttagatagatgttgataactgtcagagctgttcttttttggccttcgtttgtattctaaggagagtccaggcctctccttagaaccccagatctggagatcaagctagctascgtgcctttcttaatcagcatccctcatacatctcattctgaaatagaaaactaaatctatcttctcccctaaacctgttccgttcttcctatgtctcctacttcagtgcacaacctcaaaaacgaccctatygtataaatcagaaacctaacagtcatcctaaacctgtcccc

SEQ ID NO: 11170 - DNA, 311 bp, Homo sapiens
  misc_feature 22: r=a or g
catatgtattgttatccctgarttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagg

SEQ ID NO: 11171 - DNA, 210 bp, Homo sapiens
  misc_feature 173: s=g or c
  misc_feature 174: r=a or g
gaggacggtggtgctttccggcctagcggcggaaatgcgacagtctctaagggaggaggccggagcgcctccctgtaatcccgaagaattgaaaactaacaaagaaaaggaaatcacgggctaggtcgcgagtatctcgttgtcaccctgaatttgctactgcgtattgaatsrcagcttcttgtttggggactgcgaactatggatcat

SEQ ID NO: 11172 - DNA, 636 bp, Homo sapiens
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactggtcgctgaaacctctacaacttagttgaccgtaactgccagagccctgccctgaattcctgtccttactccctctttaagattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacatttttgagtttttttgggtttttttttt

SEQ ID NO: 11173 - DNA, 640 bp, Homo sapiens
  misc_feature 303: n=a, g, c or t
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagatngcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaaggccctgaagaatcctgtgaccttcatctaaagtaggtcatgagacccctgagcttaaaacg

SEQ ID NO: 11174 - DNA, 553 bp, Homo sapiens
  misc_feature 428: r=a or g
  misc_feature 512: y=c or t
  misc_feature 513: r=a or g
  misc_feature 516: w=a or t
  misc_feature 519: s=g or c
aaaaaaggattgggatattccgactccttaagggcctggcgcacataaggtgtgactttttcattcccgttgttatggagggccacatctgccagagcctggagtctgcgaaggccgggacccggttccccggcccacagtgggggtgtgcaaacccgagagaactggattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtaraaacatgcttcttatgtatcagaggacatgctcagcagatccaagagatatatttggcactttttctagaaaggcacattgggyrtcwttsattacatttttgagtttttttgggtttttttttt

SEQ ID NO: 11175 - DNA, 689 bp, Homo sapiens
  misc_feature 303: n=a, g, c or t
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgaccgtaactgccagagccctgccctgaattcctgtccttactccctctttaagatngcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttt

SEQ ID NO: 11176 - DNA, 368 bp, Homo sapiens
aaaaaaggattgggatattccgactccttaagggcctggcgcacataaggtgtgactttttcattcccgttgttatggaggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacatttttgagtttttttgggtttttttttt

SEQ ID NO: 11177 - DNA, 376 bp, Homo sapiens
aaaaaaggattgggatattccgactccttaagggcctggcgcacataaggtgtgactttttcattcccgttgttatggaggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaaggccctgaagaatcctgtgaccttcatctaaagtaggtcatgagacccctgagcttaaaacg

SEQ ID NO: 11178 - DNA, 425 bp, Homo sapiens
aaaaaaggattgggatattccgactccttaagggcctggcgcacataaggtgtgactttttcattcccgttgttatggaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttt

SEQ ID NO: 11179 - DNA, 456 bp, Homo sapiens
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacatttttgagtttttttgggtttttttttt

SEQ ID NO: 11180 - DNA, 464 bp, Homo sapiens
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaagccgatgcagcctcagtgttcctttgccttgggggtttctgagtggtggggttgtaagcagatcctgccaggcacccagaaggaaacctcatcaggactccctcagaaaggccctgaagaatcctgtgaccttcatctaaagtaggtcatgagacccctgagcttaaaacg

SEQ ID NO: 11181 - DNA, 513 bp, Homo sapiens
aaaaaaggattgggatattccgactccttaagggcctggcgcacataaggtgtgaccttttcattcccgttgttatggagggccacatctgccagagcctggagtctgcgaaggccgggacccggttccccggcccacagtgggggtgtgcaaacccgagagaactgggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttt

SEQ ID NO: 11182 - DNA, 297 bp, Homo sapiens
actggtgcgcgatttaggtccggaggaggcgttgtgaggtgagctttttcagaagcgcgatcccaggacacgtcgggaagcaagcatccccagagctgcttggaaagaggaccaaagacgtctaaaaagtcatttggaaatatctctaaatatttgttaccatgtataagctgctaaagagaaattgggcccaacaaaactaattgaataattgaggcagatttgtgtgtatcatcaaattctatccagaagttgaagaatctgaatttaaagattgtgtgcatttaataagaggat

SEQ ID NO: 11183 - DNA, 319 bp, Homo sapiens
ttggtttggtggggctgcggccacttaaaacctcccgatctctttttgagtcctttattataagtagttgtagctgcgggagggggagggggagtgcgcgggcagtggatagtaagacttactgcagtcgatttgggatttgctaagtagttttacagagctagatctgtgtgcatgtgtgtgtttgtgtatatatacatatctagggctagtacttagtttcacacccgggagctgggagaaaaaacctgtacagttgtctttctcttatttttaataaaatagaaaaatcgcgcacttgcgcgtcccccccccaccc

SEQ ID NO: 11184 - DNA, 424 bp, Homo sapiens
tggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacaga

SEQ ID NO: 11185 - DNA, 393 bp, Homo sapiens
  misc_feature 12: s=g or c
  misc_feature 178: r=a or g
actttgcggcasgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccraccgcacgggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaaccc

SEQ ID NO: 11186 - DNA, 306 bp, Homo sapiens
  misc_feature 12: s=g or c
actttgcggcasgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcaccccttcctgctcaacgaaaagcgcgtcgagatcaccaagatcgagctcaagcagcgcatcagcgtgctgctggtgccgaacaagtcgctggagacgccgaactacaagctggagcgcttga

SEQ ID NO: 11187 - DNA, 396 bp, Homo sapiens
  misc_feature 12: s=g or c
actttgcggcasgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggcccaaaggaaatcaagaaaagagcaaatgagaatgcaatttaaaatgtaaatacaaactgaaatcaaagccatttctatgaaacatttaagaacattctgtaagtattgctggtcaggaaagcacaaaaaattgtctgtgttttgagcccattgtcagtgtattatttagagggaagttctgatttttgctaaggggttattccgagttgcgaagtggtgtggtgt

SEQ ID NO: 11188 - DNA, 161 bp, Homo sapiens
  misc_feature 12: s=g or c
actttgcggcasgccgagaaccccaccccttttctttgcggaatcaccatggcggctgggaccctgtacacgtatcctgaaaactggagggccttcaaggctctcatcgctgctcagtacagcggggctcaggtccgcgtgctctccgcagcgatgagagc

SEQ ID NO: 11189 - DNA, 228 bp, Homo sapiens
ctcgaaccagaatctatttctgttgaacatctgttttttaaatcgtgaaacttttttgagtacttcaggccaaaactaggggcgagctcaagcctgtgggcatggctgccagcctgggtctgggactcaggatctgagcctcctgctgaaggcacaggctgggaatcccaggcctgggttccagtcccactccctctgtgaccctggacaagtcactgccccctctga

SEQ ID NO: 11190 - DNA, 452 bp, Homo sapiens
caaaggaattttaacaaagagcaatcagtattattggaccaaatttggtgtttgttttcaccttgacgctcttcttttcattatttctaatgctacaagaatgctgtaaagtgtcttctaaaatgatgtagcctgacaagacatttttttcagtgtataaaactaggtagtattgtgcactgatttgaccattgtgaaatcctttctcagtgtaactgcatttctaataaaaatttattgagtgaaacaatctttgtacaatgactagtcatgcatcatcagtaattttacaagttcttgtagtaggtagggggtactactagggatatctgtggcatgattatgcattccgtagtattatttaattaatttggggttcattttgcttccttttctttatgcttagattatcttactggttcaacatttttctgatatatgcagtattacag

SEQ ID NO: 11191 - DNA, 1355 bp, Homo sapiens
  misc_feature 90: r=a or g
  misc_feature 586: w=a or t
  misc_feature 605: r=a or g
  misc_feature 649: w=a or t
  misc_feature 665: m=a or c
  misc_feature 697: y=c or t
  misc_feature 734: k=g or t
  misc_feature 753: y=c or t
tggtgtttaactaagggccatccaaccatccaacctttaaaaaacaaaacgaaagtgcttctcatcaatgatatgtaaggtgacttatgratcacctgaagtacaattctttgttgtttagcacttaaatttcccaatttattaaattgatgtaaatcagatcttttctacaagctcctatccagccttttttttgaaatttctcaaactcatttactagttctgtaaaatcaagatactaacattgtcaaatgcaaagatttgtttgatttttaaccacttcccatgtgttatacataacaccttttgcattatttcttatgttttgaaaagaaaatagctttttatactttttagttttgatttcggtaactagtttaactacaggtaaccttcaaagggaccattgtacattatgaacaatagatagagatgacatcttgatgactcttgaaatatggaaattttgtctgaagatcagtggccatattactgtaggccctggttcatgttttcatcaatctaaggtgcaatttctaaatttgtaagagtaggtttaaaaaaaaaagtgcttcttatctttgtwaacattgtacttttccttratgttcttaaaaggtatttccctcagattactcatgtttatgtwgtgagcatgtagaaamagtaatgctaatgcatggctagttgccttttyaagattgtgacaccaggcttaccttttaaagtttagkatatagagacaattttaayggaaataactactgtagactattgaagaatgatctctttgtgatttaagaagtggctggattggaacttttaatatgctaatgtggaaaattaattacctttatgaaggtggtttattacaaataagcacactaacccctcggaagttgttttacctactttaaaagttttaatggattgcacctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttaaccgaatgttcattcatattcatttataaaaagtacctgtatcaaaggaattttaacaaagagcaatcagtattattggacactgggcgcgcggtggctcatgcctgtaatctcagcactttgggaggctgaggcaggagaaccgcccgaacctgcaagcgaaggttgcagtgagccgagatcacaccactgcactccagcctgggtgatacagcgagacact

SEQ ID NO: 11192 - DNA, 340 bp, Homo sapiens
  misc_feature 327: w=a or t
aaagttcatatcccagtgtcctttgaatcgacttccttttttcttttttccggcgttcaagatgtcgaagcgaggacgtggtgggtcctctggtgcgaaattccggatttccttgggtcttccggtaggagctgtaatcaattgtgctgacaacacaggagccaaaaacctgtatatcatctccgtgaaggggatcaagggacggctgaacagacttcccgctgctggtgtgggtgacatggtgatggccacagtcaagaaaggcaaaccagagctcagaaaaaaggtacatccagcagtggtcattcgacaacgaaagtaaaggtwctgccattacagg

SEQ ID NO: 11193 - DNA, 475 bp, Homo sapiens
  misc_feature 338: w=a or t
  misc_feature 339: n=a, g, c or t
  misc_feature 343: n=a, g, c or t
  misc_feature 417: n=a, g, c or t
  misc_feature 418: n=a, g, c or t
  misc_feature 419: n=a, g, c or t
  misc_feature 420: n=a, g, c or t
aaagttcatatcccagtgtcctttgaatcgacttccttttttcttttttccggcgttcaagatgtcgaagcgaggacgtggtgggtcctctggtgcgaaattccggatttccttgggtcttccggtaggagctgcaagcacccgtgggcgcagacggactgaggagccgctttgtccaccttgagcccatgtctcatgaactaccctgtggccatactcagacagtccaggcacattatattctgaatgaggcaccctgctggggctgaagaagctctcttctattatctgataatggcaaagggaggcattgtccgaactgggactcatggactgcwngtgnagcaggaagacatgaagggccatttttccatctcaatccctgtgaagtcagacattgctcctgtcgctcggttnnnngatctatgctgttttacctaccggggacgtgattggggattctgcaaaatatgat

SEQ ID NO: 11194 - DNA, 454 bp, Homo sapiens
  misc_feature 259: n=a, g, c or t
  misc_feature 260: n=a, g, c or t
  misc_feature 326: m=a or c
  misc_feature 401: w=a or t
cattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgagagcttccattacttctgaaaactatatttatctgagtgagtccaaggtgcaactnntaaatgaattgtgttgcagagaactcccagtataattcactgaccagtacattttataaccatccmggccttggtttgcaagcaacagaccttaaacatacaggaaactattaaaattggctcgatcagtagtcataggawttggtataagaagagactcatttagagctcagagttttcttcacataatgggg

SEQ ID NO: 11195 - DNA, 488 bp, Homo sapiens
  misc_feature 63: m=a or c
  misc_feature 64: n=a, g, c or t
  misc_feature 86: n=a, g, c or t
  misc_feature 415: y=c or t
aaacaatattcacaactttcttaaatttttaaattgaaaaccaaggttttttcaaatataaamntagatgattttggtcacaaatngttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattayagggttttagagatctgtgggtcaaatgatgtccctcaaaacttcctaaaaaggtgaagctcaaagtcacaca

SEQ ID NO: 11196 - DNA, 455 bp, Homo sapiens
  misc_feature 11: w=a or t
  misc_feature 431: m=a or c
tcatatctggwaatggcaaacagggatgaaaatcgattatgttttggagactccttttggacatgtatcagtgtgttgatttgcacaaaccaataaaagccctacattttttggaaatggatccctagatttcaagcatgtataatcactcaaagtggatatgatcacaggcattcttctcttgagctcagcaaaactatgcctaccaacaccgaagagaagtcaaagatttttatgaaaaaaaattgcagatgatgttggtgagataataggatatgagcaatgaacccttgggtggggttccagggcacttaaattgcctcgtgtcttgagtccttaagatggactcaaacaaaaaattagtattatcaataacaggtaatactgtgtggattctaacaacattagaatcattagctggcagtgtcaamtctgaacaagatttgtcagcttat

SEQ ID NO: 11197 - DNA, 118 bp, Homo sapiens
aaatgtccacttttgcttgcagcaaagtttccgcctgttccatgggcatcctggaccccttgaccctgcaagacaattacagcttcatcatcgagaaaactatgtgagctgccacgac

SEQ ID NO: 11198 - DNA, 200 bp, Homo sapiens
actgattttggctctcatttcactcttcagtgttcctgttatttatgaacggcatcaggcacagatagatcattatctaggacttgcaaataagaatgttaaagatgctatggctaaaatccaagcaaaaatccctggattgaagcgcaaagctgaatgaaaacgcccaaaataattagtaggagttcatctttaaaggg

SEQ ID NO: 11199 - DNA, 589 bp, Homo sapiens
  misc_feature 25: s=g or c
  misc_feature 583: m=a or c
aaggataggccgagttccgggcgcsaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaactttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttamcttttt

SEQ ID NO: 11200 - DNA, 309 bp, Homo sapiens
tcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgcttctaatatatttgggt

SEQ ID NO: 11201 - DNA, 234 bp, Homo sapiens
caaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagacctcaactgtttggcattatgaatctgtacatgggtagttacattttaaaatagactaggatcttaagtttcgtgcctac

SEQ ID NO: 11202 - DNA, 373 bp, Homo sapiens
cctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacaggggctatctgatgggttagagtgcctttgagaagaaatcagtggatactggatttgctcctgtcaatgaagttttaaaggct

SEQ ID NO: 11203 - DNA, 203 bp, Homo sapiens
agtagtgtctgtaaacgccgcttaaaataaaactcaccaagggtttgccagaataggtttctggagaagaatcgctggtgtgagcaggagctctgtcccagtggggctgctgagtgtcacccactcccccactgcgattttctcactgtcagtcccaccgcttcctgccacttggtctggctggtcttttttttttttttttt

SEQ ID NO: 11204 - DNA, 496 bp, Homo sapiens
  misc_feature 486: n=a, g, c or t
catttattgtattagctgaataacatacaagtagttcttggaagatggtattttaagcagcagcaaacaaaactgatatttacattgactttttcattttcagaatccaagcaaaaatcctggattgaagcgcaaagctgaatgaaaacgcccaaaataattagtaggagttcatctttaaaggggatattcatttgattatacgggggagggtcagggaagaacgaaccttgacgttgcagtgcagtttcacagatcgttgttagatctttatttttagccatgcactgttgtgaggaaaaattacctgtcttgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagctagnaaaaaaaaaa

SEQ ID NO: 11205 - DNA, 296 bp, Homo sapiens
  misc_feature 122: r=a or g
cagctcggcatggcggcagtcactgccgtcacttagtcgccgatcaaggcttggactaagggcccacggtcactcgagtaggacttggatcggatgctgaataaaactcaccgtgaagcaargtcccactgaacgaaaagttggtcgtagcatttctcaggtgggataggagcatgccaggtgctgcgagggtttaatcgggctcttctgctggccttgaatatggtggacaggacaggacattctcattgctcaggagccactggcgctgcctttgggaatgaagttccacagcc

SEQ ID NO: 11206 - DNA, 543 bp, Homo sapiens
  misc_feature 60: s=g or c
  misc_feature 387: n=a, g, c or t
  misc_feature 388: n=a, g, c or t
ctctagtctcgtggagagattgaagatggcggcttctcaggcggtggaggaaatgcggascgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctnnttgagtatcggaaccaaggtgagaaaatgaaattttgggagaagtggactatctgggttcaaatcctggttgactgtgatgttgggagatgaagaaggcacagagatagatactctacagtttcgtcttccaggtcagatgcactcggaaccccc

SEQ ID NO: 11207 - DNA, 205 bp, Homo sapiens
actctgtttctgcctccaagaagaaaagcctaaaactcactttcttccggactctttcaaggaagctgattaaaagaagctcctaaaccagaggtgcagacaaggtgatgatgtggctctcagaggaaggtgtgctacctacaaccctgctggcttcatggaagaatatgcttctcaaatgcaaatccaatcaagttatctccct

SEQ ID NO: 11208 - DNA, 164 bp, Homo sapiens
  misc_feature 160: r=a or g
ttcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagraatg

SEQ ID NO: 11209 - DNA, 275 bp, Homo sapiens
taaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtag

SEQ ID NO: 11210 - DNA, 242 bp, Homo sapiens
actacactgagacaaatattgtcacaaatcagatgatcatatatttttggttctattattggacagttctgttggtcactttgttgtccttgaatcagagcagcttttaaaactcattaactttatctgctttgtcacctttttgtttcggtggggtaaaccctgaaataattgttccatacctcttaaatattgcctaatcatggactgcagatgatagagcacacactgagcattttttg

SEQ ID NO: 11211 - DNA, 469 bp, Homo sapiens
  misc_feature 407: r=a or g
  misc_feature 436: n=a, g, c or t
gagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttgraggagcttgctttagttagatgtcttatnattaaagttacctattattgttggaaataaact

SEQ ID NO: 11212 - DNA, 157 bp, Homo sapiens
  misc_feature 10: k=g or t
caccaaggakagcaaagtgagaagtcaagaggacctagtagggcccctgaaaactccaaatggccaagaagaggcaaagagctacaaacaatcctgagagggggccgagggcagagccacctggagggaatgttcatcaaagtcacaccctgcccct

SEQ ID NO: 11213 - DNA, 120 bp, Homo sapiens
gaattataaatgttgtatttgttcattgaatcatcatgtcacatgtttaggaaacttactgtttcaaaaaaccttgtgatacattttgtgatgatttatatgaccaattttcaaacccac

SEQ ID NO: 11214 - DNA, 424 bp, Homo sapiens
  misc_feature 263: r=a or g
  misc_feature 267: n=a, g, c or t
  misc_feature 309: y=c or t
aaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaacccaggaagagcgttcgcggagracancaacttagtgaacatccagaagacccatgagcggatgcagayagagaacaagatttctccctattaccggacaaagctgcgtggcctctacacaaccgccaaggccgatgcagaggctgagtgcaacatccttcggaaagctctggacaagatcgcg

SEQ ID NO: 11215 - DNA, 309 bp, Homo sapiens
  misc_feature 79: n=a, g, c or t
cccccaagcgcccgccccccacctccagtcagtcagtgtctcccgatcttcttcctgcagcagagaacagaaggcagtncacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccgag

SEQ ID NO: 11216 - DNA, 287 bp, Homo sapiens
  misc_feature 249: s=g or c
  misc_feature 253: m=a or c
acaagggaagattttcttttttagaggtacagattcctcttagtcaagtcctgattaaaactccagctaagacattagtaagccttggttagtgaagtggcatcaggaagtgcctacattttcatggcctggtagcgttcagtgaaaatgttcattaacagacacaggccattcagtcccgaatcccaagacactgaagactctgtttgaatcagactcacgggttccttcctagccactctcagggasaggmatgcttctggtgaagaagttttcggtggtggttc

SEQ ID NO: 11217 - DNA, 207 bp, Homo sapiens
  misc_feature 176: y=c or t
aaaactcggcgcccctctagttaaaagggtaaagtacgcgctgggccccacctcacctgcgcggttactttgtactcggtgtagcccttggggtgagtcctggggtccgacactgtgtagtgccgcagaagtcatccttcgcctggcgggacatgaaaccgagctggagcggaggyagcgccggcctccacctcctcgccgtcccca

SEQ ID NO: 11218 - DNA, 441 bp, Homo sapiens
  misc_feature 225: n=a, g, c or t
  misc_feature 226: n=a, g, c or t
  misc_feature 338: m=a or c
gcggggagccaggcctcggggcctcggagcaaccacccgagcagacggagtacacggagcagcggccccggccccgccaacgctgccgccgggatgctccagaccttgtatgattacttctggtgggaacgtctgtggctgcctgtgaacttgacctgggccgatctagaagaccgagatggacgtgtctacgccaaagcctcagatctctatatcacgctgccnntggccttgctcttcctcatcgttcgatacttctttgagctgtacgtggctacaccactggctgccctcttgaacataaaggagaaaactcggctgcgggcactcccaacgcmaccttggaacatttctacctgaccagtggcaagcagcccaagcaggtggaagtagagcttttgtcccggcagagcgggctctctggccgccaggtagagcgtt

SEQ ID NO: 11219 - DNA, 290 bp, Homo sapiens
aatgttgtgatatattctcagtgcttgtgcccaccttggaactctgttcttgctcttcattccgcatgtgatactctggtccaagatcttggccaggtgccttctgctcaaatatcgtctcagaggtgcttcccttgaaaactcggtgctgtttccatagttactctatttgatcactctaagtttggttgtcttcatagcacttgtcaccctctggaactattctattcatttatttacttgtttaatgcttggctcttttcccctcctaacgtaaactccatgattgc

SEQ ID NO: 11220 - DNA, 210 bp, Homo sapiens
  misc_feature 100: k=g or t
caatctgaaaactcgtgaggggaacgtgcgcgtgagtcgtgagctggcaggacacacaggtacctgtccttgttcataagcttcaagtgacacaagctgkttacctggggtacattatatgctttggatactcactttttatcaatcattttttaattaattaattaattattttttttgaggcggagtctcgctctgtcacccaggctg

SEQ ID NO: 11221 - DNA, 347 bp, Homo sapiens
ttcagaaccaaattgctgagccagtcacctgtgttccaggagccgaatcagaaatgtcatcctcaggcacgccagacttacctgtcctactcaccgatttgaagattcaatatactaagatcttcataaacaatgaatggcagaggtgcctgctatagtggatccattcttgccaacaccaccatggaggataacatggaaataatttgaacaggaaaatattactccacctagaaatccaagaactggaaggatcttcaattttatttctagaataggaatcgtatagtcccacattgttgctcctccaaatgcagacaacacaaagacaatcactaaagctatct

SEQ ID NO: 11222 - DNA, 383 bp, Homo sapiens
agaagtccaggatgggaagagagatctgcagactcccagggaacctacagctttctccttcacagcattgcaggaggagccgaatcagaaatgtcatcctcaggcacgccagacttacctgtccactcaccgatttgaagattcaatatactaagatcttcataaacaatgaatggcagaggtgcctgctatagtggatccattcttgccaacaccaccatggaggataacatggaaataatttgaacaggaaaatattactccacctagaaatccaagaactggaaggatcttcaattttatttctagaataggaatcgtatagtcccacattgttgctcctccaaatgcagacaacacaaagacaatcactaaagctatct

SEQ ID NO: 11223 - DNA, 415 bp, Homo sapiens
ttgaatttttgtttcttcgattcaattattgtaactgtcttagctgacaactttctgagaatggttcttgggtgagcagagttcagatccatttttggactgtgataaaggatctaattttgccctcattctttctcttggttcaactgtgtcattttttcttcatactgacattgaaaaggtcatgttgtttatctcaacagtatttaaatttaattctgaaacatacactatgtctgagtcagtaaataagatggctttgacataagttttataatgcaagaataaaactctcacatttcccacagtccatgtaccaacaggaaggttttctatccccaaagactcagcaggaagtacttgtcggcatcaggaaagaagagtttacacctgaattaatcaaactgttattctg

SEQ ID NO: 11224 - DNA, 379 bp, Homo sapiens
cttttagagtgtaatgttgaagatggattggagtgggcaacaggatatggcagggaaacaagagcccatcattttggtccatttgagaaatgatgaaaagttagaaaggcattgaggcttggaacggagagggtagaaaactctcagggtactggttttgacaactgtatggatgatcaaccagatagggatcactggattgatttgatgggaaaggtaaattgagtttttggagatgctgaatttgcggttccaagtgtaactattcagatcctagatgaaatatgggtctggagatgcagacttgggagttactcagcatgaaattgtagtcaaagccttgggagctgaggaaacaggtcagggagggtgagttata

SEQ ID NO: 11225 - DNA, 585 bp, Homo sapiens
  misc_feature 558: y=c or t
aaaaaaaaaaaagtaaacctggcagctatagaatacactatgtgcatttataatagctattttatatatgtagtatcaacatttttaaattaaatgttttacattcacaagtggtggggagtcttgtcattaaggtgtgtgtaatttagagtccagttggttttcttctgactgcacttgttctcatagtagtaaaatgctatgcgcatttataccttgcataagtcctcattctaccacatgttaaccctctagctgataatgcaaacactaactgggggattttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgycctgggaaaatcatttttatagagatg

SEQ ID NO: 11226 - DNA, 472 bp, Homo sapiens
  misc_feature 37: s=g or c
  misc_feature 322: w=a or t
actgcagttgagtggaaatgggcaacggcgggcggasggcctgcagcaggggaaggggaacgtggatggggtggcagcgactcctactgctgcctcggcctcctgccagtacaggtgcatcgaatgcaaccaggaggccaaagagttgtaccgagactataaccacggtgtgctgaagataaccatctgtaaatcctgccagaaacctgtagacaaatatatcgagtatgatcctgttatcatcttgattaatgctatattgtgcaaagctcaggcctacagacatattcttttcaatactcaaataaatatccatggaaawctctgcatattttgtttgctttgtgaagcatacctgaggtggtggcagcttcaagattccaaccagaatactgcccctgatgacttgatcagatatgctaaggaatgggatttctatagaatgtttgcgattgctgctttagaacaaact

SEQ ID NO: 11227 - DNA, 311 bp, Homo sapiens
ttgtctttgttttgtttatggttagacttacagacttggaaaatgcaaaactctgtaatactctgttacacagggtaatattatctgctacactggaaggccgctaggaagcccttgcttctctcaacagttcagctgttctttagggcaaaatcatgtttctgtgtacctagcaatgtgttcccattttattaagaaaagctttaacacgtgtaatctgcagtccttaacagtggcgtaattgtacgtacctgttgtgtttcagtttgtttttcacctataatgaattgtaaaaacaaacatacttgtgg

SEQ ID NO: 11228 - DNA, 477 bp, Homo sapiens
acatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcagaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaat

SEQ ID NO: 11229 - DNA, 129 bp, Homo sapiens
atgtaaagctctccgttccaaccctaccccaaacttcctctcctgtcttcatgtggatgctaacttaaaactcttatttctgggtcagataactccctgctctcagccctgatgactacacctttgaca

SEQ ID NO: 11230 - DNA, 346 bp, Homo sapiens
cattcttaaatatttcttctacatatatttagaatcacgttagacagtgttacaacttttctttcaaccaccaaacatatttcagaaaactctttgaaagagaagggaagtctatcgtatttacgcacatttttagatttcttatttttgttataatcattccctttctgtttagagaacttcctttagccatactgctagcaacagatttttagccaaaaaaaatttttttcattcataatgaaagggaaatgacattgtcaaatgacagaaaatgggtataggattctgggttcacagttcttttctttctttacttgaaaactattgtgccacttttttctag

SEQ ID NO: 11231 - DNA, 433 bp, Homo sapiens
  misc_feature 61: s=g or c
actagggggcgcgtctctgagggcagggcctccgtctccgacgctgacttcctcagcgcascagcactgtctccggtggcaagtcgaccagctcctcccacacggattctgtgtagaaatccacggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagta

SEQ ID NO: 11232 - DNA, 161 bp, Homo sapiens
cattctgtatttgcaacccttatttgtggacatttataaaactgacatgagttcatgaatgcttcctgtgagaagtgtgcttctaagaaaggagtcagcttttatatgtggaaaagccaagctgtggtctgtgggaaatacatatgtgttagatacaacct

SEQ ID NO: 11233 - DNA, 380 bp, Homo sapiens
catctttttgagagtctccttcccctaataacggctgtattagtcagcgtttactacttgccaggttaacaagtacacttccagtgctgataatgtctgtgattgtgcatgtatgttgtatttgtgcatttttataaagtactttagattgtgtcatgattgaaagggtgtcacttcttatttaaaactgactttaccattttattgtggtctcaggagaaactaattcgagatgttgctcattgtcatggaattttgatcacatcttactcctacattcgattgatgcaggatgacattagcaggtatgactggcactatgtgatcttggacgaaggacacaaaattcgaaatccaaatgctgctgtcacccttgcttg

SEQ ID NO: 11234 - DNA, 289 bp, Homo sapiens
cattggacttttgaaacagaataaagaaaggtgccaagcatagtaaagctctgaaagaaaggaggaaactggaaaggatagatggaaagagatttaaggaagtcatttaagtggtcaacaatataaaatgtcttagataagtttggagagcttgaaaactgagaaacttttcaaaagagggaagtgattgatagcttttgggagtggagaataatagaagatatttggagagctggtaggcatgaattccacacatttgtttggtagccaggagatgtagaagagtaca

SEQ ID NO: 11235 - DNA, 249 bp, Homo sapiens
gaactgtatatccaataatagtgaaatggatcccactaattatgacagaaatgatgatacatttaaatgacttggatgttttataggtatgatctcgtgaaatcttgagagaaactgaatgacgaatgaaactattgttcctgtttcacacagaagaaaactgaggttaaaaggggtaaagtaattttgcatggcatgaagtagaaattcaaagtacaggaatttgaacttggttctgtccttttctga

SEQ ID NO: 11236 - DNA, 253 bp, Homo sapiens
atgaatttgatgcagacttacagtatgaatacttcaatgctgtgctgataaatgaaagggacgaagagtaggccttctgctgtctataaccatccaggaagctggcattgatgtagtcagagccctccacaccacggatgggctgcagacacaaactggacagcgaggacaaggacaaagaaggcaaacccctgctgaaggctgtgatgcgccgctggctgcctgccggagacgccttgttgcagatgatcac

SEQ ID NO: 11237 - DNA, 583 bp, Homo sapiens
  misc_feature 337: w=a or t
  misc_feature 338: n=a, g, c or t
  misc_feature 581: m=a or c
  misc_feature 582: m=a or c
ctaattccttcttcctatgaacattcatcttttgagtatggtggtgtcttaggctagaaaactgatgtctggcctttgtaggtataaatacctatttatacctggcttatgtgatgcctagtctctggtccccttcagtccatagcactgactggccactttgagcatatggtagtgagctgcagatatgactaagtaaggctgctagcattcagtcttagccatttaagtagtcagcatatgctagtaatgtttgtattcagtataacttggaggcaaggtgttttttactagcacattttggttttctcgttgttgttattgttattaatttttwnaaaagcttacattggggataattgagaataaatgcctttgcattcagcatgcatgagatgtgcttgtgtatagggaggttgttgcttgggtggaagagttagaatttgtatgtataaatgaaggaaaaatgtgatttgcagggctactttccaggtcgaccaagttcttcaaagtgacaaacatctctgttcctttgaaaattatagagacgctggtgtgccctatcattaaatgaattgtcmma

SEQ ID NO: 11238 - DNA, 203 bp, Homo sapiens
aattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgcccca

SEQ ID NO: 11239 - DNA, 577 bp, Homo sapiens
  misc_feature 71: n=a, g, c or t
  misc_feature 72: n=a, g, c or t
  misc_feature 504: m=a or c
tcattgatgtcgaaggatatatacagtgttagaaattaggactgtttagaaaaacaggaatacaatggttnnttttatcatagtgtacacatttagcttgtggtaaatgactcacaaaactgattttaaaatcaagttaatgtgaattttgaaaattactacttaatcctaattcacaataacaatggcattaaggtttgacttgagttggttcttagtattatttatggtaaataggctcttaccacttgcaaataactggccacatcattaatgactgacttcccagtaaggctctctaaggggtaaggtaggaggatccacaggatttgagatgctaaggccccagagatcgtttgatccaaccctcttattttcagaggggaaaatggggcctagaagttacagagcatctagctggtgcgctggcacccctggcctcacacagactcccgagtagctgggactacaggcacacagtcactgaagcaggccctgtttgcmattcacgttgccacctccaacttaaacattcttcatatgtgatgtccttagtcactaaggttaaactttccca

SEQ ID NO: 11240 - DNA, 237 bp, Homo sapiens
  misc_feature 138: m=a or c
  misc_feature 237: y=c or t
aaccttcccccttcgcggccgagatggaccctgggctcggcgtcctccggaaaactgcactgtgaggcggggcgatggggaagggccgaagccccgccagcccagctaaagcagacggctcgcactgcgacccgaagmgcgagtcatggctggggccttagtggcaacaagtgctgagatcagcgggctcagtagcaggaacacaagcacccccttgcggtgtctggaggaagcggy

SEQ ID NO: 11241 - DNA, 182 bp, Homo sapiens
agccggtttccggtgcaggtggggaaaatggcggtgtctacagtgttctcgacttccgctgtctttttgctaaagaacatctgcagcacatgacagaaaagcagctgaacctctatgaccgcctgattaacgagcctagtaatgactgggatatttactactgggccacagaagctaaacca

SEQ ID NO: 11242 - DNA, 333 bp, Homo sapiens
  misc_feature 309: m=a or c
actttcgttccgtcttccatcgttttctctcgtgcaatggcgtccgggctggtaagattgctgcagcagggacatcgctgcctcctggctccagtcgcccccaagctggtccctccggttcggggagtgaagaagggattccgcgccgccttccgcttccagaaggagttagagcggcagcgccttctgcggtgcccgccgccgcccgtgcgccgttcagagaagccgaactgggattaccatgcagaaatacaagcttttggacatcggttacaggaaaacttttccttagatcttctcaaaactgcmttaaaactttaatcccacttgccc

SEQ ID NO: 11243 - DNA, 283 bp, Homo sapiens
  misc_feature 274: n=a, g, c or t
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaataattttgcctcaaaaggcatttagaaaataagaaaacaaatcaaggtctgatgaaaattcaactctttatgacttgaagaattacatatganaagtacatg

SEQ ID NO: 11244 - DNA, 431 bp, Homo sapiens
  misc_feature 177: k=g or t
  misc_feature 184: k=g or t
  misc_feature 209: n=a, g, c or t
  misc_feature 245: n=a, g, c or t
  misc_feature 246: n=a, g, c or t
  misc_feature 303: n=a, g, c or t
  misc_feature 310: k=g or t
  misc_feature 311: s=g or c
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcaccgtaattgtgtaatgctkgtgtttkaaataggtatttataataattaaancatattattgctccttaagcattgaagaagaaatannaaaagaaagaaaataaattaaaaaattaaaccccaaacaaaattttagaagtaatanaaaaagksaataattttggactcctggcattagctactatgatgacctatttatctcctacagtgtagttgacatgaagaaaacttacttttggcttgcacttgctctgtgtgtgtgtgtgtgtctgt

SEQ ID NO: 11245 - DNA, 419 bp, Homo sapiens
  misc_feature 171: y=c or t
  misc_feature 172: m=a or c
  misc_feature 314: w=a or t
  misc_feature 354: n=a, g, c or t
  misc_feature 355: n=a, g, c or t
  misc_feature 408: k=g or t
  misc_feature 409: n=a, g, c or t
ctaagttctcgcgcgactcccacttccgcccttttggctctctgaccagcaccatggcggttggcaagaacaagcgccttacgaaaggcggcaaaaagggagccaagaagaaagtggttgatccattttctaagaaagattggtatgatgtgaaagcaccaatgagggggymaagagaaacccaaaggggccaggtgcggttggtcacgcctgtaatcgcacattttgggacgccaaggtgggtgggtggcttgagccctggagtttaagaccagcctgggcaatgtggggaaaccctgtctctacaaaaaatwgaaaaattagctgggtgtggtggcgggcacctgtaatcgnngctacttgggaggctgaggcaggagaattgcttgaacctgggaggcagaggtkncagtgagcaa

SEQ ID NO: 11246 - DNA, 330 bp, Homo sapiens
aaaacaagtcctgctagtcgcctccgtctgggtaccagccccctattactctgcaggcgtgtgaagaaagaaggaaactagctcggaccgtgcaggtttgtaggtctgttggcctgtaggtttcggcacaagtttcagcgagagaaggagaaaactgccttggttggaaccttgcagattcatcacaagagagctacaagagcctggaagaagctgaagactgctaccctccatccttactcaccctggacctgagagacctcttcaatcagaaatggaaacagagagattctcctggaaacccctgccccataaacggccctctcgaac

SEQ ID NO: 11247 - DNA, 734 bp, Homo sapiens
  misc_feature 289: y=c or t
attcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatayaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaagcggtgtattctttttgacaattcattttcctacagactaccccttcaaaccacctaagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctccccccctttgccatgcattgcatg

SEQ ID NO: 11248 - DNA, 482 bp, Homo sapiens
attcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgcgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattgg

SEQ ID NO: 11249 - DNA, 269 bp, Homo sapiens
ctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcgggataatcaagagttttggccggacctttgagcatacaccgagagagtgaggagccagacgacaagcacacactatggcgctgaaacggattaataaggaactt

SEQ ID NO: 11250 - DNA, 348 bp, Homo sapiens
  misc_feature 142: y=c or t
ctcccccgccctcctggtccaatctccgatctgtttagtaagaaggtgctgttccgagaggagaaggaaaagggcttgacacgtattcactcggccccggacgtgggaagcaagccgtctggcttcggcctcacatcggtcytgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaactt

SEQ ID NO: 11251 - DNA, 172 bp, Homo sapiens
  misc_feature 70: k=g or t
gtgagccccgtaggccggggaggcaccagctgccgcgcggggaggaggccgaggccgcagcttgagggakgccccggcccctctgcgcctgtgtctggcagagctggtgtgagacgagacaatcctgccccgccgccgggataatcaagagttttggccggacctttgagca

SEQ ID NO: 11252 - DNA, 488 bp, Homo sapiens
  misc_feature 305: s=g or c
gacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcascaagttgaagaggaaatattggtggaagaattgcaagatgtgggcaatcgggattactgttctggttatcttcatcatcatcatcatcgtgtgggttgtctcttcatgaagaaccagcggaactcaaaactgctgttcaagaaacctcttcaagacttttgacttagaacctgctatattatc

SEQ ID NO: 11253 - DNA, 305 bp, Homo sapiens
  misc_feature 8: s=g or c
  misc_feature 119: r=a or g
  misc_feature 174: n=a, g, c or t
  misc_feature 188: s=g or c
tggagacsggctccatgtgaacagcagttgaacatgggtcagtcggtcctgagagatgggcgagcgccgttccgaaggacgggcgatggcctccgttgccctcggccgaatcgaaaggragtcggggttcagatccccgaatccggagtggcggagatgggcgccgcgaggctnccagtgcggtaacsgaccgatcccggagaagccggcgggagccccggggagagttctcttttctttgtgaagggcagggcgccctgggaatgggttcgccccgagagaggggcccgtgccttgggaaagcg

SEQ ID NO: 11254 - DNA, 312 bp, Homo sapiens
gaagataataataatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttg

SEQ ID NO: 11255 - DNA, 181 bp, Homo sapiens
  misc_feature 92: n=a, g, c or t
ttttatagatactgactcataagtgtaatttgaaagtaccccttgacccaaacaaaactgcttctcaaaacttctcattttctccctgaganattctaaagaattgttctctgttcatttctaagagaaagatttactgggtgtatgatgcggttacttttaagttatttctactggccag

SEQ ID NO: 11256 - DNA, 456 bp, Homo sapiens
  misc_feature 42: r=a or g
  misc_feature 167: w=a or t
ctctctctgctctcgcggccgactcgcaagatggcgccgcaraaagacaggaagcccaagaggtcaacctggaggtttaatttggaccttactcatccagtagaagatggaatttttgattctggaaattttggtaccttccctagtgaatatctagggtcttcccwagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcgga

SEQ ID NO: 11257 - DNA, 325 bp, Homo sapiens
cattgaatactttgtgaatcaacgcaaaactggacagattccaccagcacccatcatgtatgagaatttctactcctcccagaagaatgcagtcccagcaggaaaggctacagggcctaacttggcaaggagaggacccctcccaattcctaaaagctcaccagatgatcccaattactctttggttgatgactacagtttgctctatcagtaaaatcaatgaaaccagagctttttccggctagtgcttctgtgatatggaaagggcacccagagcagcaggacctatagccacgttatgtcagcaatgaagactttgaagtga

SEQ ID NO: 11258 - DNA, 394 bp, Homo sapiens
  misc_feature 11: n=a, g, c or t
  misc_feature 307: s=g or c
tacatgtttgncgatgactcatatcctttttgcctagaatgttcagatcctaggaactgacatctgtcgtgtcctccgtagaacttctgtttatgaagtgcatatatgacttgtcatccgatccttttttactcttgagtcttttgagtatataatgacctattattttccctttctccctgcaggaatgggatcaggtaacccagagtgcctcttcacatacattgttcaagagcttaacttggtaggaaggaaaactgggttatttgggagaatcagtagttgtcacatcaggacaccggcagtsacagaatgggtcatttcaaggcaggccctggtgctttgggataaggtgtgtgctgacctctctagtaactgagatatctttgagcac

SEQ ID NO: 11259 - DNA, 163 bp, Homo sapiens
cacacattaataataagttctgaggaggcatttggtgcagctagtaatcataattcttattaaaactggtgacgtctggcccccagggtgtagccaagctcaaattgatgctttttgccgcctgatcaccagcatggcctaagtgctcattatattgtagaga

SEQ ID NO: 11260 - DNA, 113 bp, Homo sapiens
tatccgtaaaatggccacaaaactggtggtgccaatgagcctgggttcagtgaggttaactgagcaaccagttcaggcacaagcctgcctcaggtcacccctgggtaactgtc

SEQ ID NO: 11261 - DNA, 215 bp, Homo sapiens
agggaatggagtatgtttatgcatctgggcagtttgtaactaaaccagccagaatgtatgtaagaccattgtaaaactggttcaatttcgtgttcgtgtattatacagttagactggagtttggcaaggaggccactaggactcattaaacttttctggatagtgatccaaagggcattagtgtcagttttataattgtgaaggtataaatgagg

SEQ ID NO: 11262 - DNA, 213 bp, Homo sapiens
agaagacgtggattgagtgagccacatagcccctttcctgttctggtttcttggtggcatttgcagcagtgcctctatgatgcctgagcaaaactggtttattgggaagtgatgtaaaccatactgccagtgcttttgctcagcacttgggcacttcgtggccgtgtgtctcatatgatgttcataatgcttttttttccctctccttccccc

SEQ ID NO: 11263 - DNA, 414 bp, Homo sapiens
actcaaggtgcatttttatttcacagattgatacttgcttttttctgtgaaacagttctcctagataccaaaatcctcaggatgaatttttgcatttgaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactat

SEQ ID NO: 11264 - DNA, 264 bp, Homo sapiens
tgtagacacaccctcccctaacaaaaacaaaacgaaagagttcatactctgattttccaacatctaggaaactgagttttatttcctagctctaaggcagccttactatatgtcagtaaagtgctgaaaactgtatatttagcagtagcacccaaaaccaagcctttaaccccaacaatgtgtgtatcttttgcacagcaaaaactgcgaggccagaactagtttatctgaacacctcagctgctgtaagcttctcctctctca

SEQ ID NO: 11265 - DNA, 156 bp, Homo sapiens
aagctttgctccgctccggcagtggcttactcccggtgccaggttcttggagctgtgaggaggaacaaccatgtcatcagaatcgagcaaaaaacggaagcccaaagtgatccgaagcgatggagccccagctgaaggaaagcggaatcgatctga

SEQ ID NO: 11266 - DNA, 338 bp, Homo sapiens
  misc_feature 256: s=g or c
gcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctastatggcttctggaatcctggttaatgtaaaggaggaggtgacctgccccatctgcctggaactcctgacacaacccctgagc

SEQ ID NO: 11267 - DNA, 152 bp, Homo sapiens
acattaatggctaacaacacgtagggacttcatgtcatgtcaaagatagctctttgcaagtgccttgattaaaccagaaaactgtcatcgtttaacccaaatatctgaatggtcatctggtaactcatgggtttttggcctcataagatggc

SEQ ID NO: 11268 - DNA, 564 bp, Homo sapiens
  misc_feature 475: k=g or t
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaggkccggggtggggcactaacagcatctactataggcttcttctcacacctacaggagctgaactccaggtaggtggtctaattcagagccg

SEQ ID NO: 11269 - DNA, 652 bp, Homo sapiens
  misc_feature 507: k=g or t
  misc_feature 526: n=a, g, c or t
  misc_feature 631: m=a or c
  misc_feature 632: r=a or g
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctaccccacatgtctctactaaaaatacaaaaaaattagctgggtkggtggcaggctcctgtaanctcagctactcaggaggctgaggcaggagaattgcttgaaccaggtaggtggaggctgcagtgagccgagactgcgccactgcactccagcctgggtgacagagmragactctgtctcaaaaacaa

SEQ ID NO: 11270 - DNA, 694 bp, Homo sapiens
  misc_feature 619: n=a, g, c or t
  misc_feature 660: r=a or g
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgccggctcgggggctgacggcgatactgggctgcaccgagtgcttcgtgtacctttctctgttgttcttcagctcatacaccacaaagagaaaggcgaggaagtctgcagacaatgttgtgagcaggcatacaagaggcctaggtttttnactatttacattttcattcatttagtcattcaacacaaatrataattccttttaagttctaggcactttgcaggg

SEQ ID NO: 11271 - DNA, 306 bp, Homo sapiens
actcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaa

SEQ ID NO: 11272 - DNA, 547 bp, Homo sapiens
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaa

SEQ ID NO: 11273 - DNA, 351 bp, Homo sapiens
actcctcaccggggtgaaaggttagcggaagtgtccttctttcctttttgctgtaggcccgggtggttgctgccgaaatgggcaagttcatgaaacctgggaaggtggtgcttgtcctggctggacgctactccggacgcaaagctgtcatcgtgaagaacattgatgatggctttgcgtccggagtagcgtccagccagtagtaacccccctcccagagttgtgataaccaaaatgtctgtaaacattgccatgtcccctgggggacaaaatcaccctgttgagaaccaccaccctgaagccattcagctcctcaagagaagcattctaactcctagttctagttattga

SEQ ID NO: 11274 - DNA, 592 bp, Homo sapiens
gacttgtaactcattttttcacttgagcacttagagaccattgtaggggttattaattggcctagttttaatattgttgtgcctcgaggcaaaggtaggaccaagaagagggagagagatgggggaagtgccagtgagtggagcagtcagaacacacatttgttgattaagtttgcaaccttctatgggcacagtttgtgatgccccaaaacaattgcaatagtaatatcacagatcactgatcacggataatcataacaaatataataataaaaatttgaaacctttttgctgtaggcccgggtggttgctgccgaaatgggcaagttcatgaaacctgggaaggtggtgcttgtcctggctggacgctactccggacgcaaagctgtcatcgtgaagaacattgatgatggctttgcgtccggagtagcgtccagccagtagtaacccccctcccagagttgtgataaccaaaatgtctgtaaacattgccatgtcccctgggggacaaaatcaccctgttgagaaccaccaccctgaagccattcagctcctcaagagaagcattctaactcctagttctagttattga

SEQ ID NO: 11275 - DNA, 196 bp, Homo sapiens
acctttttgctgtaggcccgggtggttgctgccgaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatg

SEQ ID NO: 11276 - DNA, 325 bp, Homo sapiens
  misc_feature 87: n=a, g, c or t
cacgaagctgcgtcacttccggcgtgtgcgtctggcgtccgcgcgctgcacaatggcggctctgaagagttggctgtcgcgcagtanacttcattcttcaggtacagacagtgtttgtgtgttcctgttgtggctaactttaagaagcggtgtttctcagaattgataagaccatggcacaaaactgtgacgattggctttggagtaaccctgtgtgcggttcctattgcacagaaatcagagcctcattcccttagtagtgaagcattgatgaggagagcagtgtctttggtaacagatagcacctctacctttctctctcaga

SEQ ID NO: 11277 - DNA, 191 bp, Homo sapiens
atcttcttaatctgtgtctttcaagggaaggtcattgctgctctgaaggaagctgcattttgtgtgcaggaacggagaataaactgagctctctctctgacctggaacagcagtaccgagccttgcgcaagtactatgaaaactgtgaggttgtcatgggcaacctggagataaccagcattgagcacaac

SEQ ID NO: 11278 - DNA, 154 bp, Homo sapiens
aaatgatgtagagagggttggggagatggggattagtaaagagaagatagaggacatggaaattgcaggagctgagtggtaaacaggaagccttatggcaagagtgtcagggatggtggcctgtggaaaaaacggggaaggagaagagaagggg

SEQ ID NO: 11279 - DNA, 197 bp, Homo sapiens
  misc_feature 121: w=a or t
  misc_feature 141: r=a or g
  misc_feature 142: k=g or t
aaaaccaattttgaaactatgaaattcctgattcataaatacacagttatttctactttagtacatataagataattcactgttattaaagctcttttattaaggcaattgcatatgtttwaaaagcaatggtaaattaarktgtcttccaaaactgtgtacttgtctggtcagctgtgtaatcagttatctacctc

SEQ ID NO: 11280 - DNA, 403 bp, Homo sapiens
  misc_feature 15: k=g or t
aaaaacaaacgccgkaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaaacaaaactgtgtggagttttatcctatattcataattacattgtggatggctgggtggtatttcaaccaagtttttgctacttgtctgggtctggtgtacatatatggccgt

SEQ ID NO: 11281 - DNA, 307 bp, Homo sapiens
  misc_feature 7: n=a, g, c or t
caataancaatgctgaactatgtaaaatggcctttttcattgaggggtgacgatacaaatagctaattctgggccaaagagatgtgagtgaagtggctggtgattgctgaatatatttgatggcaaggtaactacgtttttgaaccttgaaaactgttctactttagggcattttggattatgcactcactcaacaagtatttattgagtatgtactgtgtactagacactgttctaggttcttgttatatatattgatgaaagagaaagaaaagtctcttctttatgatactttttctagtagggg

SEQ ID NO: 11282 - DNA, 166 bp, Homo sapiens
tttggcagatttgccatcagaacggagactaatacctgtggcatcaaatctgttttctttgctacacagagtttgaaaactgtttttaaggttttaagggcttatatgatacttttagggtttgtttcctttagatatctcccattggaagcaggttgcacaacgg

SEQ ID NO: 11283 - DNA, 328 bp, Homo sapiens
  misc_feature 19: k=g or t
ttctaggaggtttgttgtkttgcctgtagttttgaggagcaggaagctcatgggggcttctgtagcccctctcaaaaggagtctttattctgagaatttgaagctgaaacctctttaaatcttcagaatgattttattgaagagggccgcaagccccaaatggaaaactgtttttagaaaatatgatgatttttgattgcttttgtatttaattctgcaggtgttcaagtcttaaaaaataaagatttataacagaacccaaatattcacgtccgacactgactttgtggttgatgctcctgcacctcctagcgggggcctcctccgt

SEQ ID NO: 11284 - DNA, 167 bp, Homo sapiens
ctttgctaaaaaacggtcttccagtttcagaagttcgtgggtcatttaactgtaaacgcctaaattttaagagagcccttactcttatacagtgaatttggaggactggcttaggacaaggccctctatgttcagaacgtttatcacttttctctcttttttttttt

SEQ ID NO: 11285 - DNA, 191 bp, Homo sapiens
tctaatacttcctccaattgatttctactctttctctggacacttttttttgtttttgtgaaatatatcttagtcatatttatctcacatttgtgaaacttcaaaaaaaagctttcattagacagttgaaactatggattattttcatcatttattctagcaactgatgcatttcaaaatgttttgaatag

SEQ ID NO: 11286 - DNA, 176 bp, Homo sapiens
tcagtggaattagacttctaatacatgtttgaaatttaatgtaatttaaaaaaatggaataactgaagaaaaatgaaactgggttttattaaaaaggttctcttattcagtttggatataaagcactatgatgcatttttccctagatgtgccaaaatcaaaacttaatatataca

SEQ ID NO: 11287 - DNA, 176 bp, Homo sapiens
agggagaggcagagaggcaggcagcctgctgggctcttcctgctgttgaaaacttacccggcccttacagaggaaatcttcctcctctcttctgccctgaatgttttcccaaacatgaaggtaagacaataaattcattacttttgtaaatgaagctatcttttcaaatgaacggg

SEQ ID NO: 11288 - DNA, 199 bp, Homo sapiens
agctgaacaaaggggacgattcactgcccaggctgcacagcgcgagatttcatcacagcgtgcaatttaaaacttacgaattgtttatttccggaattttccatgtagtattttcagaccacggttgacctcaggtaactgaaacagcgggtaaggggggacaactgtacttccaggttctgcagcctgagaatgagag

SEQ ID NO: 11289 - DNA, 312 bp, Homo sapiens
ttaacagtgcatcagcattgtacattgctcaatttttgtttgctttcatgtaataaaagaaattattgattctaatgagccatcgtattctgttcttttacttgattggtcccactttttttctaccctaacatctacttccagcagaagtgtggcttccagttgttccatggaggcaccttcagggactacttctgggaaaggcagctggagctagaacaggcagaaggggttcagctagagcagatctgacttatctgttccaaataagattttatttgaacatacagtttaaaacttactgtagtagaa

SEQ ID NO: 11290 - DNA, 237 bp, Homo sapiens
aattaacgtccattgaaaacttactgtgctcaaggcacagaacggggtagttttatacacattctcccatttggatttttcaaagacaacatctaatcatccccagagaaatttcagctgagaagacaggatgatgaagtgccctgggggccagagtccagacaagtattttggcacctccaaggactcgcagaacacagagaggaaaagagagaccctgttatctttccgcagggg

SEQ ID NO: 11291 - DNA, 380 bp, Homo sapiens
atctctgccgggtgactagctgcttcctttctctctcgcgcgcggtgtggtggcagcaggcgcaccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagaacttttgactggagagaatcacagatgtggaatatttgtcataaataaataatgaaaacct

SEQ ID NO: 11292 - DNA, 416 bp, Homo sapiens
atctctgccgggtgactagctgcttcctttctctctcgcgcgcggtgtggtggcagcaggcgcaccagcctcgaaatgcagaacgacgccggcgagttcgtggacctgtacgtgccgcggaaatgctccgctagcaatcgcatcatcggtgccaaggaccacgcatccatccagatgaacgtggccgaggttgacaaggtcacaggcaggtttaatggccagtttaaaacttatgctatctgcggggccattcgtaggatgggtgagtcagatgattccattctccgattggccaaggccgatggcatcgtctcaaagtaaggttgggggctcacatttgggcagagtgagtggactaggactgctccagaggcgtggtcttaacgttgtccttttcccctggttctaggaacttt

SEQ ID NO: 11293 - DNA, 398 bp, Homo sapiens
aagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagacggaatccttaagcatgcaaaagctttgaacagaagggttcacaaaggaaccagggttgtcttatggcatccagttaagccagagctgggaatgcctctgggtcatccacatcaggagcagaagcacttgacttgtcggtcctgctgccacggtttgggcgcccaccacgcccacgtccacctcgtcctcccctgc

SEQ ID NO: 11294 - DNA, 382 bp, Homo sapiens
  misc_feature 55: s=g or c
  misc_feature 319: r=a or g
ctctctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagatgtcctgtgtttgctgtgacgctgacgtcggaggaggargaagaggaggaggaagagcagcaggacgaaggccaccatgaccccaatacgcaaaattaaccc

SEQ ID NO: 11295 - DNA, 309 bp, Homo sapiens
  misc_feature 55: s=g or c
ctctctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacgctgggggattagtatagagaggtagagtttttttcgtgatagtg

SEQ ID NO: 11296 - DNA, 398 bp, Homo sapiens
  misc_feature 55: s=g or c
ctctctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagagga

SEQ ID NO: 11297 - DNA, 382 bp, Homo sapiens
  misc_feature 128: s=g or c
ctctctctttctcagtgaccgggtggtttgcttaggtgcggtgcggtggtgtgctttttctctagggtttgggttggatggtggcccgggccttccgagtttccatgagcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacgctgggggattagtatagagaggtagagtttttttcgtgatagtg

SEQ ID NO: 11298 - DNA, 455 bp, Homo sapiens
  misc_feature 128: s=g or c
  misc_feature 392: r=a or g
ctctctctttctcagtgaccgggtggtttgcttaggtgcggtgcggtggtgtgctttttctctagggtttgggttggatggtggcccgggccttccgagtttccatgagcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagatgtcctgtgtttgctgtgacgctgacgtcggaggaggargaagaggaggaggaagagcagcaggacgaaggccaccatgaccccaatacgcaaaattaaccc

SEQ ID NO: 11299 - DNA, 471 bp, Homo sapiens
  misc_feature 128: s=g or c
ctctctctttctcagtgaccgggtggtttgcttaggtgcggtgcggtggtgtgctttttctctagggtttgggttggatggtggcccgggccttccgagtttccatgagcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagagga

SEQ ID NO: 11300 - DNA, 531 bp, Homo sapiens
  misc_feature 2: n=a, g, c or t
  misc_feature 148: r=a or g
antattgttcggctgggctcggtcgggcgctgtctccctcggctctgcgggtgtcagttcgtccggcttcctcacagcccctcactcccggcggctgacagcagcagcgggaggaggagccgtgtgccctggcactgagcggccgcgrccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaaga

SEQ ID NO: 11301 - DNA, 141 bp, Homo sapiens
  misc_feature 130: k=g or t
agaacatgccttcagggagtgatctaaaacttccctcttttcctcctggtccctcccgcatgtctggcataagccagcaatagcaataaggagaatcctatcatcttatcccttctcctttttttttttkccctttttttt

SEQ ID NO: 11302 - DNA, 456 bp, Homo sapiens
agtctgaagatggcggcctcagcggcgaggtgctgcggcgctgcgtagaagtatcaatcagccggttgcttttgtgagaagaattccttggactgcggcgtcgaggatcatagtccacatagcacagtaactggtatgaaaacactcgatatttgctgaggatggagactgcagccaactcaacaacttctctgtccatctcaccaccaagtctggtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacactagaaggccaaaacttccgcaaacatctgatgatgaaaagaaagatttttgagactgcag

SEQ ID NO: 11303 - DNA, 187 bp, Homo sapiens
gcgcatgtgcagaagggaaacgtgaagaaggtgaagatggcggtggccagggccggggtcttgggagtccagtggctgcaaagggcatcccggaacgtgatgccgctgggcgcacggacaggtccgcgagaacgggcgagacctcagtgtgggaagggggtacctgaaatttggtgtatcgggaggg

SEQ ID NO: 11304 - DNA, 108 bp, Homo sapiens
gcgcatgtgcagaagggaaacgtgaagaaggtgaagatggcggtggccagggccggggtcttgggagtccagtggctgcaaagggcatcttcaccttttcctccgacc

SEQ ID NO: 11305 - DNA, 304 bp, Homo sapiens
  misc_feature 229: m=a or c
acctttcttaaagacatatgcaaatagccagacagaacacatggcactgacctatggccagggactcacagttttgtgagaatacgggagcggtcgtgtcctttgttcatcttcaatcatttgagcaatagtcttttcatattcagctacaattttcctcatctccaaaacttcttgccgggtctcttcgtatttcttcttccattcatttgcttcaatctctttagtmattatctctgtttctccaggattggttcttcatgccttatttggttcatttggtgaggttatgttttcttagatg

SEQ ID NO: 11306 - DNA, 448 bp, Homo sapiens
  misc_feature 157: n=a, g, c or t
  misc_feature 443: n=a, g, c or t
ttccggaacttcaactttttctttttgttttacataaacatttaagcagctaggaacttttagttttaattaggtcagttgaagttctctggtgaactaaaaaatctacattttggttggggataaagatttgattttaaaaacaagctttgaattnaaagcaaaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattcaagggtactactatagatattacaatgatgctgtttactaagtgataaccccgtatcttacaggactgactttgactcaataaaccactcagcctattatnggaaa

SEQ ID NO: 11307 - DNA, 165 bp, Homo sapiens
  misc_feature 138: m=a or c
acctcaccacgcccccatctccgtccgtgtacacacactcacacaaggacgccaaccccacctagatgcaaagcaggattcaaaagaacatctttgcgttttctaccggctccccatcatcgtactagggaggaagamgcggtagagacggggtttcaccgtggt

SEQ ID NO: 11308 - DNA, 304 bp, Homo sapiens
gctcctatgcgataaacctatacagcatgtaactgtgctgaatactgtaggcaattgtaataaaatggtatttgtatatctaaacacagaaaaggtagagtaaaaatatggtataaaaatataaaatggcacacttgtatagggcacccttaccatgaatggagcttgcaggactgaaagctgctctggggttgttagtggacatcatccgagcaaaacttgaaaagtgcttatatgactgggcttacctgtacatgttcctgcttttacatgagaggcacatgcctccaatataaccactggt

SEQ ID NO: 11309 - DNA, 441 bp, Homo sapiens
  misc_feature 265: s=g or c
agctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatstggcctgtacaggtgaggtatttctgggaccctgacctgggatccttctgtcagagatcttctggaacttgggatgacttggactatgattgataatatttaattaagcacgaagtcagttcaacctcaataaatgattaaccttatatacactataatatcatgaagttgttctt

SEQ ID NO: 11310 - DNA, 415 bp, Homo sapiens
  misc_feature 4: n=a, g, c or t
  misc_feature 236: m=a or c
ttgntgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatcmccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcc

SEQ ID NO: 11311 - DNA, 323 bp, Homo sapiens
atacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattggggtttggggtggggg

SEQ ID NO: 11312 - DNA, 302 bp, Homo sapiens
ttcatattctctcaggaactttaatgttcccgactcgggtgattccagctgtgttgctggcagtgttgtctcaaccctctccctaaaatgactgagccctgggttcatctaatgtggttttccttaggaagagatagaaggcacagaagatcacagctagagaattgagaattaactatactactagccattttagggcaccaaaacttgggattaaacacttcctacttcccactcccaactcctgaaatgaagtcttgctatctgtgactagttttatttttgtgcttttaatagtccga

SEQ ID NO: 11313 - DNA, 415 bp, Homo sapiens
gcctccttcacttgctgtgagtcccttatcacaactgatcactccgtggggtcaccgctgctctggcgtctacctcccccaacaggttggggtttctaggagggcagctccagaggttgcagaacactccgctgcctctccagagccaggcacacagcaggcgctccataaatgttcgttgggtaagtgctgaatcccaggttccctacctgaaaacttggtggcttcttaagggtgtggtctaagtcccagaggaaaatggccaaatcttaattcctgtttttcttttcttataatggggacactgaggcccagtgaagtcaaagggtggctgcccggggtcatgtagtccctgtgtggcttcaaacttgggcttctgctgtccccgacgcctgtgtcctactcctgatgacac

SEQ ID NO: 11314 - DNA, 316 bp, Homo sapiens
ttcctgacttccttcctggtgtctcaactcggccaccacagcctggtttcgctttgattgacacgcgtcaatctatagttgtggatgacagtgttcgggagagcccaggaactgtcaaaacttggttctctgcagtcctgaaggcactctgtctctttcggtcactccatctgacgattggtgcctgaaatacacctacggtttctggtcagcgtttatcagtggttggaagaacagaacccctaggaaccctgctgtcagcacgcagagtgtaaagtctcagatcaaggattcggagaaaggtctctacaggtcc

SEQ ID NO: 11315 - DNA, 417 bp, Homo sapiens
tgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagt

SEQ ID NO: 11316 - DNA, 479 bp, Homo sapiens
aaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaa

SEQ ID NO: 11317 - DNA, 242 bp, Homo sapiens
  misc_feature 4: w=a or t
agawaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaattttttt

SEQ ID NO: 11318 - DNA, 256 bp, Homo sapiens
  misc_feature 98: k=g or t
ttagaggtagggaaaagatgaatgtcagacatttgaagaactatagtaaaatgataaacactaaatatacttgagaaaactttcttaatatgccaatkaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgc

SEQ ID NO: 11319 - DNA, 522 bp, Homo sapiens
  misc_feature 367: r=a or g
  misc_feature 368: w=a or t
  misc_feature 384: k=g or t
  misc_feature 385: n=a, g, c or t
ttttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttactaaatttttrwtcttaaaataaagackntttcacactggcacagattactcagcaaaagatagcaaaacgggtggttgaagataattcattttaatcgtaatgtattttagtgtgaatttaaaaatttcatacatcaaatctatgatctcccttatattcttatg

SEQ ID NO: 11320 - DNA, 440 bp, Homo sapiens
  misc_feature 65: r=a or g
  misc_feature 123: y=c or t
accgcccgccccactcccaccctaagtgctgcagactcttccctgaagctgccggctgaggccgragctgccgcctccatgagaggcttcctcctacaccccagggccagaggaccctttgcyaccagagtgagatcctagagaccatcatcctggtaaatcccagtgcagacagcatcagctctgaggttcatcatcttcttagcagctcatcagcttataaactactaatcttgagtgggcaaagtttagagcctgggggagacctcatcctacagagtggcacctactcatatgaaaactttgcccaggtccttcacaaccccgagatttcccaattgctcagcaatagagaccctgggatacaggccttccttaccgtgtcctgcttaggggaaggtgattggagccacctgggattatccagttcccaagagacc

SEQ ID NO: 11321 - DNA, 429 bp, Homo sapiens
  misc_feature 41: y=c or t
  misc_feature 42: y=c or t
  misc_feature 54: k=g or t
tctgtgggatacttagttttctaatgtgccattatctattyytattctgcagtkatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctggtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatg

SEQ ID NO: 11322 - DNA, 318 bp, Homo sapiens
  misc_feature 16: r=a or g
agtccgagctgggagragttcactccgatcagctgatcccaactgacaacaggagaggaggaagcccgggaggcaacgaaggaggagggtggcggagatggagatgaggatggatctgccggtgtcctgaggaatagcctctgcccccactggcgccctgcggccccccgacgccgccttgctgcggccgagcttctcagtggtatcccctgaaatactgacttcaggtcgaattatattgaaaagctcctgaccactttctttcattaccaaaactttgtagctgatgtccaaccgatgaacccaccaccgtgaacc

SEQ ID NO: 11323 - DNA, 163 bp, Homo sapiens
ttagttgataatgggttaataggaaaacttttacttaggaagacctacttcaaaataacctagatgctcgtctataccagcggacccagatcctcttcatctggcaaatacctacccatcatccatgacttagcacagatgccagggcctaaactgctttacc

SEQ ID NO: 11324 - DNA, 405 bp, Homo sapiens
  misc_feature 326: w=a or t
cttttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgwgttcaagaaaacatgaacagaagcaaatgatgaaaatgagcattttacttgatgttgataacatcacaataaattatgg

SEQ ID NO: 11325 - DNA, 465 bp, Homo sapiens
  misc_feature 324: s=g or c
tgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgttsgttaaactttttctgtggcaccttggccacatgcctgcaggcatttgttttcagaacagtctcaccaattacaacacaccgtgttttagtagaagtgttgtggttttagttggtgctttcagaactgctgcctaggaaact

SEQ ID NO: 11326 - DNA, 235 bp, Homo sapiens
ctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacaga

SEQ ID NO: 11327 - DNA, 329 bp, Homo sapiens
ttcccagcattactgatcagttctcctagctataaaatttaaaagaaactatagctttaaccatgtttctaacttatactaacaaaccatggcacagtgtgtagtaaattcctcttataattccaactaatttgccattgtaaataagtaaatatttggcttttcaaataatttcatagcagctgggcttatctgtagaatcctagcttttcttcactcttgattctaggctgttccaggaagaaaataattagggattaatacctaaaataattctccttctcaataatgcccctaaaagggacctaattttattttgactgctaact

SEQ ID NO: 11328 - DNA, 630 bp, Homo sapiens
  misc_feature 397: y=c or t
  misc_feature 405: r=a or g
attgattatctttaagttgatccatagtatattcaacagtctcatgagaacataatttttgttgatgatttgtccaaagtttctatcaatccatcttagcagcagagccaagtgttagagttattgctgcctgagttataacagctgccctgggaatcttgtctgaacaacaagttaactgctgttcccagttatatctggtctttcccacccccaaacatacacaaaagatttttgtcattcttggcactggacaacagaagtgataagacatgccagcagaactctaaaggcagaatgtccttccacctgttttatgctgtaagacaaacttccaagtgcgaggcagtgtggagggctgttgccttgaatggcagctgaatgcaccagcgggatyctttggcrgcaatgcccaggcactgaagtcgggcattcaggagagctaaatggagaaaagaaacttgagcaaactgcttcctggaacactgagaacctgaatgggaaattaagaagaaccagattctttctattcttccaccagccaaggtgatgagcacaaaaggatccatcttatacagtgcttgccagcttccataatactactcaccacgatgttgaaatcacctgttc

SEQ ID NO: 11329 - DNA, 241 bp, Homo sapiens
tctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataactttatatttacacacatacgtgctacc

SEQ ID NO: 11330 - DNA, 358 bp, Homo sapiens
cttccgccacggccgtctctggagagcagcaggtaagtggtttcccgcactgccggtatccgccgccatccggactcccgggtcctctgtgcaggttggaggatggttggttgtggcgagcgaggctgaaggagccgggacgcggggctctgggcctcgggaactgagccggtactcacctccgccccttctccccgtcgctgtccgcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtgg

SEQ ID NO: 11331 - DNA, 392 bp, Homo sapiens
  misc_feature 7: s=g or c
gaggcgscggaagtgtaaccagctgggagccagccggcaggacgctgtgagttggcgtgctagtgggatggcagatgaggaagaagaccccacgtgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccat

SEQ ID NO: 11332 - DNA, 182 bp, Homo sapiens
  misc_feature 7: s=g or c
  misc_feature 15: n=a, g, c or t
  misc_feature 16: n=a, g, c or t
gaggcgscggaagtnntgtaaccagctgggagccagccggcaggacgctgtgagttggcgtgctagtgggatggcagatgaggaagcgggaggagctgagcaacgtactggccgccatgaggaaagctgctgccaagaaagactgagcccctcccctgccctctccctgaaataaagaacag

SEQ ID NO: 11333 - DNA, 105 bp, Homo sapiens
atggaaaagtattccagaggatacagagtagatttttagtcatcagaacagtagctgaattttaagatatgttcataaaagaaagcagagagtggttgagagttc

SEQ ID NO: 11334 - DNA, 230 bp, Homo sapiens
  misc_feature 18: n=a, g, c or t
aggaggggccgtcagggngggatacagcctggaaggtgcgtgtggggctgggtctcggagtgggagacgtggagtgcaggtaatgcatgtccatggtacacaaattcacaaggtttgtaaatgagaaaagacgtgaggttccttttgttctttacctgtggcctccctgccctacacggggactctagggtggaatgtagcaaagcccatccaccagccatgtactaccc

SEQ ID NO: 11335 - DNA, 205 bp, Homo sapiens
  misc_feature 18: w=a or t
  misc_feature 19: r=a or g
  misc_feature 166: w=a or t
agaagggctgttaaaaawrtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctwaatgggatcatatgaagttagccatgtctgtatgccccc

SEQ ID NO: 11336 - DNA, 453 bp, Homo sapiens
  misc_feature 12: m=a or c
  misc_feature 398: n=a, g, c or t
tattctttcacmagagagctctttaaactttttgggaaaaaactagttagaacacccaaaggctacaagtttccctgcaataatccctgattgttgtaaaccttacccctgctgtcaactcatttctttgttgagtctacttttgtgatgctgagataatatgtgaaacctgctatccgttttgaagttttaatcaagatggggaggtccacacttctaagtacaagttaaacaacctcagtctccagttgtttcaattaatcctacaagtatatgagtatttactctgcgggttcttataccagacacagtgggagatcatgaagaagtattttacagtctccaatctcaaagcatttacactctatttgtgacaagactcgtagttcccacatganagcatagttcccacagacaacaatgggcaatcctggtaggtacagtgtgtctgca

SEQ ID NO: 11337 - DNA, 444 bp, Homo sapiens
  misc_feature 351: w=a or t
  misc_feature 352: w=a or t
ggtatttaggaaggtggctttgaaactcgcagggctgcttaaacaagagctacagctattgaacaaactgctaccattttagcttcaacacaggaatgaggcagtgttgccagacgccattttaagaatcctgcataaatagcttagctaccgatgactctgcctgttttagcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcagacacatcaacaagccccattaaaaagawwaagaaacctggcttactgaacagtaacaataaggagcagtcagaactaagacatggtccgttttactatatgaagcagcgactcaccacaga

SEQ ID NO: 11338 - DNA, 381 bp, Homo sapiens
attttagcttctcttatgatttgctcctgagcctggtgatatggtttgtatttgtgtccccaaccaaatctcacattcaattgttatccccaatgttggagatggggccctgtggcaggggactagattatcgagttgaatttctcatgaatagtttagtaccatccccttggtactgttctcacaatagcgagtgagtgctctcaagatctggtcatttaaaagtgtggcatctcacatgtacacacaaacatataccatatatagcaacatttgcagtccaaaagaaatataaagaacagtagagatgcaatgttaaatcataactgcataaaattaactgtagtatatactgtactactgtaacaattttgtagccac

SEQ ID NO: 11339 - DNA, 130 bp, Homo sapiens
aatacctttcttataatcccctgtcattttctttcatctatagtgttatcaaaatgttattataacatgaagacatacaaaattttcttcttggcattgaaaagaaatgctactaagtggtttcatgaag

SEQ ID NO: 11340 - DNA, 188 bp, Homo sapiens
acttagagcgccgaacagctctgggccaaaggaccatgagagggccggagccgggtccccaaccgacgatggagggagacgtgctggacacactggaggcgctggggtataaaggaccattgtagaagagcaagcccttacaaaggcggcagagggtggatagaagcctgaaccaaatcagagcaggg

SEQ ID NO: 11341 - DNA, 489 bp, Homo sapiens
  misc_feature 251: s=g or c
gtcgccaggtcgtgccagcatccgccggacgccggaagtggttctccgcccctgccactgggccatggagactgtggcacagtagactgtagtgtgaggctcgcgggggcagtggccatggaggccgtgctgaacgagctggtgtctgtggaggacctgctgaagtttgaaaagaaatttcagtctgagaaggcagcaggctcggtgtccaagagcacgcagtttgagtacgcctggtgcctggtgcggasaagtacaatgatgacatccgtaaaggcatcgtgctgctcgaggagctgctgcccaaagggagcaaggaggaacagcgggattacgtcttctacctggccgtggggaactaccggctcaaggaatacgagaaggccttaaagtacgtccgcgggttgctgcagacagagccccagaacaaccaggccaaggaactgagcggctcattgacaaggccatgaagaaagatggactcgtggg

SEQ ID NO: 11342 - DNA, 380 bp, Homo sapiens
tagggataataatatctacctcataggattattgtgagaattaaattaacttcactatagtagaaaatatcaactaccatccttttctctacttcccttgcccctcattaaagactaatacaagttagcatttcagatgtgtagatcattctttattccagttaaaagaacaaactttatctcatcagttctgaaactttaagatgcagtagcatcacctaaagtgcttttaaaatgcagattctcaggcctcaaccgtacaccacccccccacacacgtactaaatcaagaatatgtgcagaaggtactgggaatctacttgttaatatgtgctccaaatgattctgatgtaggtaattagccagccacactttgagaa

SEQ ID NO: 11343 - DNA, 345 bp, Homo sapiens
  misc_feature 245: k=g or t
  misc_feature 248: m=a or c
  misc_feature 251: r=a or g
  misc_feature 253: r=a or g
cacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggccttacakgamccrgrgaaagctggaccatgaggtgaagaccctacaggtccaggctgcccaatttgccactgcactggaatatgtctacaaagggcagctgcagtct

SEQ ID NO: 11344 - DNA, 192 bp, Homo sapiens
tcaagctggagaagttgatttgctggtcagttgcagggagatgctggtttaaatcgtgggtagatgagaactagggagagagagtaaagagaaaaggttgaaggggtgaaagtgagtcttggggaatactcatgtttgagaggtgggaggaggaaatagagaagacaaaagaacagccaggtgggtagaaca

SEQ ID NO: 11345 - DNA, 456 bp, Homo sapiens
  misc_feature 140: n=a, g, c or t
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaagccncgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggcttaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 11346 - DNA, 412 bp, Homo sapiens
  misc_feature 137: s=g or c
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaasgccgcaagttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccggaggcgagcacgtcggtactgatgtgctagggtagttcagaccccctgctccgggcaggcgcggctggacggacccccaccctgggttcttaaaacatgaggggaaggcgt

SEQ ID NO: 11347 - DNA, 382 bp, Homo sapiens
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaacgccgcaagttcctggagacggtggagttgcagatcagcttgaagaactatgatccccagaaggacaagcgcttctcgggcaccgtcaggcttaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgg

SEQ ID NO: 11348 - DNA, 486 bp, Homo sapiens
  misc_feature 140: n=a, g, c or t
attttttttgagcgcatgcgcaagacatgctagtctcttttccggttagcgcggcgtgagaagccatgagcagcaaagtctctcgcgacaccctgtacgaggcggtgcgggaagtcctgcacgggaaccagcgcaagccncgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccggaggcgagcacgtcggtactgatgtgctagggtagttcagaccccctgctccgggcaggcgcggctggacggacccccaccctgggttcttaaaacatgaggggaaggcgt

SEQ ID NO: 11349 - DNA, 533 bp, Homo sapiens
agtgagcggagaagctttcttccggcgggaagggccccggaggcgggcacttggggggaaagttgagacgtgattaccgggttgggcgggccccatctgggaggggtttgtgggtgaactcggggtccaccgcccgctgaggagatggatgaggatgggcttcctctcatggggtcaggcatagacctgaccaagacaggatctcactttgtcacccatgctggagtgtagtggagtgaacttagctcactgcagcctagacctcctgcctcagcgccccaagtagctggaactacagaaactggcagacctttcacttcgtatccaacaaattgaaacaactctcaatattttagatgcaaagttgtcatctatcccaggcctagatgatgtcacagttgaagtatctcctttaaatgtcaccagtgtcacaaatggagcacatcctgaagccacttcagagcaaccacagcagaacagtacacgagactctggactacaggaaagtgaagtatcagcagaaaatatcttaa

SEQ ID NO: 11350 - DNA, 651 bp, Homo sapiens
  misc_feature 483: n=a, g, c or t
agtgagcggagaagctttcttccggcgggaagggccccggaggcgggcacttggggggaaagttgagacgtgattaccgggttgggcgggccccatctgggaggggtttgtgggtgaactcggggtccaccgcccgctgaggagatggatgaggacgggcttcctctcatggggtcaggcatagacctgaccaaggtgccagctattcaacagaaaagaacggtggcttttctaaaccaatttgtggtgcacactgtacagttcctcaaccgcttttctacagtttgtgaggagacggggtcttgctgtatcaccgaggctggagtgcagtggcgtgatcacagctcagggcaacctcaacttcctgggctcaagtgatcctcccacctcagcctccctagaagcttggactatagaaactggcagacctttcacttcgtatccaacaaattgaaacaactctcaatattttagatgcaaagntgtcatctatcccaggcctagatgatgtcacagttgaagtatctcctttaaatgtcaccagtgtcacaaatggagcacatcctgaagccacttcagagcaaccacagcagaacagtacacgagactctggactacaggaaagtgaagtatcagcagaaaatatcttaa

SEQ ID NO: 11351 - DNA, 209 bp, Homo sapiens
gtggggtgtttgtcgcagcggccgaggagggaagacggcagtttggcgacatttctcggccgaaggccatttgcttttgcggagatgcggcattccaaaagaactcactgtcctgattgggatagcagagaaagctggggacatgaaagctatcgtggaagtcacaagcggaagaggagatctcatagtagcacacaagagaacaggca

SEQ ID NO: 11352 - DNA, 212 bp, Homo sapiens
  misc_feature 130: s=g or c
tatcaggtgccactgaactgaaggggtgaactagaggagaagagggtgactgggcggggagcagctgcgggagaagcaaagggacgactgagggaataatcaggagaccactgaggcgtgaagtactagscgtgcgataactgaaggagttagtaactgggagcacagagttggaaacagcttaggggaagatggagaaggaagaaacgggg

SEQ ID NO: 11353 - DNA, 154 bp, Homo sapiens
  misc_feature 21: n=a, g, c or t
  misc_feature 22: s=g or c
gtggggacgcgcccagcgganstaatcagattacctggctggtgtttgcttgttctggagtgatcttctgactggaaaagaactctaagacaccatcaagacaaagtcattccagttcatctcctcatcctaaagtgaaatctggaacaccacc

SEQ ID NO: 11354 - DNA, 293 bp, Homo sapiens
ataagtcaccatggtaacggtcgcttcagttgtttttcaggaacctggggcaactcctgtccagtttaaaccggttgagactaccgacctttcaactggacccacgcaagtgcccaagaggtggccaaaaactccaccctcaaatcatactaacggcgccattttctgtacattatgtccaatgcaataccatgaacttttgcgcagaacgaacctgttacttcattttccctaactgccaatcacttttccccacaccttagaccaccccacttccctaactcgtaattatc

SEQ ID NO: 11355 - DNA, 338 bp, Homo sapiens
ggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggcttttccccacctttcccccttttctattccacaaaa

SEQ ID NO: 11356 - DNA, 463 bp, Homo sapiens
ggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggaagtactagccggacatcatgagtggctgtcgggtattcatcgggagactaaatccagcggccagggagaaggacgtggaaagattcttcaagggatatggacggataagagatattgatctgaaaagaggcttttccccacctttcccccttttctattccacaaaa

SEQ ID NO: 11357 - DNA, 257 bp, Homo sapiens
agtggttgtgtacggtccgcagcggcaggtgaagtctagcagaggacgcggccaggcgattcggtgaagcgattcctgcaggcgttggttcccctctttgacctggtacaaagaattttacgtgaaagattttgtcgtcagagtccacatagtaacctatttggagtgcaagtacaatacaaacacttaagtgagctgctgaaaagaactgctctccatggagagagtaactctgtccttattatcggaccccgagg

SEQ ID NO: 11358 - DNA, 189 bp, Homo sapiens
gaaaagaacttcacaaggtggaaggacacattgcagtctggctctatcgcccaggctggagtgcagtggcacgatctggactcattgcaacctcggcctcccaggctcaaaccatcctcccacctcagcctctcaagtagctgggattacaggtgcacaccaccatgcccagctaattttttttttttt

SEQ ID NO: 11359 - DNA, 55 bp, Homo sapiens
ggaacctctctgctgggcccggtggccgcaaaagaactttctttctcccgccccg

SEQ ID NO: 11360 - DNA, 347 bp, Homo sapiens
ttgaataaccctcaagtaaaattcattttgaaggcaggagttggtgtcacagacgtttatctctggtaaaaatggtagaaaattccccaatgccttgtgccagtagagtatggctctgcctgaaacattctccataaggaacgcatagcttaggatgaggtggaggtgggccagggagttgctacctcactccccaccttctgtatgttctgcagtcaagaaaatagcagctcattaaaagaagacataatcatgccgtggattacttgtggttccagaaagctttcttaagctttcattctagactccagatcttgagtaggtaatgttacaacacttagtcacgg

SEQ ID NO: 11361 - DNA, 170 bp, Homo sapiens
tattttagtaaatagcacattttaaaaggtatggaagatacaagtgaaaagaagacggaaagcttgcctgtaattagatcacccagataccactcccacaagaaaatccccaagacacatattttgaaaatgaagatatttaagttattttgatataacaaatggataga

SEQ ID NO: 11362 - DNA, 222 bp, Homo sapiens
tcgggatgttttcggttgtttgaccgagagagttgtaggcgcaaagctgaggaaaggagagtgtggagaggggcctggtgtggtggggcccggtgtttgggaccggagggtgttgacggctgagagttccttgggtttgctctttcttcacctgaaaagaagactccaggaagggcagcacatgccggagaaagatgaattccagcttgaccgcccagaggc

SEQ ID NO: 11363 - DNA, 122 bp, Homo sapiens
aatttatccataaagagcaaaatagtttatcactactagaagcaagagaagcagacggtgatgtggttaatgaaaagaagagaactccaaatgaaaccacacagttttagaaccaaaaaaag

SEQ ID NO: 11364 - DNA, 374 bp, Homo sapiens
ctcagtccatcaggggggggagggggtggcgcgcgcgccatttctagtcgttttcaaagcgcctcgcgctgattctcacgggcccggctgccggcccccgctctgccctggattggtagcttatgtcgatcttgatgaaagagcaattgatgctctcagggaatttaatgaagaaggagctctgtctgtactacagcagttcaaggaaagtgacttatcacatgttcagaacaaaagtgcatttttatgtggagttatgaagacctacaggcagagagagaaacaggggagcaaggtgcaagagtccacaaagggacctgatgaagcgaagatcaaggccttgcttgagagaactggttatactctggatgtaa

SEQ ID NO: 11365 - DNA, 355 bp, Homo sapiens
ctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggcatggtcgtggagtggacctctagcaaactccaacagacctgcagctgagggtcctgtctgttagaaggaaaactaacaaacagaaaggacatccacaccaaaaatccatctgtacatcaccatcatcaaagaccaaaagtagataaaaccacaaagatggggaaaaaacaggcagagaaaactgaaaacaacaagtaaaagaaaccaatattccgct

SEQ ID NO: 11366 - DNA, 137 bp, Homo sapiens
cagaggagggagaagctgcaaaaaactcctgtcggggtgtgggagcgggcatatttgtgactgtgctgtgagaagagtggcctgccgggcagcacgatgccagctgagctcgtgccgaatccacaatgagaccgggt

SEQ ID NO: 11367 - DNA, 215 bp, Homo sapiens
tttttcatttctcacaaggactgggtgaagagttctgcagccttacagagactggaaaagaagcccaaaccaaggcccccagagaggtcccccaggcccctttgggtccctgagcctcagctggagatccggcgcaggagaccaacgcctgccatgctgttccggctctcagagcactcctcaccagaggaggaagcctccccccaccagagagc

SEQ ID NO: 11368 - DNA, 241 bp, Homo sapiens
tacggagaaaagaagccgtggccacgggaggaggcgagaggagtcgggatctgcgctgcagccaccgccgcggttgatactactttgaccttccgagtgcagtgacagtgatgtgtgttctgaaattgtgaaccatgagtctagtacttaatgatctgcttatctgctgccgtcaactagaacatgatagagctacagaacgaaagaaagaagttgagaaatttaagcgcctgattcgaga

SEQ ID NO: 11369 - DNA, 113 bp, Homo sapiens
ggacatttagccaatgccaccacggacctcatgaaactggaccatgaagaggagccccagctctccgagccctacctttctaaacaaaagaagctcatggtgagtacctcccg

SEQ ID NO: 11370 - DNA, 223 bp, Homo sapiens
  misc_feature 107: k=g or t
gcgacaatcggggggcatcctgcggcgaggggaccctgtggggcttgggacgagagacgggggtctttccgtgggaaccgagctaggtgccgggcaagagacgcgckgctggcccacctggatcctggccaactcgggattgagttcgttcctggtctcagaaggcccgttttgctttcagggaggagcttgtgaagtaaggaaatggcacctcgaaagggga

SEQ ID NO: 11371 - DNA, 338 bp, Homo sapiens
  misc_feature 293: m=a or c
  misc_feature 313: s=g or c
ctctctttccggtgtggagtctggagacgacgtgcagaaatggcacctcgaaaggggaaggaaaagaaggaagaacaggtcatcagcctcggacctcaggtggctgaaggagagaatgtatttggtgtctgccatatctttgcatccttcaatgacacttttgtccatgtcactgatctttctggcaaggaaaccatctgccgtgtgactggtgggatgaaggtaaaggcagaccgagatgaatcctcaccatatgctgctatgttggcttgcaggatggctgagtgggtggmaaatagataaatatggatgsatgggtggatattaatgaatctgca

SEQ ID NO: 11372 - DNA, 230 bp, Homo sapiens
ctctctttccggtgtggagtctggagacgacgtgcagaaatggcacctcgaaaggggaaggaaaagaaggaagaacaggtcatcagcctcggacctcaggtgctgcctccaaggccccgaaacagagagtgctactgcgaacaaatcaacctcttccactccactgctgcttttggtgccccataacgacgaccccctctcagcaggaagtagccagaaagattacgacc

SEQ ID NO: 11373 - DNA, 466 bp, Homo sapiens
gtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaagagacatgaaagccggtatcagaaccatagtagcaagtcttctggtagaagtg

SEQ ID NO: 11374 - DNA, 213 bp, Homo sapiens
  misc_feature 144: r=a or g
  misc_feature 146: r=a or g
gtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgrtragacgcaggagggagcggactaggtgacagggccgttcctgtgagcctcgcgggcgcctggcgatgc

SEQ ID NO: 11375 - DNA, 220 bp, Homo sapiens
aaaaacgcggacgacggaggacggggccgggcgacctgggcaccagcaggacccgaggccaggagccaggggcccagaagattgagcttctagagcctcagagatggaattcgccgttttgccgcgatttggcgttaacttattgacccatggggaggagggtcacttcccgtgaaaagaaggcagagatgttttgctgtgcccagtgtgaggaagcgaa

SEQ ID NO: 11376 - DNA, 341 bp, Homo sapiens
agatggcggccattccagctttcctaagcgtccattatctaccaggttcctcccgcacccacgttcacccgcaagagcagccgggagcgctgtggactccctagcccgaagtctcctcttggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacc

SEQ ID NO: 11377 - DNA, 106 bp, Homo sapiens
aacacatagcctaccccttccttgtactttcctccttcccctcaaccgccagacagcacccctcgacagccagaggctagctttgaaccccatccttctgtgacac

SEQ ID NO: 11378 - DNA, 542 bp, Homo sapiens
  misc_feature 477: n=a, g, c or t
acacagtgttcatcccctcaggaggatacagcttttgaggtaccatcttggaagcagagaccagacctcactagacacaaacttcctggcaccttgattttggacttcatagcctctagaactgtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtgacttctatgttttgggttgatgctgaattagggagtgatatttaccttgatggtatcataactattgtgnattcaaaatatggattaaaagtgaaataccactaaaggcagaagagaatgaaatcatcccaccca

SEQ ID NO: 11379 - DNA, 366 bp, Homo sapiens
  misc_feature 137: y=c or t
  misc_feature 147: r=a or g
gtgatgacgtcaggccccgggcaggccgggagtggcgtgctgggcgtgcgcggctgcggtacggcgtgttggtcccagcggttcagctgaggtagggacgtgctgtaggccggaatgttaccggctgttggatctgyggatgaggargaggatcctgcggaggaggattgtcctgaattggttcccattgagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactg

SEQ ID NO: 11380 - DNA, 482 bp, Homo sapiens
  misc_feature 335: r=a or g
  misc_feature 445: m=a or c
  misc_feature 458: n=a, g, c or t
atgaaagagcaatggccttggttttaccctctttgtcaggaactaactgttcattctctggtgagtcacccaaatgtcctggctcttcacctgcaaaatgagtccattggcctagatgttctctatcaactccaaaggtctaagatatgtatgataaagggtatgccatccagtgaagatcaacagtatcattcacagcaggcctgttcaataaggaggaagttgccatctcaactggaggctgtactggacaaataacattcactattctgcctccaaggtttctcatttaaccatgggagctaatatgaaaagaaggtgttcctaagccagtragattaaggtttgcaggttttagcctgcaagcaggaccaactaccaatttacaggatctagcacaaaattaaaatgtggaccttttgttcaaaaattgttcaggatttcmagacacagcagancattaacgaagcatggcacctggg

SEQ ID NO: 11381 - DNA, 85 bp, Homo sapiens
tgtgctgagcctttggtctaagtggttggttggtcccagccacttcttcaaaagaaggtttcctgaggtaaccataaattagggc

SEQ ID NO: 11382 - DNA, 236 bp, Homo sapiens
  misc_feature 144: m=a or c
  misc_feature 145: m=a or c
  misc_feature 152: k=g or t
  misc_feature 153: n=a, g, c or t
agtgcgagcgaccccgggccggctgcgtggagctggcgctgcctctcctgaagccgaggcgctaacttgagtgaagaggtctataggctttttcacttttggttatctgctcaggcgctccttggggtcgcgcaggtctcggammagggttkncaaggacttcggagctaaccagtttggagccataaccctttcgtacttgccaaaaaactctgggcaagactcttgaattttga

SEQ ID NO: 11383 - DNA, 183 bp, Homo sapiens
  misc_feature 139: r=a or g
  misc_feature 140: n=a, g, c or t
  misc_feature 148: k=g or t
  misc_feature 164: n=a, g, c or t
cacgcccatcgtggaggctccgcctggaaaagaagtccgacttcctctccaagctgctccgaggggaatggggaatcggcaggaaatgacccgaactgccagcctgcgcctttgcagccggccctcgctttgctgaagrngagcagckcccaccaaagtcttgnctccccttaccccgaaagc

SEQ ID NO: 11384 - DNA, 587 bp, Homo sapiens
  misc_feature 37: n=a, g, c or t
  misc_feature 38: m=a or c
  misc_feature 233: r=a or g
  misc_feature 356: s=g or c
  misc_feature 372: s=g or c
  misc_feature 373: s=g or c
  misc_feature 510: k=g or t
  misc_feature 543: k=g or t
  misc_feature 545: n=a, g, c or t
  misc_feature 546: s=g or c
  misc_feature 555: r=a or g
  misc_feature 569: s=g or c
acagcggggcacctcgaggagaggacgactaggagcnmacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggartcgggagagccggagagcctctgggaaagcgcaaggttgaggacctggcccccgaatcaggaaaagaataactgtgcttgaagaagaaaattcccaacatggacaaaccacgcaaagaaaatsaagaagagccgcagasscgcccaagaccgatgaggagaggcctccggtggagcactctcccgaaaagcagtcccccgaggagcagtcttcggaggagcagtcctcggaggaggagttctttcctgaggagctcttgcctgagctcctgcctgakatgctcctctcggaggagcgccctccgcagggktnstttccaggraggacctgtttgasgggcgcctcccatggagc

SEQ ID NO: 11385 - DNA, 574 bp, Homo sapiens
  misc_feature 37: n=a, g, c or t
  misc_feature 38: m=a or c
  misc_feature 343: s=g or c
  misc_feature 359: s=g or c
  misc_feature 360: s=g or c
  misc_feature 497: k=g or t
  misc_feature 530: k=g or t
  misc_feature 532: n=a, g, c or t
  misc_feature 533: s=g or c
  misc_feature 542: r=a or g
  misc_feature 556: s=g or c
acagcggggcacctcgaggagaggacgactaggagcnmacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggagtcgggagtcgggaaagcgcaaggttgaggacctggcccccgaatcaggaaaagaataactgtgcttgaagaagaaaattcccaacatggacaaaccacgcaaagaaaatsaagaagagccgcagasscgcccaagaccgatgaggagaggcctccggtggagcactctcccgaaaagcagtcccccgaggagcagtcttcggaggagcagtcctcggaggaggagttctttcctgaggagctcttgcctgagctcctgcctgakatgctcctctcggaggagcgccctccgcagggktnstttccaggraggacctgtttgasgggcgcctcccatggagc

SEQ ID NO: 11386 - DNA, 220 bp, Homo sapiens
  misc_feature 94: k=g or t
  misc_feature 113: r=a or g
  misc_feature 134: r=a or g
  misc_feature 139: s=g or c
  misc_feature 142: r=a or g
  misc_feature 148: r=a or g
ctaccctgtcttgcgtctgtgtgcaggtctgctggtcacagcggggcacctcgaggagaggacgactaggagcacacggcccggaaaggtccakaataactgtgcttgaagargaaaattcccaacatggacaraccasgcraagaaratgaagaagagccgcagagcgcgcccaagaccgatgaggagaggcctccggtggagcactctcccgaaaagc

SEQ ID NO: 11387 - DNA, 257 bp, Homo sapiens
  misc_feature 179: r=a or g
  misc_feature 185: r=a or g
cttttttttttgcctgtccaccatctccctattaccctttggtcgagagggaaagcagaagaagtctgctggtcacagcggggcacctcgaggagaggacgactaggagcacacggcccggaaaggtccagaataactgtgcttgaagaagaaaattcccaacatggacaaaccacgcraagaaratgaagaagagccgcagagcgcgcccaagaccgatgaggagaggcctccggtggagcactctcccgaaaagc

SEQ ID NO: 11388 - DNA, 270 bp, Homo sapiens
  misc_feature 146: w=a or t
  misc_feature 147: k=g or t
  misc_feature 149: m=a or c
  misc_feature 151: k=g or t
  misc_feature 189: s=g or c
  misc_feature 192: r=a or g
  misc_feature 198: r=a or g
cttttttttttgcctgtccaccatctccctattaccctttggtcgagagggaaagcagaagaagtctgctggtcacagcggggcacctcgaggagaggacgactaggagcacacggcccggaaaggtccaggtcagggaaagggawkamckgtgcttgaagaagaaaattcccaacatggacagaccasgcraagaaratgaagaagagccgcagagcgcgcccaagaccgatgaggagaggcctccggtggagcactctcccgaaaagc

SEQ ID NO: 11389 - DNA, 351 bp, Homo sapiens
ttctcaggaggcgtcacggtggggaacataggacgacagttagctatgctgatacccttctgtgaggagttgaatttgaagaccacttggctgtttcacaaaaccagaagtaattacagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgaccg

SEQ ID NO: 11390 - DNA, 414 bp, Homo sapiens
atcacagtcccgcctcttccgctgcgtgccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcac

SEQ ID NO: 11391 - DNA, 508 bp, Homo sapiens
  misc_feature 235: r=a or g
  misc_feature 468: m=a or c
  misc_feature 477: n=a, g, c or t
  misc_feature 478: n=a, g, c or t
  misc_feature 479: n=a, g, c or t
  misc_feature 480: n=a, g, c or t
agagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttraactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaaggmctgtgaagnnnntaatcctttgattcgagccttggcagtc

SEQ ID NO: 11392 - DNA, 273 bp, Homo sapiens
  misc_feature 113: r=a or g
  misc_feature 128: y=c or t
  misc_feature 200: y=c or t
  misc_feature 245: y=c or t
ttatttaaaaaaatctttttgcatgtgtgatgttatcattggcttcatttcttacccaaggtatgtctgttttgccataaatcagcagagtcatttcattctgggtgatcctracacaccattgctaygttagatttgaaatgacatctctgttaaaagaatcttctatggaaataatggtgccctgcaaaatcttcctytgaactcacaggttagggatcacacaacttacttaatcgtttgcygtttttgttttttttccttatatgtcaa

SEQ ID NO: 11393 - DNA, 329 bp, Homo sapiens
aatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgataatgggcagggaaatttcggcgctcgaggactgtgcccaggagcagatgcggctcagagccca

SEQ ID NO: 11394 - DNA, 158 bp, Homo sapiens
acaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgataatgggcag

SEQ ID NO: 11395 - DNA, 347 bp, Homo sapiens
  misc_feature 76: m=a or c
caaattttaatttaaaattatggttttcatttttgtttaccttaaagtgatgcttaaaagtggcatgtaattaggmcacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctcccc

SEQ ID NO: 11396 - DNA, 63 bp, Homo sapiens
ctgactggtatagcaggacagttaattccagggacgatatggatgaaaagacaaccctacagc

SEQ ID NO: 11397 - DNA, 311 bp, Homo sapiens
  misc_feature 260: y=c or t
caacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccagggtacgcgtgcgacgcttgatctgcttcctaagtccctaaagctcayaaactggccagaacctaaaaatcagtatctgggattcggtttatgctagag

SEQ ID NO: 11398 - DNA, 77 bp, Homo sapiens
cttttccttctggagtttccccggcgggtgccagggctcgacccacagagcaccctcagccatcgcgagtttccgga

SEQ ID NO: 11399 - DNA, 290 bp, Homo sapiens
  misc_feature 133: n=a, g, c or t
  misc_feature 136: n=a, g, c or t
cttttccttctggagtttccccggcgggtattagtccttgtggcaccaagtcagaatttcattcaaaagacaattaggaagatggttttctatggaaaatatttaagtgtaggtcttaatgtgaaagaaaganggnagagaaagaaacccctttattatgttctcccttccttaggcattttttgtcccgtgggaaaaaactgtactagggacagagacctctgttaagttttagagaaaagggatcttttttttttatttgagacagagtcttgctctgtcgcccaggc

SEQ ID NO: 11400 - DNA, 195 bp, Homo sapiens
atagaattacaaatctggagctcattttggcgtcgcagagggaagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggc

SEQ ID NO: 11401 - DNA, 217 bp, Homo sapiens
  misc_feature 133: n=a, g, c or t
cattaggaaatttcaaaagctttcacgactacacggtattctgtaaaaatattgaatggatgaaataaaataattagataaaatctctgaggttgaaattctattgacttaaagttcataattattcagagangtgttaagcaaatttgtttcattagggtgtactttaaaagacagacttttacttaagttgactgtagcttagctcttttccaat

SEQ ID NO: 11402 - DNA, 290 bp, Homo sapiens
agggctaaaagacagatgtgagcttatttgggagctaaactgggctttgaaaaaggaataatactggtagcatttaatatcaaaatttaaattttatgttaacaataagaaaaaaatggagaaaaatttttgttagggattataaaatgcctgttaaaataaaaagacttatatttactcctttgtggagctgaattggtttcggtcagacagcaatgtcaaatgcaaatcaagaaaatacatttctgaggccaaggcaggagatttcttgaccccagaaatttgcaaca

SEQ ID NO: 11403 - DNA, 103 bp, Homo sapiens
cagaagaatgtcgggccccacttccaggatttgtccacattgctgggaatgatcaagatggcctcataaagatttcctaataaaagacagcagcataacagtc

SEQ ID NO: 11404 - DNA, 225 bp, Homo sapiens
  misc_feature 124: s=g or c
tttaagatttttgtaaaaagctacaaaaaactgcagtttgatcaaatttgggtatatgcagtatgctacccacagcgtcattttgaatcatcatgtgacgctttcaacaacgttcttagtttasttatacctctctcaaatctcatttggtacagtcagaatagttattctctaagaggaaactagtgtttgttaaaaacaaaaataaaaacaaaaccacacaag

SEQ ID NO: 11405 - DNA, 421 bp, Homo sapiens
aaatcgcgccggccggctgcacgagccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaaggcataaatagcagc

SEQ ID NO: 11406 - DNA, 205 bp, Homo sapiens
agtcccgagatgaggcaagatatgctctgagattcctcactgttctctgagagagaagagctactgggcccatccaaaagacagtctgcacctggaactcggcacccaggaggtcacccctgcaaggacctgtagaggagcctgtgtcctggtggccttaggtggctgcattactggatcgagatgaccacagccacccctctgg

SEQ ID NO: 11407 - DNA, 393 bp, Homo sapiens
  misc_feature 146: n=a, g, c or t
  misc_feature 377: r=a or g
gaaactcaaccgaaagcctgcagagagcagaacatggaaggagacttctcggtgtgcaggaactgtaaaagacatgtagtctctgccaacttcaccctcatgaggcttactgcctgcggttcctggtcctgtgtccggagtgtgangagcctgtccccaaggaaaccatggaggagcactgcaagcttgagcaccagcaggtgaggaggcggcagggaggatggggtctgagagtcaaggtgagtgttcagtcctccctgcaggtgagatggggtctgagagttgggggacgagggtctagtcctccctgcaggtgagatggggtctgggagtcaaggcaagtgttcagtcctctctgcaggagagatggggtctgrgagtcaaggcgagtgt

SEQ ID NO: 11408 - DNA, 377 bp, Homo sapiens
acaagtcattactaagttgagcaaaagagtttttatctattagcagaaagggcctctctggcagcagagattaaaaactggcccaacttcatttccatacttcagggaacagcaaattgaggatttacttatctaggacttgaattccttctttgggaccaagttaataaaagaccaagaaactcctgattaaactggataatgaaggattctgtagacagggctgcacgtatcggctttgtttgacttctcttttctcagttaacatctcagagctagaacattccacattccccagcagcgtgtgggggctgactaaagtttacaattccaactaaaaatcaccctgcttctggcttatctgaatcccttaccca

SEQ ID NO: 11409 - DNA, 237 bp, Homo sapiens
gagcttcatagcatatggagtcaaaggaagcagccaaaagaccagcagggaaagagcactgggcttggagtcagaagacccagcttcccactctgactctgctgcttaccagctgggtgactgggggagccgcttcccttccctgagccttcacgccttcatccatgcagcagagctaacaatacctgcccagcaacttcaccaagtcatgaagactgagaatcatgacaagagatg

SEQ ID NO: 11410 - DNA, 402 bp, Homo sapiens
  misc_feature 103: k=g or t
  misc_feature 296: n=a, g, c or t
ggcatcttgctttttcttccccctcctcctgtgtgccccgcgccgctccctctttcccttttattcccggccccacacgccaaaatgaacagctcggacgaakagaagcagctgcagctcattaccagtctgaaggagcaagcaataggcgaatatgaagaccttagagcagagaaccagaaaacaaaggagaagtgtgacaaaattaggcaagaacgagatgaagccgttaaaaaactggaagaatttcagacacttgaactcatctttttatgactaatagttttttgattaanaatgtgaacaagaaaatactaaaataaaaatcctttcgatttagccaactctttttgctgtaggctaggaatacacctttttaaattaacacactgtagatctttt

SEQ ID NO: 11411 - DNA, 183 bp, Homo sapiens
  misc_feature 20: s=g or c
agcttccaagatggcggcasgatgcctgcccggctgttggggtggcggtgacgacaggcagcaaaagaccagctggtcccagattcgctgctggagtgctggatggagcctttctctgccctctgtgacatttccaattttagataatgcctcacatctctgtccccccgggaccccctagag

SEQ ID NO: 11412 - DNA, 246 bp, Homo sapiens
atcatcactaggctaagaaacagaatggacacagctgaaaatcaaaatcagggtctggaagaggaattccataacttgatggaacagagtgatagaaaatatggagggaaaagaccgcaatggggtaacaagatgagactagaaagagtgaaaaggagggaatagttgaagaagtgatagctgaagtgttttccagaatcaatattaaaccctaagatttcaacgatgcacttgcatgtcaaacag

SEQ ID NO: 11413 - DNA, 59 bp, Homo sapiens
tataaatatgtagaagaggaagttttaaaagaccttaagctggcattgttaaggaacac

SEQ ID NO: 11414 - DNA, 452 bp, Homo sapiens
  misc_feature 15: r=a or g
  misc_feature 69: s=g or c
aaatccactctctgrtgctcggagggaactgcatttcctatggtgccctgcgactccgcagacgcggascttttgggaaatgaagtcttttctcaaagaccttgccgctcaactggatccaggcccttgcatcttggcggatctgaggcgtttggagggacaacaacctagatgtggagccgaaatttgagggtgtgacctatcttatgcggacggacctttgaggatctctgagtggaaggtgtactacaaattcttgcaatcctcacgctcttcgtctgcggcgacagttcacctggggtgggcctgatttgttcctgactctagcaaacaaaccccgggaccggggagagctgggatgttggagcgccctgaggccaggctacttgggggcaaactgaggaaagagtgttgaggattatttctagagttcaaaggtcagaggtcaatgt

SEQ ID NO: 11415 - DNA, 290 bp, Homo sapiens
  misc_feature 112: m=a or c
  misc_feature 113: m=a or c
  misc_feature 114: m=a or c
  misc_feature 256: m=a or c
  misc_feature 283: n=a, g, c or t
gagactggagtctgtccgtcattgtggacccgagaagcagagagcgagagggggaagaggagcgtgcaagcggaaaagacgggcctcttcctccgactcccgagcgcgaggmmmtcattttgggttctcagcgaacggcggcagcggcggcggctggaacaatcactcggccaagggcgacagccaactgctagacctaaagggcaaggaaataaagtttcagtacaaaacggttcgattcatcaaaaagatgctmtaaatgatgatgattttgagccatacntaagtag

SEQ ID NO: 11416 - DNA, 347 bp, Homo sapiens
  misc_feature 207: m=a or c
  misc_feature 213: m=a or c
  misc_feature 241: m=a or c
  misc_feature 278: n=a, g, c or t
  misc_feature 288: y=c or t
  misc_feature 299: k=g or t
  misc_feature 306: y=c or t
  misc_feature 317: m=a or c
aagcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaggamcctgamctttagtaacacagctggaacaatccgmagcggcggcggcagcggcgggagaagaggtttaattnagttgatttyctgtggttgtkggttgtycgctagtctcmcggtgatggaagctgcacattttttcgaag

SEQ ID NO: 11417 - DNA, 292 bp, Homo sapiens
atagcaatttgggagagaaatctttcttctcctctcgcatctcaaactgtaaggattatgtaaacttaagctgtggcttttttcctcaaccgcatagaaaatgctgctgtcgctgctgtgctgctgcaggaaaaaggagcagagacaagctgagatgagataaataagaagaggaaggatactggctgcatccattgagcacttggatccatccctgtaacaaaagactcctgacaaatacagctgtaaagctgactagttcagtgactagcagcagcaataagaggtagac

SEQ ID NO: 11418 - DNA, 217 bp, Homo sapiens
agagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactc

SEQ ID NO: 11419 - DNA, 270 bp, Homo sapiens
tgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccc

SEQ ID NO: 11420 - DNA, 193 bp, Homo sapiens
accacagactgtcctctccacctttagcaaacatatggtttacttcattgttttgtactacagatacatccttttagcaaaagactggaattttatcctttcaacttcaagaactttggaaatgcaagctttttgttattaccaactttttgtttctcattactgaagaaaattggaggaaaatcttcatact

SEQ ID NO: 11421 - DNA, 130 bp, Homo sapiens
gcccaatttctacgcgcaccggaagacggaggtcctctttccttgcctaacgcagccatggctcgtggtcccaagaagcatctgaagcgggtggcagctcccggacgtctaaaccaaaccactttcaccg

SEQ ID NO: 11422 - DNA, 300 bp, Homo sapiens
agtttcagggatgctgatagaagacatgagactcctgggtcagacgtaaaagactgtttgctacagcaacagcagtatccagaatatcagcatttgtgctcgttctctgagccccatttctggcagggtaatgcaaagagggctagatgatccctgcacacattgtgggttgcattacattatttatgttaacatgtaatggatgtatctcttttaaataaattaatattttaaatttttctgtttttttgtttttgtttttgttttcagcactttaaagatgtcattctcgttttccag

SEQ ID NO: 11423 - DNA, 199 bp, Homo sapiens
  misc_feature 122: n=a, g, c or t
  misc_feature 126: n=a, g, c or t
  misc_feature 129: n=a, g, c or t
gggaagaggaagtggattgggtcttgtttaggtaaaagacttcagtggcagacaaaggaggagtaataagatcgctagggggcccgtgcccagcccacccacgcacaatctcagtcctcgcnatanccnacaaggagaaattctcagcctcggggaagagtatttcttgatgagggaagagcgcggggaagacactcac

SEQ ID NO: 11424 - DNA, 157 bp, Homo sapiens
agttcgcgtaggactcgagcgtggagatgaagcgtattttctcactgctagaaaagacttggcttggcgcaccaatacagtttgcctggcaaaaaacatcaggaaactaccttgcagtaacaggtaactgtgttgccatggattgggataaagatgg

SEQ ID NO: 11425 - DNA, 206 bp, Homo sapiens
aaaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttac

SEQ ID NO: 11426 - DNA, 270 bp, Homo sapiens
  misc_feature 64: n=a, g, c or t
agatggcgaccgtgtgggatgaggccgaggtgggcaccgggcgagctggcggtccgggaaccgnggccccgcaggagacgccattgacaagagggaaggaggtggctgggggtcaagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaac

SEQ ID NO: 11427 - DNA, 231 bp, Homo sapiens
agaagaaggagagaggggagaagaggcaggagctggaaaggagagagggaggaggaggaggagatgcgggatggagacctggagttaggtggcttgggagagcttaatgaaaagagaacggagaggaggtgtgggttaggaaccaagaggtagccctgggggcagcagaaggctgagaggagtaggaagatcaggagctagagggagactggagggttccgggaaaagagc

SEQ ID NO: 11428 - DNA, 348 bp, Homo sapiens
ccacctacaaaacctacacaatggaaaagccaaacaaaagaaaataaagttggaacttctttccctcatgagtccacatttggcgttggcaactttaatgcttttaaatcaactgccaagaactttagtccatctacaaattcagtgaaagagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggatgacgactcatttaatttacataac

SEQ ID NO: 11429 - DNA, 159 bp, Homo sapiens
ctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctgg

SEQ ID NO: 11430 - DNA, 191 bp, Homo sapiens
gaaaactgcgacagactcgcagcctgccctgaattttcttcacacagcctgggggcatccgaatgcacgggagatgttttacactcagatgaaacaaactgtttagacctcggggaaaagagactgtgcttgaacaaaatgaaccaggagaaagcgccctcctgagacatgtctctgctttcatgtttgaa

SEQ ID NO: 11431 - DNA, 377 bp, Homo sapiens
agtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaagtgagtaattgaaatattcttctgttgctaagcagaataatactct

SEQ ID NO: 11432 - DNA, 430 bp, Homo sapiens
  misc_feature 415: r=a or g
ttttttccctcccttggcccagctttctcaggtttgctttttaattccctcggtttcctgttccggaggcgcgggcggtgccactgtcttggtacctgcggtagtagcctggctttgctctgacggcgatctcgcggcccgagagccttttatagacagctccttcagtgtctctgtttccaaaccgcaaccgagaagagacagacggagaaaagagagttacttttccaggttgcttttcccggggatgtgaaggatacagaaatgactgtgaatcaacccatatcatcaaggagctgataatctagtggaagagttagacgtgtgcatacttcactatgatatgaggcagtctctgagcttatattctctgtggaagatgtgacatatccaggcggaacatcatgatgcaggraacacatgtcacaga

SEQ ID NO: 11433 - DNA, 153 bp, Homo sapiens
  misc_feature 3: n=a, g, c or t
  misc_feature 14: r=a or g
  misc_feature 28: r=a or g
ccnaggttatagarcttttaaaagagartcagatatttgaacccaggtgacctggcttcgtaattaatattcttaaccactacatctcttacttcctagagttgtagtactccttctattacactacaacagtgaatgtaaaattcagttgga

SEQ ID NO: 11434 - DNA, 288 bp, Homo sapiens
agatggagctctggatgtcactactggagagaaggcctctgatttttgggattttaaactaaaatgatcttcatttattaggccagttaattcattatgcaaaagagatataatatttaatctttgctttttttctggtaattgtatgtttcatctttctcttatattaaatactttctatagtgcttaaattatattgttatctctttgtttttttatgtatttatttttgagacagactcttcctttgttgcccaggctggagtgtcttggctcactgcaacccct

SEQ ID NO: 11435 - DNA, 388 bp, Homo sapiens
aagcgcggaggaccagggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggccccccaccagaaggtggacttaggtggacagtttcataaagcataacatgagtagaagaatctactgccaataactgtttattatctgcaatcaagtgg

SEQ ID NO: 11436 - DNA, 566 bp, Homo sapiens
cacacacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggaggctggggtacgctggagaaggaatgggcttcataaccttgagccctcttccctgaagatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatcaagagctgactatgcctgcattgctgagaacaaacccac

SEQ ID NO: 11437 - DNA, 569 bp, Homo sapiens
  misc_feature 13: s=g or c
  misc_feature 14: s=g or c
  misc_feature 71: n=a, g, c or t
  misc_feature 72: k=g or t
agaggaggggccssaatgtctgaggtggcaacacttctcttcagccagacagcactggccagtttggagtnkgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggaggctggggtacgctggagaaggaatgggcttcataaccttgagccctcttccctgaagatatatgtatctacgggggcctggggctgggcgggctcctgcttctggcagtggtccttctgtccgcctgcctgtgttggctgcatcgaagagtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatcaagagctgactatgcctgcattgctgagaacaaacccac

SEQ ID NO: 11438 - DNA, 836 bp, Homo sapiens
  misc_feature 7: n=a, g, c or t
  misc_feature 8: s=g or c
  misc_feature 346: s=g or c
  misc_feature 359: n=a, g, c or t
  misc_feature 360: w=a or t
  misc_feature 539: r=a or g
aggaagnsggcgggaccggacttccggctggtctgtggggtttcgggttcggggtttcctggtgggcgtcaggggcaggcaacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttascagtacatgcttnwtaatgggacctgtgaagcaactgaagaaaatgtttgaagcaacaagattgcttgcaacaattgttatgcttttgtgtttcgtatttaccctgtgtgctgctctttggtggcataagaagggactggctgtgttattctgcatattgcagttcttgtcaatgacctggtatagcctgtcrtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcact

SEQ ID NO: 11439 - DNA, 327 bp, Homo sapiens
  misc_feature 140: r=a or g
  misc_feature 147: r=a or g
  misc_feature 229: r=a or g
cttttacgtcggccttcgcgagcgtctgggcgggtggtaggtgagtgggtattgcgggctagtatccgagcaaaagatggtggcgcaggccgagttaagagctttaatcctgtgaagacatcttagtgaagagtttagartgctgaragttgaaagcttgcacgtgggaaacgtgcggccggactgccacatgtactgaggttgagtcgtgacggccacaggctccgarttttggcgtgaggaaccgctgatcggccacgggcgccgaacttgctggcctccggcatgtgcctgagcggcggcggaaaaaccaccttaattggggcg

SEQ ID NO: 11440 - DNA, 400 bp, Homo sapiens
gtggattactacgcacccggtggttggctgggccggcttgcaagcggcgggggaccttggtctcaggaatccgtgccggggcgtatccttattcacccccgtgacattacacgctggggaccgaactcagtccgagatgtagactaggcaataacgctaatctaatcccggtacgattaaccccactcagcccgccctggcttaatgtccgctggtggtgtttggagacctcgagcatttaaatgaagcgctcacaaacaagagcacaggttgctttgggatcataaaagagcaggagagaaaggcttctgggggctctcggaagatggatgtcaacgcagagttttcaaggctgagtacgggttagccaggagaaagaagagaaggtggagagagcaac

SEQ ID NO: 11441 - DNA, 395 bp, Homo sapiens
  misc_feature 265: w=a or t
  misc_feature 269: k=g or t
  misc_feature 373: s=g or c
  misc_feature 374: r=a or g
atggtatcttttataatccacaatacatttctggtaagatggaatcactacctctgatcacatatcaggctaacgatagagaaagcattaggtttaagttgagggctaagaactggtttgtttaaaggtttaaattgttggaaaagagcatttgccttctttaatgaatgatggtctcacaattcagttgactttgacctaatatttaagaatataaatatattttatttgaaaggctgagtgttgccctcaaacacttgctaawactkcctagggcaggattcattagggcttgcagacaatgtcacctaaattactgaatgtactcattataatatgatatctgacaaaggtagtacagcgtttctgagtsrtttgggaccaactgcagtggt

SEQ ID NO: 11442 - DNA, 296 bp, Homo sapiens
  misc_feature 246: k=g or t
tcagaaatgtaaactggtaaaacaatataagaaggagagtctgtaggttatattgctattttaggtcctagtgcatcttagaaactatagaaaatattttgtcactatttcaaacatggtcatttttattaaagtaaaaaataagatagtagtagctctggacatttggaaatgtgtatgtttgtttacaccctgtgaaaagtagacatggtctgcaaaagagccaatctcctaaatatatttctktctctagaaatgttattttgggacaaatgaatgaatccctgttgggaaaa

SEQ ID NO: 11443 - DNA, 533 bp, Homo sapiens
  misc_feature 462: s=g or c
  misc_feature 463: m=a or c
  misc_feature 464: n=a, g, c or t
  misc_feature 524: r=a or g
aggagggtattggccaggtcaaaggagagggtggaggaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagaggtatctgtgaggggactgagttgggagggcaagcagggaattggacatgtgggcctggagcacagagaagggacttgagcatgcatatttgggtgttccctccaaaacttatgttgaaacttaatccccagagtggcagcatggagaggtggggcctttaagaggtgattggatcatgaaggctctattcccactaatgaatggattcatcatgggagaactggcggctttataagagaggaagagagacctgcgctasmncttagcacgctcagtccccctgccatgtcatgccctgaacccctcaggactctgcagagrgttcctacc

SEQ ID NO: 11444 - DNA, 238 bp, Homo sapiens
aggagggtattggccaggtcaaaggagagggtggaggaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagaggttaacacagaaatctgcctcctgggccatgccgc

SEQ ID NO: 11445 - DNA, 402 bp, Homo sapiens
  misc_feature 331: s=g or c
  misc_feature 332: m=a or c
  misc_feature 333: n=a, g, c or t
  misc_feature 393: r=a or g
aggagggtattggccaggtcaaaggagagggtggaggaaaagagccacgaaataaccgggagacaagctttcggaggcttttgactgactggatgtgggaatgttgtggaagacttctggcctgccatttcctgagaacgggactgctgagagaggagctgggaggagcactgcaaatttcactttggacacgtgagtcagagagtggcagcatggagaggtggggcctttaagaggtgattggatcatgaaggctctattcccactaatgaatggattcatcatgggagaactggcggctttataagagaggaagagagacctgcgctasmncttagcacgctcagtccccctgccatgtcatgccctgaacccctcaggactctgcagagrgttcctacc

SEQ ID NO: 11446 - DNA, 206 bp, Homo sapiens
  misc_feature 15: w=a or t
aagtaaatgggtgawcagaatggatggctgtgtgagaccagcaccagagttccttctctcaagtcctgaattaggctgattcaccccaagagtggccgttcctaccacgaggagttcaaccctccaaaagagcccatgaaagatgacatcaccggggaacccttgatccgtcgatcagatgataatgaaaaggccttgaaaatccg

SEQ ID NO: 11447 - DNA, 227 bp, Homo sapiens
gaaaacttttacgtcggccttcgcgagcgtctgggcgggtggtaggaacaatggcgctgtcttaagtggcacagtggagcagctctgaagatgcaaagtgagggtcgctgtctgcccattgatagaggccagattgtcttggaagttccaaagttgcaacgatttctggctagtgccacgaggtttacttgactgttgtgtgaaaagctgataagaaaaccatccag

SEQ ID NO: 11448 - DNA, 387 bp, Homo sapiens
gaaaacttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgaacagcgttctgagtgtggacgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccag

SEQ ID NO: 11449 - DNA, 306 bp, Homo sapiens
gaaaacttttacgtcggccttcgcgagcgtctgggcgggtggtaggaacaatggcgctgtcttaagtggcacagtggagcagctctgaagatgcaaagatacacgaaaaaacttccagaacatctgggagaatatttaatggaaaatcgcttggttaaaacctgacacttttaacagtgagggtcgctgtctgcccattgatagaggccagattgtcttggaagttccaaagttgcaacgatttctggctagtgccacgaggtttacttgactgttgtgtgaaaagctgataagaaaaccatccag

SEQ ID NO: 11450 - DNA, 425 bp, Homo sapiens
  misc_feature 42: n=a, g, c or t
  misc_feature 169: s=g or c
aggcaatccacagcagctgcccctgcaaatgtcagcgccagnccagtcaaaagagcttgaaacctaccaagccggaggactgtgctgtgcctctctcgcccacattttccccaagcactctcaggaacctggcaacagtgtccccttgtggccaagcctggaacatcasatctgtacgttgcaatctgtggatcagctacgagactgagagaaaggaatgaaaggatggaagaattacaagatcaggcactgctgtctgtctgttccacggatgtaaccacagcacacgcgtggctcacgatggatatctgagagccagcgaactttctttacctcctagtatcatttcatgaaaattagtagcacctgcacaatggggccttggagacaggaataaaaggaaaaatctggaatggaatcacatg

SEQ ID NO: 11451 - DNA, 102 bp, Homo sapiens
aacatctgtacgttgcaatctgtggatcagctacgaggatgaatgccatccacacaaaagagctcctgttgacatctcatttacaatctcccccaggacaca

SEQ ID NO: 11452 - DNA, 335 bp, Homo sapiens
gaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacgggggaggagacaatattcccctgagggaattacataaaagaggaactcattatacaatgacaaatggaggcagcattaacagttctacacatttactggatcttttggatgaaccaattccaggtgttggtacatatgatgatttccatactattgattgagt

SEQ ID NO: 11453 - DNA, 289 bp, Homo sapiens
  misc_feature 285: k=g or t
gactctgcttccgtttctggttttgctctagtgtttgggtttcttcgcggctgctcaagatgaaccgactcttcgggaaagcgaaacccaaggctccgccgcccagcctgactgactgcattggcacggtgggcatttgatcatgcataagtaggctcaggacctctgacacacccgaccccgcccacccccagccccgggcccatattcttcctcttcatttcgggtcctgggccccttacacgtcgtccctctctatctcaccttctccccttcatccctgtkaccc

SEQ ID NO: 11454 - DNA, 208 bp, Homo sapiens
acattcgctgcacttataagcctttctccagtgtgaaccctatggtgttcaatgaggctagagtttggctaaatgacttcccacattcgctgcactcataaggcctggatccactggaactttctggtgttttatgagactggaatgatatgtaaaaaacttcccacattcactgcactcataaggcctctccccagtgtgaactccc

SEQ ID NO: 11455 - DNA, 337 bp, Homo sapiens
  misc_feature 292: r=a or g
tctatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagctctcctacccttcccatagggrcacaggcctttaccccactgtacttcggagccaacgcctttccct

SEQ ID NO: 11456 - DNA, 182 bp, Homo sapiens
  misc_feature 24: m=a or c
  misc_feature 168: n=a, g, c or t
tttggactggcgcccaaaagaggmgtgctgacaggtgtcacttcaggagaggtaccacttctctcagcctgtgggcctttagggtctccagtgttctgcttcccttcccatcgctgtggctttctcctgagtctcagaaagttcctatcccctacactaccggcgcanctgtatcccaaccc

SEQ ID NO: 11457 - DNA, 388 bp, Homo sapiens
taattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagcc

SEQ ID NO: 11458 - DNA, 206 bp, Homo sapiens
ccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcagtctctgttgactaaatacgacgaaaattcatactttatgcag

SEQ ID NO: 11459 - DNA, 275 bp, Homo sapiens
ttccaaaggaaagaaaagagggtggtggtgaaggggtggtgctctatgctcaggtaaatttggaaggttggcttaaagatgaatacgtctcttcattttctgacttctcacagaaagaggtaggaatattccacatttctcagactttttaggctaggaaacaacattgtcagggcccaagaactgacatctcttccaacactcttgttcagagaccatttgggtaaaagtacatgatgcatttaagcccttctggagataccgccacaatgcag

SEQ ID NO: 11460 - DNA, 418 bp, Homo sapiens
  misc_feature 345: n=a, g, c or t
  misc_feature 346: n=a, g, c or t
ttaggtagatgcttgtgtaggattcctgataagagcaactgaaaaggagaggggaagtagtaaagggacaagaaacgattttttttttgaggaaccataagcaaattatagtttgacaagacaagattgggggacatatatggttaccagggaattacctcttatgtgttatatctttatattatttatctctggaaaagagtaccctgcaaaattccctacagctgcaagcagatgtcacttgatggacagaggggggattctgcccctccggtatcaggaaatacatactaaagacattgcgaaacgctgaacctcttcccataaataaaaggtttgtttgtnnaatgggaaatccacccataataaatgaacaataggcactgccagtttaggcctgttcatgaatggatctgca

SEQ ID NO: 11461 - DNA, 513 bp, Homo sapiens
  misc_feature 404: s=g or c
aagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcastaatataggagaatgctttcttctgatactatttacttagaggcagttttaatataaatcatttcaattatatctacatcaaataaaataaaaatgagtgaagccccca

SEQ ID NO: 11462 - DNA, 444 bp, Homo sapiens
  misc_feature 348: n=a, g, c or t
  misc_feature 379: n=a, g, c or t
  misc_feature 380: w=a or t
  misc_feature 441: m=a or c
agcatgaacagctcaggtgggttcagagtggctcagctatgaggggctgcctagttactgagaagcttattatggagctcagagaagtagtcagggctgactcttagaaatggcagctctcctgtttacctgtaatcatttcagttggaattacaaagcaggtcagctgaaaagagtcagcctgtgaagcattgtatttaacttggattcacctggaaagatagaagtggattctgtgatgtcttcaataaatccaaatacttctggtatattactcgaggggtttttaaatattgtcaggaaaaagaaggaagctcaacgatatcggaacgaagtaagacacatctncacagcctttgacacctactaatcgtggatnwttaactttggaagatttcaaaaaagcatttaggcaggtggctcccaaattaccggaaaggmctg

SEQ ID NO: 11463 - DNA, 301 bp, Homo sapiens
ttcttagtttagcagaacgaaacagaggaatggaagagattgaagatgtaaaagagtgaaggaataattgtctgaaagcttggcatgagatcaagaataaaagggcggagactcttcctgtgatggaaggccaggggccaagaacagacaagcaagtctacaaaggagctttagatagagggttccccaggattggctttgagattctcagtgtggggggatctggagtaatctgctgagattaagtgttggaggaataggaacaggttaggggagagttttataggaatttttagagaca

SEQ ID NO: 11464 - DNA, 182 bp, Homo sapiens
gtttttcagctcgccattcacttcgctgtgaagatggcgtcgggcagcgggacaaaaaacttggactttcgccgaaagtgggacaaagatgaatatgagaaactcgccgagaagaggctcacggcgagtttctcatattcttttttctcccactgttgtaaataacttttaatggccaaacc

SEQ ID NO: 11465 - DNA, 155 bp, Homo sapiens
  misc_feature 135: n=a, g, c or t
gtttttcagctcgccattcacttcgctgtgaagatggcgtcgggcagcgggacaaaaaacttggactttcgccgaaagtgggacaaagatgaatatgagaaactcgccgagaagaggctcacggaagagagaganaagaaagatggtgggtgcta

SEQ ID NO: 11466 - DNA, 204 bp, Homo sapiens
atctgtgtgtgtgtgagtgtatctgtgtgtgtttgagcctttctgtgtgtgcacatgtgttgtatgtgtctgttttacgtgtctatctgtacatgcacatatgtttcagctgaaaagagtgcggaggggtaaaggtgactgtgagaatgagtgtgtactaggagagctgtgtgtgggacgctgcgtgcggctgttggaaagcag

SEQ ID NO: 11467 - DNA, 484 bp, Homo sapiens
  misc_feature 338: n=a, g, c or t
  misc_feature 440: k=g or t
agagaatcccggctcctgctgcaataagaggctgttctggaagctctggggttcgggtctttgtccctgcagtcttttccagctattgtgtagagcattttgggcaggagaatctaggaccaagccacatcagttctctccttaacccactccattcgactgttatcacagctatgcttccagagtgctctgtgcattttcacgatcagcaaacaatgaataaatctctgttctggaagctgggaagtccaggatcaaggcactgtcatctggtacctgatgagagacttcttcctgcatccttacatggtggaagacaaaagagtggcagagaatgnatatactcccagtccattcgagagggaagagccctcacctcatcacttccctgaggcctcaccttctaatactatcaccttggtgataagatttcaacatakgaattagaggggaatacatacatccagactattgcagatgggat

SEQ ID NO: 11468 - DNA, 475 bp, Homo sapiens
  misc_feature 48: s=g or c
agagaatcccggctcctgctgcaataagaggctgttctggaagctctsgggttcgggtctttgtccctgcagtcttttccagctattgtgtagagcattttgggcaggagaatctaggaccaagccacatcagttctctccttaacccattccattcgactgttatcacagctatgcttccagagtgctctgtgcattttcacgatcagcaaacaatgaataaatctctgtctgaatgagagttcctgttgctgcacattctcaatatcagttgttgtcagtgctccagattttggccattctactagaagcaagagcaacggctctatatctggatcactgcagtgcctagaagatacaacagcacaatttacaaatccaaatttccaggaagtctctccacatacctctagtacaaaagatgcttcagagactagagggtcagagaggaaagagaggaaatattcaactctca

SEQ ID NO: 11469 - DNA, 175 bp, Homo sapiens
  misc_feature 137: n=a, g, c or t
gcagcaggagcctctcagctttttcgtatttggagatataaccaagaactaaaagctaaagcacacaaataaaagagttcctgatcacctgaacaatctagatgtggacaaaaccattgggacctagtttattattnggttattgataaagcaaagctaactgtgtgtttagaag

SEQ ID NO: 11470 - DNA, 376 bp, Homo sapiens
  misc_feature 8: y=c or t
  misc_feature 203: r=a or g
  misc_feature 204: r=a or g
  misc_feature 346: w=a or t
agagttcygggggccaggcggccgccgcgagtctggtatcctgagcttcgtgagttgagcgctgctgctccgcggtggagtcaccgcaccgctcccgggatcatggtgttctacttcaccagcagcagcgttaattcatctgcctacactatttacatgggaaaagataaatatgaaaatgaagatctgatcaagcatggctrrcctgaagatatctgggagagaatatagaagacatcccaaaggaagtgctgatggactgtgcccaccttgtgaaggccaatagcattcaaggtaaaaattgtgacagtggagaagaaagtaaatgagatctgaaccgattagwaagaccaaagtcgagcggtcccagacctag

SEQ ID NO: 11471 - DNA, 231 bp, Homo sapiens
  misc_feature 19: n=a, g, c or t
  misc_feature 80: n=a, g, c or t
gcacacccgtcgcgcatgncaaacacagctgtcggaaggtggcgagcctgaggcgaacaatggcggactgggcgaacgantgaagcggagttgcagcgcctggtggccgccgagcagcagaaggcgcagtttactgcacaggccacgtgcccgtagaaaagatactcatccactgtgggttttggtttcgccgtcaccccactgcctcactgattgtgaggatcatatgcg

SEQ ID NO: 11472 - DNA, 303 bp, Homo sapiens
  misc_feature 19: n=a, g, c or t
  misc_feature 68: s=g or c
gcacacccgtcgcgcatgncaaacacagctgtcggaaggtggcgagcctgaggcgaacaatggcggastgggcgaacgaatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggaggg

SEQ ID NO: 11473 - DNA, 131 bp, Homo sapiens
aatactggaggaaaagataggtaaatgttttaaaattttgtttctgctaatcctaatgtactttgtctaacaaacatttcttttcatttgtagatgaactaaaccttaagatgacttcacaggatgaggag

SEQ ID NO: 11474 - DNA, 332 bp, Homo sapiens
  misc_feature 148: k=g or t
  misc_feature 155: y=c or t
  misc_feature 160: k=g or t
  misc_feature 261: s=g or c
  misc_feature 273: y=c or t
  misc_feature 292: m=a or c
  misc_feature 320: s=g or c
  misc_feature 327: m=a or c
gagagagggatgggcgtggctaatatgaaagctgcatctttactagttagctaccatgcgtcattatttatcaaaagatatatgctgcttaaacacaaatacgttttaaaatatattttaggcagtagggttttgggttttttttttkgcaagtyctttkggtgagtaaatttagtgataaatgatttttttttcttttgagacagtttgctctgtcgcccaggatggagtgcagtgcagtggcgcgatcctgcaacctcsgcctctcgagtycaagcgattctcctgcctmagcctcccgagtagctgggattacagasgcgcgcmacccc

SEQ ID NO: 11475 - DNA, 378 bp, Homo sapiens
  misc_feature 173: w=a or t
  misc_feature 174: w=a or t
  misc_feature 363: r=a or g
  misc_feature 364: n=a, g, c or t
tgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaawwagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaarnaaaaaaaaaaaaaa

SEQ ID NO: 11476 - DNA, 335 bp, Homo sapiens
  misc_feature 298: r=a or g
  misc_feature 303: y=c or t
  misc_feature 321: y=c or t
aaaaccagaagttgaggcgtgagtttggccactccgtagtgtgcacttggtgagggcagcagctcgccacagctgccagccatctgtccattcacccatctgtccatctggcagcccgctgttcagacctgtctgtctgtccgcccatctgtaagcccatctctgtcccattgtctatctgaccatctttctcttactgtcctctttgtctagctatctggcctatctgtcgatccatcttcgtgtctgtcttcagcccccacctgtttgtccatctgtccaattacctgtgactctrtgcaycttcttgtccattcatcygcccacccatctgg

SEQ ID NO: 11477 - DNA, 263 bp, Homo sapiens
  misc_feature 261: s=g or c
  misc_feature 262: m=a or c
ccacttgcttgcttttctctccgagctcattccttctcattcattttgcccagaaagttcctgcttcagagctgaaggtgattgggagattttaacttagatctccagcaagtgctacaaggaagaaaagatcctgaagaatcaatcaagttttccgtgaagtcaagtccaagtaacatccccgccttaaccacaagcaggagaaatgaagcacattatcaactcgtatgaaaacatcaacaacacagcaagaaataattsmg

SEQ ID NO: 11478 - DNA, 381 bp, Homo sapiens
cattttgtgcctgcctagctatccagacagagcagctaccctcagctctagctgatactacagacagtacaacagattcactggatgaaagaaagataaaaggggtcattgagctcaggaagagcttactgtctgccttgagaacttatgaaccatatggatccctggttcaacaaatacgaattctgctgctgggtccaattggagctgggaagtccagctttttcaactcagtgaggtctgttttccaagggcatgtaacgcatcaggctttggtgggcactaatacaactgggatatctgagaagtataggacatactctattagagacgggaaagatggcaaatacctgccgtttattctctgtgactcactggggc

SEQ ID NO: 11479 - DNA, 172 bp, Homo sapiens
agaagatggcgagggtgtgtaggcggcagaatgctccgttgagagacgcggctttcggcaagaactggattcgtggcgccacaagctcattcactgtggtttgaaagtattcttgaagggctgtttggacctgcattattaaaagatctcagtttatttaaagactgtgaac

SEQ ID NO: 11480 - DNA, 327 bp, Homo sapiens
tatgctgtcttgaaattaaagtctgctccatttctcctattgactatacatttatgttgcccatgtctgagttacagccccaatatatcagggtagtgatgtaatggaagtggactggtagttaaaagggctttaatccattctaaggattgggttaaagaggggtacaggggtgaggatggcttcctggagatgtcactgaactgagtcttaaaagatgaataggaattagccagacaaagaaaggagtaaggtctatagctcaatgatttgcatcctccacaatgcattttcctgtagttttctatagaggtttgaggggtagag

SEQ ID NO: 11481 - DNA, 263 bp, Homo sapiens
  misc_feature 78: s=g or c
gtgcggtgcagcaggtcggtaggcgggaaatggcgactggctgaaggagctggttctgttgctgctgcggggtaagcsggaaagacaccacacattgcgcagtcgggaccatcgccggagcctgaggacacttctctgtcgtcacagttagttttacatgtggcacccataaaagatgaggctgagaacacggaaagcttctcagcagtcaaatcaaatccaaacacaacgcactgccagagcaaagaggaaatattcagagg

SEQ ID NO: 11482 - DNA, 301 bp, Homo sapiens
agaggcaggacctttggcaggagacacatcccttctcctgtgatgtgtcagttagtgtagagaagcaagctggcatggacttgagagctggggtgggtatctgccccatgtggcctggctatggctgctctgttcagggagcctggggtcaggggtggcggccaccgacctgtgccagagaaggctagtctctgcatggacttcagtgcaggcatacccggcctgatggggagggctgtgggtggaaaccacacagaaaagatgcctcctcttgcttgaattgtggtgttaactagccggg

SEQ ID NO: 11483 - DNA, 388 bp, Homo sapiens
  misc_feature 82: w=a or t
  misc_feature 115: r=a or g
  misc_feature 133: m=a or c
  misc_feature 136: w=a or t
  misc_feature 223: r=a or g
  misc_feature 236: w=a or t
  misc_feature 237: r=a or g
acagaaaatgaggattattaaaggtcagttgctcgcagtgctacagctagaatgaagcacatcaacctatcatttgcagcgwgtggatttctgggcatttaccacttgggggcarcatctgcactttgcagamcawggcaaaaaacttgtgaaggatgtcaaagccttcgctggggcgtctgcgggatcgttggttgcttctgttctgctaacagcaccagaraaaatagaggaawrtaaccaatttacctacaagtttgccgaagaaatcagaaggcagtctttcggggcagtaacgcccggttatgacttcatggcccgactaagaagtgggatggagtcgattcttcctcccagcgctcacgagctggcccagaaccgactgcac

SEQ ID NO: 11484 - DNA, 349 bp, Homo sapiens
ggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggttccttagcatcagggatgccaggcagtcccagtggaagcgaagagatactcggcaagtggctgctggtaatgggacgcaaatgttgacttgatttgtgggacatccacgctgagaactgagtgctcacgtaactcaaatggg

SEQ ID NO: 11485 - DNA, 483 bp, Homo sapiens
  misc_feature 110: k=g or t
agtacaaagatgctgatgaggggctgcagcatgcaattcacttcaccagcagtcactaaggtctgatctcttttctaaccatacctggaagatggaatgctggacccagkgtatgcaaaaatgggagttattagaaaagcagctttgcttgctttaacccaggaattgtatttctggtatgttgtttccttttagacaattgccctaaaggttcttttgtttaaggagcaggaggatgggggaggttatttctgctctcagcaaaagtcttagaaccagggtctcctcgtttgtaaggaagcaagtaggtccctggacctgggctgggatatgatttgtgatcagccaggcaagagttaagagtggaagtctgtgctctctgcccatcttataatatcttaagggtgatcatctgtggtattcttgagtggtatgtcccattccatctagcatttcattagaattattgtataaaggatgaca

SEQ ID NO: 11486 - DNA, 329 bp, Homo sapiens
gtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacgcaccagcatacataccttaaaaaaacagtaaaagattttttttt

SEQ ID NO: 11487 - DNA, 351 bp, Homo sapiens
  misc_feature 129: w=a or t
  misc_feature 158: n=a, g, c or t
  misc_feature 159: m=a or c
  misc_feature 306: w=a or t
  misc_feature 307: s=g or c
gcgagtcacttgtcagcccttgtctgaggcggaggcagccccgcgccgcgccggacccgagcatatttcattttctgtcattggactttgagccattagaaccatgagcaactacagtgtgtcactggwtggcccagctccttggggtttccggctgnmagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagccccawsgaccaccgctttctgattccagattgaattaaaaaaaaaaaaaa

SEQ ID NO: 11488 - DNA, 354 bp, Homo sapiens
gcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtgtaagtaaactttacaaattttattatagatgttcattcagtgcttagtcctcgggctgagttgtttaattctctgttgacctgtactctacttattatcattgctcctgggatttgatcttggcaaatttgattatctataataaaggatgagg

SEQ ID NO: 11489 - DNA, 279 bp, Homo sapiens
tgatcagactgtaacattgcatcttgagaaaagatggtaatataaatggacaaataaagaacttgaggtcagcagtgacgagtgtgggatcacactgaatctcgtgtgtttcgctgtgtcactgcagagtgtaaatgggaaccatttttagcttaaggtaaaataggtaacaggaaacactacagaatgggtacaaaggcatgcccctcattaccaaagattacagccaagtgtctgcctcttggggaaggatctgttctgtggggagtactagacgtg

SEQ ID NO: 11490 - DNA, 304 bp, Homo sapiens
aacgcgtgcgcacagtttcttccgacagttgtgttgtgccaatggtggagaagaaaacttcgggtatgtgagcccccgcggttcgcccccttccccttcccaagtcagtcctagaattttcttacctagtcattcctcttttttggtctcgctctttcgcctaggctggagtgcagtggcatagtcatggctcactgcagcctcgatttcctgggatcaaaccatcctcccacctcagcctccggagtggctggaactgcaagcatgaggccccacgcctggttaatttttaatttgttatgtg

SEQ ID NO: 11491 - DNA, 367 bp, Homo sapiens
  misc_feature 18: n=a, g, c or t
  misc_feature 20: n=a, g, c or t
  misc_feature 22: n=a, g, c or t
  misc_feature 259: w=a or t
  misc_feature 260: s=g or c
  misc_feature 303: n=a, g, c or t
  misc_feature 351: n=a, g, c or t
attttgtgggagcgaagntntnggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagwsgtgtccggctggtagaaggaattctgcatgccccagatgctgnctggggaaatctggtgtatgttgtcactatccaaagataacaaaaganaaatggatgagacaga

SEQ ID NO: 11492 - DNA, 382 bp, Homo sapiens
  misc_feature 7: m=a or c
  misc_feature 8: n=a, g, c or t
  misc_feature 16: n=a, g, c or t
  misc_feature 298: n=a, g, c or t
  misc_feature 299: n=a, g, c or t
  misc_feature 300: n=a, g, c or t
  misc_feature 313: y=c or t
  misc_feature 314: n=a, g, c or t
  misc_feature 315: n=a, g, c or t
  misc_feature 325: n=a, g, c or t
  misc_feature 337: w=a or t
gcgatgmngacggggncctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcggatacataaaaattaacttaaaatagatttaaaaacctaaacagaagagctaataatataaaacttccagagaaattcttgatttaggtaaagatttgtgacattgagttcttaacannncaaaaagtacaaynncaagaaaganaaaaagaaaagwaaagaaagagaaaatgaaagaaaaggcactgtattgctactgggc

SEQ ID NO: 11493 - DNA, 256 bp, Homo sapiens
  misc_feature 20: s=g or c
  misc_feature 229: n=a, g, c or t
  misc_feature 230: n=a, g, c or t
gctgtgtgcgtcacgccgasgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggnncacgggccagccccgccgccctcgca

SEQ ID NO: 11494 - DNA, 375 bp, Homo sapiens
  misc_feature 12: n=a, g, c or t
gtttgaacgggngtctacagaaggcacagtgtcaaccaaccactctagccaaaataaataaatctgggagctaaaagattacttctgcctggacaaggctgcctagcaatcaaaataaccagcagaaaacacctcttaatggagaagaatgagactgggctggctgcacatgccaagaggctggctgcatcccctacaatatccagaactctcatcaatcctctttccatgcctcaaacggtaatctacactccaaccttcccttgtaaacacatcagtacccactgaagtgtggtaccccagaagactttctgttaagctgtcagcacgattctaccgataacacggtatggcattttagcattattggataca

SEQ ID NO: 11495 - DNA, 245 bp, Homo sapiens
acacaacccggcgatcgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacagagtgatttgccccggatcaaaacggagattgagg

SEQ ID NO: 11496 - DNA, 584 bp, Homo sapiens
cggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtccttttt

SEQ ID NO: 11497 - DNA, 295 bp, Homo sapiens
agccccgccccgctgcggctgattcgtctagttaaaccctggtgttcctgacacaaacttcaggaaaggattttgcacttgtgcagaccgggcgagcagagtaagaagcaggtcccgcataccaacaaaactaaggacgccaacttgtctggaaggcccaataaaaagctgattcatggaggaatgcaattgtcacatcctaatgatttcatctcccttaccccaacgaatcgataaccccaaattttccagcccctcaccctccacaaatccccttaaaaaactttgcctagaa

SEQ ID NO: 11498 - DNA, 432 bp, Homo sapiens
aatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacag

SEQ ID NO: 11499 - DNA, 363 bp, Homo sapiens
gattacattagaactccagaacttctatttatttaaaagatttaagatttgacacaaaagcggtttattttagaatgtttatttctatagattgtcattacttcaactcagttttcataatttgtatttgagtatactaactttggaacatagtgtaatattaatggctacagaagaggtttgttgaagaattgtaatttgaaagaacagcatatgtttattgaagagagcatatagagatggaagtggttagaaactatgaactttctttagtttggcttttcatgtaaagtggaatatgaaaacaaaagtcctaaagacagttcagcagagttcctcttcaccctgtttttaagcagtgat

SEQ ID NO: 11500 - DNA, 572 bp, Homo sapiens
agttcgaggagaaatgcacctactgtacgtgaaatgctggtgcagatttttttcctatcagtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatataaataaagatatacttcaattgatgctggctttgcatgcaagtatttaaagatacagtgtcactgtcttatagtatttatatgctctttgccatctataacttatcatatttcattcttatgatgtaattatcacatactttcactgctattatgtaacactgcaagtatgtggacattactaagagtttgtgtatgtgttcgt

SEQ ID NO: 11501 - DNA, 459 bp, Homo sapiens
agttcgaggagaaatgcacctactgtacgtgaaatgctggtgcagatttttttcctatcagtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcga

SEQ ID NO: 11502 - DNA, 469 bp, Homo sapiens
agggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccag

SEQ ID NO: 11503 - DNA, 392 bp, Homo sapiens
  misc_feature 85: s=g or c
tagcactcatcagaaaactcctgtatgttctattgatgggagcactcccatcactaaatcaacaggtgatttagtgatgggagtsttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccag

SEQ ID NO: 11504 - DNA, 356 bp, Homo sapiens
tgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatct

SEQ ID NO: 11505 - DNA, 409 bp, Homo sapiens
  misc_feature 376: m=a or c
  misc_feature 396: w=a or t
  misc_feature 397: n=a, g, c or t
agttgtctcttcgccgccgccgcagcctctgccccactcgtgagggatccgagggctccgtccttgtgctgtcttcgccccggctcccaggggtcaaacgagggtcgggggtggggacacgcagcctagccactgtcctgcctgggatccggtctcccccgccccccggctgcagggtggataaagaggaagatgtgaagaggaggcagacaaaagcaaaaggacatcctgtcagtaggaaacggccgaattacaattcagatgtgcaatgtttgcataagtaaactgacacgggactattatatgcagaaatccacgtgcaaaaattttcagacacacctttgtacctcttcctaatcctgcctggtaaaatggmggttatcagtgcaagtttgwnggatacatacag

SEQ ID NO: 11506 - DNA, 447 bp, Homo sapiens
  misc_feature 314: r=a or g
  misc_feature 389: w=a or t
aactgaggaaccatctgggctggccaatggctacagttttggggtcgatgcagcatatcagtggacaccattacagatatggtagaaggaagagtctcacagtggtttccaagtgtggtccccggacctgcagcatcaacatcacctggaaacccattagaaaagcaaacccagctgtgggcccagcaagttgtagtttaacaagcccttcaggtgattctgatgcactctcaggattgaaaagcactggtctgggaaagacacagtctcctcagacctgaatgtcacatcattccaggtgtatactttgggargtacacagacccactgtagcaccttcagatggtgagaaggaaggccaattaaaagaatgtccaaagaaaggagtwctcatcatgagataaaacaccagcagaggaatgaaagctgcttcaaacaggtgacaaa

SEQ ID NO: 11507 - DNA, 235 bp, Homo sapiens
ctagcggctctccccgcgtccaagatggcggcagaagcagctggtgggaaatacagaagcacagtcagcaaaagcaaagacccctcggggctgctcatctctgtgatcaggactctgtctactagtgacgatgtcgaagagggaaaatgaaaagggtcgccttgaagaagcctacgagaaatgtgaccgtgacctggatgaattgattgtacagcactacacagaattgacgaca

SEQ ID NO: 11508 - DNA, 271 bp, Homo sapiens
  misc_feature 85: r=a or g
  misc_feature 87: s=g or c
acggcgagtctgggcgactgcgcacgcgcggctggttataaacaacttgtgaaatgagtgatttggaagatgatgagacaccccrgstttctgcccatgccttagcagctctccaggaattttatgctgagcaaaagcaacaaattgagccaggcgaggatgataaatataacattggaataatagaagagaattgggtgccatcatggaagaacaggcagcagaactccttggagtgaagatgtgcacgtttgttccaagacacacccgg

SEQ ID NO: 11509 - DNA, 129 bp, Homo sapiens
caatccttaaagcaacaagattaattttctgcttaaaatatttgggaagataggtaaggaggagggggttttaaaatataaaagcaagtttttctattttaaggtgcatatttgtaacattacagggga

SEQ ID NO: 11510 - DNA, 251 bp, Homo sapiens
ggatgagccgccgcggacggggcgcgggcggacgatggaactccacatcctggagcaccggctgcaagttgccagcgtcgccaaggagagtatcccgctgttcacctacggcctgatcaaacttgccttcctgtcctccaagaccaggagatggtaaaagcaataccatgagacttccgaggctagggcacgaaaggatggcttctgcgtggtgctccctctctcccagatcccttgctctgtaggaaacc

SEQ ID NO: 11511 - DNA, 352 bp, Homo sapiens
  misc_feature 352: n=a, g, c or t
aaacttcgagagcgtaggccccacctatcgtgggtcgagttgcttggcggtcgtggttccggaggttcctcgggatgtcggtggccttcgtaccggactggctgaggggcaaggcggaagtcaatcaagagactatccagcggctccttgaggagaatgaccagctgatccgctgtattgtggagtatcagaacaagggccgcgggaacgagtgcgtgcagtaccagcatgtgttacatagaaatctcatttatttggctaccattgcagatgccagtccaaccagcacttcaaaagcaatggaataatctttcaaaagcaatagaataatcttccatttggctgtcgtgan

SEQ ID NO: 11512 - DNA, 408 bp, Homo sapiens
tgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcaaggtgctgggattgcaggcgtgagccaccgtgcctggccagaaactcttttttaagcgatgagatctgtgtggcatttctagcgctctctaaattatgtctctggcatattttaatcactggaaactcaaagagtggaagagtggaagtgcgaaggaatctcaggtagctcttaactaattcgcct

SEQ ID NO: 11513 - DNA, 285 bp, Homo sapiens
ccatccataggtaaaatgctgacctatagaaaaaaatgaactctacttttatagcctagtaaaaatgctctacctgagtagttaaaagcaattcatgaagcctgaagctaaagagcactctggtggttttggcataatagctgcatttccagacctgacctttggccccaaccacaagtgctccaagccccaccagctgaccaaagaaagcccaagttctccttctgtccttcccacaacctccctgctcccaaaactatgaaattaatttgaccatattaacac

SEQ ID NO: 11514 - DNA, 308 bp, Homo sapiens
  misc_feature 11: s=g or c
  misc_feature 287: m=a or c
attctgcgtascggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgmgcggggcacaagggacgacgc

SEQ ID NO: 11515 - DNA, 159 bp, Homo sapiens
  misc_feature 126: n=a, g, c or t
  misc_feature 154: y=c or t
ggcattaatatcaccttgtttcacagtgaaacaaacggaaaagcagagaggtcaggcaactgacttaaaagcacagagctcgtaagagaggagggtgggctttgaacacaggcagtccaatgtcangttgaactcttactataattctataatyaccgc

SEQ ID NO: 11516 - DNA, 334 bp, Homo sapiens
  misc_feature 15: r=a or g
  misc_feature 116: r=a or g
  misc_feature 136: m=a or c
ttttttttgtagaaracaaagaaacccaaggcagcagagtctgtttcaaaaccagatgtcagtgaagaagccccagggccatcaaaagttaagacagggaagcctgaagaagccarccttgattctagagagaagmaaaccaacttggctcccaaaagcacagcaatgaatgagagctcttctggaaaagctgggaagcctccgtgtggagccacaaagaggtccatcgctgacagtgaagaatcggaggcctacaagtccctctttaccactcacagctcaagcgctccaaggaggagtctgcccactgggtcacccacacgtcctactgctt

SEQ ID NO: 11517 - DNA, 188 bp, Homo sapiens
aaacaaagcggcgagtggtgtgagagggcagcacgcgctgtgggtctttttgccattcctccaggacatccaccataaggaaaggagaccctggaccaacattctctaagatgtttatatggaccagtggccggacctcttcatcttatagacatgatgaaaaaagaaatatttaccagaaaatcagg

SEQ ID NO: 11518 - DNA, 428 bp, Homo sapiens
gtggctgttgcggatggggcgtaggtgggcggtgcgcccacagctgcctgggtgtgcctagattgatcggtataaggctcactctcccgccccccaaagtggttgatcgttggaacgagaaaagggccatgttcggagtgtatgacaacatcgggatcctgggaaactttgaaaagcaccccaaagaactgatcagggggcccatatggcttcgaggttggaaagggaatgaattgcaacgttgtatccgaaagaggaaaatggttggaagtagaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccct

SEQ ID NO: 11519 - DNA, 144 bp, Homo sapiens
tcctgggtggcgagcaggcgcgtgtgtaggggagttagaaatggagtcaatatatcttcaaaagcaccttggggcctgtttaactcaaggtcttgcagaagtggcaagagttcgcccagtggatccgatagaatatttagcatt

SEQ ID NO: 11520 - DNA, 296 bp, Homo sapiens
  misc_feature 250: m=a or c
  misc_feature 294: s=g or c
atttcctctgccccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtattccaacaatgtctcacccatcttggctgccacccaaaagcactggtgagcccctcggccatgtgcctgcacggatggagaccamccattcctttgggaacccagcattttcagtgtctacacaacagsca

SEQ ID NO: 11521 - DNA, 184 bp, Homo sapiens
  misc_feature 99: m=a or c
atttcctctgccccttgttctggaagctgaggcgagaatgtctcagttctgttcccttcaggcttcgagaccaccgccttgctgtgtcccgtagtggamtgagggcctgcaagagggagtgagggctagtggagggccagctgcctgtgggggctggacatcgtgtgagtacatcattactgcc

SEQ ID NO: 11522 - DNA, 419 bp, Homo sapiens
  misc_feature 11: y=c or t
  misc_feature 373: m=a or c
  misc_feature 417: s=g or c
atttcctctgycccttgttctggaagctgaggcgagaatgtctcagttctgttcccttcaggcttcgagaccaccgccttgctgtgtcccgtagtggactgagggcctgcaagagggagtgagggctagtggagggccagctgcctgtgggggctggacatcgtgtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccamccattcctttgggaacccagcattttcagtgtctacacaacagsca

SEQ ID NO: 11523 - DNA, 329 bp, Homo sapiens
  misc_feature 58: s=g or c
  misc_feature 133: k=g or t
  misc_feature 191: n=a, g, c or t
aggaagtgggtaagggtaatatggaggagcttccggcagcccccggcggctgaaagcsgggcagaagtgctggtctcggtcgggattccgggcttggtcccaccgaggcggcgactgcggtaggagggaagakgttttggacgcgctggcctcccgccgctgtgcattgcagcattatttcagttcaaaangaactatatgcctggcaccgccagcctcatcgaggacattgacaaaaagcacttggttctgcttcgagatggaaggacacttataggctttttaagaagcattgatcaatttgcaaacttagtgctacatcagaccgt

SEQ ID NO: 11524 - DNA, 234 bp, Homo sapiens
  misc_feature 92: y=c or t
catttctaaccccaatgcagctggtccacagaccacactttgagtaggaaggccttagatgtccagatttttctctgtattatgtaatcctycatccaaatgtctagaaaccaaaagcagaacaaaaagcaaccactgtcaatttaataaggccaataaaggttactttcgggtgagttttttgttttgtttggttttgttttgagacagagtcttgctctgtcgcccaggctg

SEQ ID NO: 11525 - DNA, 430 bp, Homo sapiens
  misc_feature 154: s=g or c
  misc_feature 259: s=g or c
gaggagatgactggggagcgggagctcgagaatactgcccagttactctagcgcgccaggccgaaccgcagcttcttggcttaggtacttctactcacagcggccgattccgaggccaactccagcaatggcttttgcaaatctgcggaaagtsctcatcagtgacagcctggacccttgctgccggaagatcttgcaagatggagggctgcaggtggtggaaaagcagaaccttagcaaagaggagctgatagcggastgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatggga

SEQ ID NO: 11526 - DNA, 382 bp, Homo sapiens
gatagagatttaacagagttttcagaattagaatactcagaaatgggatcatcgttcagtgtctctccaaaagcagaatctgccgtaatagtagcaaatcctagggaagaaataatcggaaaaataaagatgaagaaagaagttagttagtaataacatccttcataatcaacaagagttacctacagctcttactaaattggttaaagaggatgaagttgtgtcttcagaaaaagcaaaagacagttttaatgaaaagagagttgcagtggaagctcctatgagggaggaatatgcagacttcaaaccatttgagcgagtatgggaagtgaaagatagtaaggaagatagtgatatgttggctgctggaggtaaaatcgag

SEQ ID NO: 11527 - DNA, 209 bp, Homo sapiens
atctgacaagctgaaataggcccattttggggccaatgataaaagtctgatttctcaagcactttatttgtctattggatcagaatggcactgattagtactttctgtgcaaaagcagagacggggagccgccttcccatttctgaacccgactgttctatttacaatctctaagcaaatttctggaatttcactgacagattccctgg

SEQ ID NO: 11528 - DNA, 236 bp, Homo sapiens
  misc_feature 168: s=g or c
tagggcggggttgccggaagaagtggcgaagttacttttgagggtatttgagtagcggcggtgtgtcaggggctaaagaggaggacgaagaaaagcagagcaagggaacccagggcaacaggagtagttcactccgcgagaggccgtccacgagacccccgcgcgcascatgagccccgccccccgctgttgcttggagaggggcgggacctggagagaggctgctccgtgacccc

SEQ ID NO: 11529 - DNA, 405 bp, Homo sapiens
  misc_feature 56: s=g or c
  misc_feature 60: n=a, g, c or t
  misc_feature 122: k=g or t
  misc_feature 260: s=g or c
acccggtagcttctagtaggttccagaaggcggcgcgtgcggttgggaacgcggascgancggattcgattcaacggggttccggaccgcgctgcgctatggagcaggtcaatgagctgaakgagaaaggcaacaaggccctgagcgtgggtaacatcgatgatgccttacagtgctactccgaagctattaagctggatccccacaaccacgtgctgtacagcaaccgttctgctgcctatgccaagaaaggagactascagaaggcttatgaggatggctgcaagactgtcgacctaaagcctgactggggcaagggctattcacgaaaagcagcagctctagagttcttaaaccgctttgaagaagccaagcgacctatgaggagggcttaaaacacgaggc

SEQ ID NO: 11530 - DNA, 345 bp, Homo sapiens
  misc_feature 249: k=g or t
  misc_feature 250: w=a or t
aaccattgttccgccggtcgcgccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaaaagcagcatctgttatagcaaaatacccacacaaaataaagagtggagctkwagctaagaaattgcctggagtaggaacaaaaattgctgaaaagattgatgagtttttagcaactggaaaattacgtaaactggaaaagattcggc

SEQ ID NO: 11531 - DNA, 478 bp, Homo sapiens
  misc_feature 134: s=g or c
aaccattgttccgccggtcgcgccggagctgggttgctcctgctcccgtctccaagtcctggtacctccttcaagctgggagagggctctagtccctggttctgaacactctggggttctcgggtgcaggccgscatgagcaaacggaaggcgccgcaggagactctcaacgggggaatcaccgacatgctcacagaactcgcaaactttgagaagaacgtgagccaagctatccacaagtacaatgcttacaggtgggacagtgcagcattctcgggtagcatacgttctgggataccctgtttagtgtggcaattaacaggactgagggcccagtggatatttggtccatctgcaagagcgggaaaaagcaagaatcgaggctggtaccttactatttcttgaagaatgtgggcagtgcgttataggatcagttcagataagttcccaattctgattgcagatagctgtagcctga

SEQ ID NO: 11532 - DNA, 174 bp, Homo sapiens
  misc_feature 107: w=a or t
  misc_feature 108: k=g or t
tctaagctcggggctccgtgcactgacgtggggccagccacagggaggcggggatcaagtagcggaggccaggatttggccacctcccgggcaagttgcagggcagwkgcgccgggagcaaaagcagcatgatgcagctcatgcacctggagtccttttatgaaaaaacctcct

SEQ ID NO: 11533 - DNA, 381 bp, Homo sapiens
  misc_feature 245: n=a, g, c or t
  misc_feature 309: n=a, g, c or t
  misc_feature 353: n=a, g, c or t
agacgcggagtgggaaaagggaggcagaggaggcggaggcagaggcagaggcagagcccggtgccgagaccaagcgacagaccggcggggctgggcctcgcaaagccggctcggcgagctctcccgacacccgagccggggaggaaaagcagcgactcctcgctcgcatccccgggagccgcactccagactggcccggtagtcaggggctcaggagcagatcccgaggcaggctttgctcagcntccgacgagggctggccctttggaaggcgccttcaacagccggaccagacaggccaccatgacngagaattccacgtccgcccctgcggccaagcccaagcgggccanggcctccaagaagtccacagaccacccc

SEQ ID NO: 11534 - DNA, 478 bp, Homo sapiens
  misc_feature 416: n=a, g, c or t
  misc_feature 417: n=a, g, c or t
  misc_feature 418: k=g or t
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaataannkccttatggttttggatgtaccatttgtttcttatttgtgtaactgtaagttcacatgaac

SEQ ID NO: 11535 - DNA, 356 bp, Homo sapiens
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctacgctcacatcactggctctgagaaagggctggttcatgaagtttctgccatcatccaaaggggataagactagggagagacgcggaagtcccactaagctggctttggcctccaacacagctgacaagagtccttggaggatttcccgaa

SEQ ID NO: 11536 - DNA, 505 bp, Homo sapiens
  misc_feature 443: n=a, g, c or t
  misc_feature 444: n=a, g, c or t
  misc_feature 445: k=g or t
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagcagttggagaaatgtgtaaaggcccgggagcggctagagctctgtgatgagcgtgtatcctctcgatcacatacagaagaggattgcacggaggagctctttgacttcttgcatgcgagggaccattgcgtggcccacaaactctttaacaacttgaaataaatgtgtggacttaattcaccccagtcttcatcatctgggcatcagaataannkccttatggttttggatgtaccatttgtttcttatttgtgtaactgtaagttcacatgaac

SEQ ID NO: 11537 - DNA, 308 bp, Homo sapiens
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtaagaactgtctcaggtttggaaacatctcagtaaaagcagggtttgagcttcatgaaattctaagggcattttaaggagtttttacttgataccttgtagataatgggg

SEQ ID NO: 11538 - DNA, 342 bp, Homo sapiens
acttccggccagatcgccggatttccgctgagtgacccttacaagtccttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggtggcccacaaactctttaacaacttgaaataaatgtgtggacttaattcaccccagtcttcatcatctgggcatcagaatatttccttatggttttggatgtaccatttgtttcttatttgtgtaactgtaagttcacatgaac

SEQ ID NO: 11539 - DNA, 175 bp, Homo sapiens
gctaagcctgtctcccagattttctagagagactcttctcgctgactcagggattactacaagctcttgcataaaaggagaaatggcagagcaaggggctggaatcaatagtcaaaggaggaaagttctgtatcccaccgagaatgccaagttattcttcaaaagcaggtaacgg

SEQ ID NO: 11540 - DNA, 261 bp, Homo sapiens
  misc_feature 24: n=a, g, c or t
  misc_feature 180: w=a or t
cacacaccgcgtgggggctgcgcnaagcagaactaggaagctttgctccggtctggacttcgtccctcccagatctctgagctagcaagcactgcagcccgagccaattgcgaaagaccaacaaagcccagcccagcggaaggaacggtttcggagttgtttttctttgatacgggagtwcctccttgctctcgcccctactctttctggtgttagatcgagcaaccctctaaaagcagtttagagtggtaaaaaaaaaaa

SEQ ID NO: 11541 - DNA, 398 bp, Homo sapiens
  misc_feature 394: w=a or t
  misc_feature 395: k=g or t
catttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacaatgccgtgactctggactatatcagtttttggaawkcag

SEQ ID NO: 11542 - DNA, 218 bp, Homo sapiens
  misc_feature 67: n=a, g, c or t
aagaagggacggggccccacgctgcgcacccgcgggtttgctatggcgatgagcagcggcggcagtngtggcggcgtcccggagcaggaggattccgtgctgttccggcgcggcacaggccagagcgatgattctgacatttgggatgatacagcactgataaaagcatatgataaagctgtgacttcatttgctttttttctcacctgcacttagag

SEQ ID NO: 11543 - DNA, 350 bp, Homo sapiens
tctttcttcccattgagagatggggtgtaggttatgacttctcctctccaacctgggcaagtctttgtgactgccttgaccaaaagcatatggcagagggatgccatgtgacatctaaggataggtaataaatatgccacatgttcaccttgatctctaaggatcacactgagggatgccacccacatataagcagcctaaatattctgaggctgccatactttgaggaagcctaaagtagctcatataaagagaccctgagactacttggagagagatgcttgacctgcccccagttgcttcagcccttcattggtacagtcagtgtctcactacaattgcattaggaa

SEQ ID NO: 11544 - DNA, 491 bp, Homo sapiens
  misc_feature 12: r=a or g
  misc_feature 72: n=a, g, c or t
  misc_feature 227: s=g or c
aattcgccatcrctttgcacactgcgaggggctccgtgtgtgcgccctgtcttgtctggccgtcctcatccnatcccccaccccctgccgccactccgacccgctcccaaagtggcttcacaatagtcggtcctcggcggtgtaggctgcgcaccaggtccacacttaagcgaaatcaaggagacccccttctacttctacctttgggtttggtgctcaatgcgaastgctgcaactcagacacgcctaagtcaactcatgcagaaaaaggagaaaagttttggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggataggtgggctccaccctgtacactaaagctaatcttatcctttgtcgcagagacta

SEQ ID NO: 11545 - DNA, 614 bp, Homo sapiens
  misc_feature 239: n=a, g, c or t
  misc_feature 594: r=a or g
  misc_feature 595: m=a or c
acagacagaccagcgactgcagccacctccaggcatttcttaaaggggagggttgtgtgctttttccagggtattctggtagcagtttgattctcttgcttttattttaatttccataattggtagcttcagaaatggctttggaaggcaatttgctttaaatgtagccacctattccaaaatgccctggttattttaggaaccctacccttttcctccggagctctctcgcaggagtncttcttttggactggtccaggaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaaagctcatccctrmctttgagatggtgatgcgt

SEQ ID NO: 11546 - DNA, 342 bp, Homo sapiens
  misc_feature 136: n=a, g, c or t
aattctaaaagccaaatttaacaacacatccagcctcagactcaggtccctggactttgggactcattctgctcgacttgatccctgctctgcccattgatcacatacacacgtttacacctggcagaagaggaangaggaggcatgaaggaatggcctcttcagaatggagaaaagccttccccatgagaacatgcctaagacagactgctgaagaaggcggcaaatggaacagcgctgaatcagcctggtcatcccagtcaagcctccagacatgtaagcaccctcctctgatctgcagagctgcctggcccaaatactgttgaccactcttgagtaagc

SEQ ID NO: 11547 - DNA, 223 bp, Homo sapiens
  misc_feature 109: k=g or t
ttaatattgtgtttgtgatactgaagtatttgctttaattctaaataaaaatttatattttacttttttattgctggtttaagatgattcagattatccttgtactttkaggagaagtttcttatttggagtcttttggaaacagtcttagtcttttaacttggaaagatgaggtattaatcccctccattgctctccaaaagccaataaagtgattacaccc

SEQ ID NO: 11548 - DNA, 472 bp, Homo sapiens
  misc_feature 23: s=g or c
  misc_feature 306: y=c or t
  misc_feature 307: s=g or c
tcccaaccttattcaggcgtcasatctctgcaccccaaatgcctgttagggaggatagtgaaggctgagccctcctgggctcatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctactgtgacttccccttctgtcgacttcctcaccaactttaaaattccgtatysagagcagtttcctaagttacctcaaatcctattcagaagaaggttcttcctggaagttgggagggcggaaaacaagtttagtcacagaagactactccatgtttgagcttctgtttcaagggaagtgagtaactgccggagagccctgcccctctgcagtgtgtg

SEQ ID NO: 11549 - DNA, 298 bp, Homo sapiens
tatttgtatttcaggaaatttcacataaatattggatttctggcttgtttgaagaacatagaccatttaataatagtgcatcccctttcccaattggcaaaagccagctaaagctattcaattagtggctgttttacttaaatgatgaaggttgttgtaactttgccgcagcgaaacccactccttgttataataggccaaccttgcttctctcattaatattatcttcctgaccccagtaactatttcagtttatgatcctttgcgttcttgttcatttagttgtctacccccacca

SEQ ID NO: 11550 - DNA, 213 bp, Homo sapiens
  misc_feature 66: w=a or t
  misc_feature 78: n=a, g, c or t
aattcctttccgcaggcagcacccagggacctgagtgttgcaaggtgcgagaggggagcgccgcgwggagcgccgcgngaagcgcatgtgcctcaaattcctgcctttcctcaagagaagagcccccaggagaaaagccagtattgcttgtgctcctaacaacctgtctcttgagaggctgatcatcaggggttcactttcagagaagttgag

SEQ ID NO: 11551 - DNA, 459 bp, Homo sapiens
  misc_feature 313: y=c or t
  misc_feature 327: s=g or c
  misc_feature 328: m=a or c
  misc_feature 389: r=a or g
  misc_feature 408: m=a or c
  misc_feature 418: y=c or t
  misc_feature 419: m=a or c
  misc_feature 423: y=c or t
  misc_feature 424: m=a or c
  misc_feature 438: n=a, g, c or t
  misc_feature 448: r=a or g
  misc_feature 449: r=a or g
cctatcactggagaatgggtttggtgctttgagctgtgtttctacataaaaaagaaggaatcaaagtgatgctggtgtgacaatataacatttgaagctgctccaaacaactttgactgtaagaaaatggccaagagaatacaagaggctctaaccaaggactctgacttcactaagccactgaaacattcctggcactacctacctcctgccttttcgttatgggaggaaaccctattggttaggtcactggtttaaaacacgtcctttaaattgcagaggaagaaaaggcttggaggtgataaaggaatayagttcattcccttsmttatggtgatggtttcataggcatatgcatatgtccaaactcatcaacttgtatacatcaratatgtgcaatttactgtmtatccacctymtctymataagctgtttaantaataataarrtaacattacg

SEQ ID NO: 11552 - DNA, 193 bp, Homo sapiens
tctcctgagtgcttatttactgttcacatgtggctaaaagccatttagaaccatgtatattgattaaagtgcagattaagatattttatatcaatttttgttcaaaaatgaaatttgattatataagattggtgcttttgtgactttcaatgccttttgtgaaggaatttataaaagggaatttaaaaaaata

SEQ ID NO: 11553 - DNA, 194 bp, Homo sapiens
cccttctctcactctcactcttgctggaggcgagccactaccattctgctgagaaggaaaagcccgcaactactttaagagattaagacaatatgcgcaatcctcgcctttcctagcaatcactatttaaatctggcaagaactgacaacagtctttgcaagaatggaatccgtaaaacaaaggattttggccc

SEQ ID NO: 11554 - DNA, 295 bp, Homo sapiens
agaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtcc

SEQ ID NO: 11555 - DNA, 341 bp, Homo sapiens
  misc_feature 161: r=a or g
tcacttagaagagaaactttcagcgggccactaaaagaaggaaagcagatgggatcaaaatgaaggagccagcagcttagattcttcatagtagaatgtataaaataattagacaggtaatgggagtagcacttaatgatctctacctgaatttgactgaraccaatagcaagaagaagaccagaagaagatgtgtctaggtaggtcaactcctgtatatcccaccctacccctaaaggaaagacaaaagccctgactatggagcttggaacagagaaagcccagtcactgaaatagctacacctcagcaacatatcacatcccatctcattctgtcccca

SEQ ID NO: 11556 - DNA, 378 bp, Homo sapiens
  misc_feature 235: m=a or c
accgccatttcgtggacgccgggtgagtgagagagttggttggtgttgggccggaggaaagcgggaagactcatcggagcgtgtggatttgagccgccgcattttttaaccctagatctcggtaagagaccagcgaaagagggaatgaggtggaaatggaatttaacagtaccaaggagccaggcccaatggcggcgccagattgagacaaagaggcgccgcgccattttgtgamgttcagcacggggcggtggcgggggctcccggcccatcggagggtttcctagtcttggagtggaagtgtttatattcctcattggggcatgagcaggatgggggttacctgggagttgggaaccacaaaggggagccgatagc

SEQ ID NO: 11557 - DNA, 380 bp, Homo sapiens
  misc_feature 183: r=a or g
  misc_feature 257: w=a or t
  misc_feature 258: m=a or c
  misc_feature 367: r=a or g
actggaaaaagaagtagaaaaaagaaaagtagccttacaagaagccaaattaaaagcaaagggattgaatccggatggaactccagccctttcaaccctgggtggattttctccagcctccaagccatcatcaccaagagaaagtaaaagctgaagagaaatcaccaatctccattaatgtgragacagtcaaaaaagaacctgaggaagacaacaggcttccaaaagcccttacaatggtgtaagaaaagacagcwmgagaagtagaaatagcagaagtgcaagtcgatcgaggtcaagaacacgatcacgttctagatcacatactccaagaagacactataataataggcggagtcgatctggracatacagctcga

SEQ ID NO: 11558 - DNA, 424 bp, Homo sapiens
  misc_feature 132: n=a, g, c or t
  misc_feature 330: w=a or t
  misc_feature 347: r=a or g
  misc_feature 396: y=c or t
  misc_feature 400: m=a or c
attttggggttttaagccataaacgatttttcttgttgcaggggattgcagtggcaaagctaggctaggtcttggaggctggtgtaaggcgatgtgggtgaaggcaggaggctgatggaaagactggggggnaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatcwgcgggtccaagcctgtrgccccaaatcggataatctctgcagctgataacaagcaaaagagaagcyaggmaacagccatattaaagaagaaaac

SEQ ID NO: 11559 - DNA, 382 bp, Homo sapiens
attttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatgtaagtagcttgcaacccaactttgacattcactgctagctcactcctcccccca

SEQ ID NO: 11560 - DNA, 454 bp, Homo sapiens
attttggggttttaagccataaacgatttttcttgttgcaggggattgcagtggcaaagctaggctaggtcttggaggctggtgtaaggcgatgtgggtgaaggcaggaggctgatggaaagactggggggaagaaaagccgaaatggattcacggtgccttggatgaaggacgagaggggaactgcaagctccttcaactggttctgtccggtgagaagtgatcaagcttgggctgacaagaggctcagggagccctcacgttctttcgcttttttacctgccaatcaaactgctacaagacaacaccctgatctggcatggacatatccaacttagaaataatgtttcattcaagataaggctcgtggcttaggagattgtgacctggcttgcatcattctaagacttctatcgtctgttttcaaaacccaaggaggacctccttttctgtg

SEQ ID NO: 11561 - DNA, 386 bp, Homo sapiens
tgtctcccgaagaaatggaaatctgacagctttttaagaaaggtgtaattaaaggttaatctgtgattgttatgaagtgaatttgaatatcatcagaatgtgtctgaaaaaacattgtcctcaaataatgttctttaaaggcaatctttttaaagatttcactaatttggaccaagaaattacttttcttgtatttaaacaaacaatggtagctcactaaaatgacctcagcacatgacgatttctattaacattttattgttgtagaagtattttacattttcatcccttctccaaaagccgaatgcactaatgacagtgttaagtctatgaaaatgctttattttttcattggtgatgaagtctgaaatgtgcatttgtcatcc

SEQ ID NO: 11562 - DNA, 362 bp, Homo sapiens
tcttttctttgtatttccgcctctcgcctctctctaaaagccgcagttagaggcgagatttaggaaaaacctctgccgagtgagcctctggttgggaatatgtatgagaaaaaaaaactggcaaggcgttagtcaagcaaagctgaaggcagaggaaatttgatatctggctggagtctagaggatttaatgcaaataagatactctgagggcagcgtggcaaaaaaagactacaattcccggtggtcacagcgtttgagaagcgatgctttctgagacttgtagtaactaggagctgtgtttgaactatccaggctcaggacagcctcttgaaaaaaaattttttattaataaagcggatt

SEQ ID NO: 11563 - DNA, 260 bp, Homo sapiens
gaggggcggggaaggactagggtgcggggagggggttgcaaaaggagccgagcggcttctgctcaatggcggaaaagccgccggtgctctgacggcctcgttcccctagcagttgcgggggagtttcctgccggcgcggctggagtctctgattctcagggttcggtggttggaagatgctccagagagacgaggctgcggcggaggaggtggcggcggccgaatcggcaacggcgctagggtggagagaaggcggcagc

SEQ ID NO: 11564 - DNA, 356 bp, Homo sapiens
  misc_feature 206: s=g or c
aagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcasagttgggagctgaaagtgccgacagcattggtgccgtgttaaatagcaaagatgagcagagagaaattgctgaaacaagagaaacttgcagggcttcctatgatacctctgctccaaatgcaaaacgtaagtatctggattaaggagaga

SEQ ID NO: 11565 - DNA, 290 bp, Homo sapiens
agtgcgcggccgcgtgctctaccggcgtgtcgctccgccccagggagagccggcgctaccatggaggagtaccatcgccactgcgacgaggttggcttcaatgctgaggaagcccacaatattgtcaaagagtgtgtagatggggttttaggtggtgaagattataatcacaacaacatcaaccagtggactgcaagcatattggaacaatccttaacacacctggttaagttgggaaaagcctataaatatatttttcaataatgctaaaattagctacaattctgctg

SEQ ID NO: 11566 - DNA, 439 bp, Homo sapiens
  misc_feature 282: y=c or t
  misc_feature 289: r=a or g
  misc_feature 292: k=g or t
  misc_feature 297: r=a or g
agatcacactgacctggcagtgggatggggaggaccaaactcaggacaccgagcttgtggagaccaggccagcaggagatggaaccttccagaagtgggcagctgtggtggtgccttcggagaagagcagagatacacgtgccatgttcagcacgaggggctgccggagcccctcaccctgagatggaagccgtcttcccagcccaccatccccatcgtgggcatcgttgctggcctggctgtcctggctgtcctagctgtcctaggagctatggtggctgytgtgatrtgkaggargaagagctcaggtggaaaaggagggagctactctaaggctgagtggagcgacagtgcccaggggtctgagtctcacagcttgtaaagcctgagacagctgccttgtgtgcgactgagatgcacagctgccttgtgtgcgact

SEQ ID NO: 11567 - DNA, 306 bp, Homo sapiens
  misc_feature 263: s=g or c
taaataagtccaataaagctttgagcaagtttacattaattatgagtcttagaaaagcctgcttagctttaaatttcttacaggcagggactatatattctgtatttctagctaagtacccaaatccaatacaatagtttgcttactgaatgtataacaacatattaattcaatgaagagaaacttttgaaacttttttgacataatttcagattcccatatacctttcacccagattccccaaatattaatgatgtgcgtascacattggctttctcattcttttccctatctccctctcatgct

SEQ ID NO: 11568 - DNA, 339 bp, Homo sapiens
  misc_feature 16: r=a or g
  misc_feature 205: r=a or g
  misc_feature 330: n=a, g, c or t
  misc_feature 337: n=a, g, c or t
  misc_feature 338: r=a or g
taacttagaagtagaragtcgaatacttcatgttctcactcataaatgggagctacataaagtgtacccatgaacatagtgtggaacaaacattggagactcagaagggtgggaggagggtaagggatgagaaagtacctgagggtacagtgtacacttttctggtgttggttgcaggaaaagcctggacttcaccacttcgcartatatccgtgtaacaaaactgcacttgtacgccttatatttatacaaatttaattttttaaaagggaagagagaatcatattaatttctcaccactttttaagtaagcaaacagcagtatttccnagaggcnrg

SEQ ID NO: 11569 - DNA, 153 bp, Homo sapiens
  misc_feature 28: k=g or t
actttgtcccttccctccagttatccckcccccgctataatgtctgtcaaaagcctgtcgatccttcaaatattttctacaaggccatccaccccctacatggtgacactcctgatccctctcaccaactccatgaactttcaccttcttttg

SEQ ID NO: 11570 - DNA, 116 bp, Homo sapiens
attcctaaaagtagaattgtcagtacgtgtatttgtgtgaagcctttgaccgcattgctcttacaaaagccttaccctatcattgtttacccagcagtggacaggggagcaagtgg

SEQ ID NO: 11571 - DNA, 140 bp, Homo sapiens
tttgttgaatacctattatgtgttagactctaaatgttgttaatacttagtgattaaatccccacaacagtcctgtgaaggaggtgatattatccaggtttacagaagagaaaataaaagccttgagaatttaaggagca

SEQ ID NO: 11572 - DNA, 388 bp, Homo sapiens
  misc_feature 372: w=a or t
tccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttatttwccttttctcatggtgg

SEQ ID NO: 11573 - DNA, 356 bp, Homo sapiens
  misc_feature 344: y=c or t
atttttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaaygggcagcggaga

SEQ ID NO: 11574 - DNA, 203 bp, Homo sapiens
  misc_feature 166: r=a or g
agagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagrcccgccgcctgagcagctccgagtctccacagcgcgt

SEQ ID NO: 11575 - DNA, 236 bp, Homo sapiens
cttcctattccaccatcaagaagtggagtttatttcccatcctctcaaatctgagctggattggtaacttactttaaccaacagagaacacagaagtatcgctgttatttctaagcttgggcctcaagagactgcaacttagaccctgaagtactccttcttggaacctagacccatgctgtgaaagccagacgagacatgtggaaaggactggttagaaaagcgacaaccacagc

SEQ ID NO: 11576 - DNA, 515 bp, Homo sapiens
  misc_feature 182: s=g or c
  misc_feature 462: n=a, g, c or t
  misc_feature 468: m=a or c
  misc_feature 512: r=a or g
agtctcgcgataactgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccasggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagccgtaaagcatggccggcccggcatcggggcnacccamtcctcccgcttcatccctctcaagtaatggctcagctaataaargcg

SEQ ID NO: 11577 - DNA, 512 bp, Homo sapiens
  misc_feature 99: s=g or c
  misc_feature 409: y=c or t
  misc_feature 445: s=g or c
aggtccggagggcggggcccgagggcagctgggctctcaggcgctgccggaggagagaaatgccccaggctctccggggcacacaaagcgcaggcgcasgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaaggaaaactggtttgccctgtggctggacgggaccctgggatactaccacgatgagacagcgcaggacgaggaggaccgtgtgctcatccacttcaatgtccgtgacataaagatcggcccagagtgccatgatgtgcagccccyagaggccggagccgagatggcctgctgactgtgaasctacgggaaggcggccgcctgcacctctgtgcggagaccaagatgatgcctagcatggaagacagca

SEQ ID NO: 11578 - DNA, 238 bp, Homo sapiens
  misc_feature 223: y=c or t
gcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcaggccgatcacgcygggggcgctgaggcc

SEQ ID NO: 11579 - DNA, 313 bp, Homo sapiens
attttccctgaggcgcggcgcggggcacacacggttaatcctccgcggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcctcttctgcactgccgtcctccggaagaccttttcccctg

SEQ ID NO: 11580 - DNA, 333 bp, Homo sapiens
  misc_feature 206: r=a or g
  misc_feature 264: m=a or c
caatggttgtaagtagttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgraaagcagtgtaagctagtgacactaaagccagtcttgtattactgtatttttgacagmatggttttgaaaactgtgctacagggactgatgtggcaaatatatctctttatgcagaaggaagtcttt

SEQ ID NO: 11581 - DNA, 365 bp, Homo sapiens
atatacatagagaagtcacttttaaaggctaagaactgaccatttgaaaagtttatgattaagatatggggagaaagtgttcatttttaaagtaataaacaatagcaagtttctcttatcagatttaaggtttaaggaatggtgcttgttcagacctgagtacagtgatgacacaggtactaaatatgttgttggaggtagtataaatctggaacctgtttcaaaagcgctttggcatatttgtgtgtatttccacttctgagagattattctaaggaagtaaccttttttttcttttttggggggagaggaggttattttccttccttaatgacaccctaattgagataattcacataaaaaat

SEQ ID NO: 11582 - DNA, 254 bp, Homo sapiens
attttaaaatggaaattggggcgaggggttggcggctgggcgaagggagcattcaaaagcggagaatgtcactttacccgagaaattcactacgatgggccattggtttctgctcggctcgcaggcgcactgcacgagtggagttttagctttaggtttaattggttcgactgccttctccacaatttgggcgagaatttcctttgccttctcagcaaaagttgttctgcggacccgtctgggtcaactttcat

SEQ ID NO: 11583 - DNA, 279 bp, Homo sapiens
  misc_feature 132: w=a or t
  misc_feature 277: r=a or g
ctctctcccccctgctgtctttgccgacacagtttatatttcctggggcggttgtagcttcgcctgaataggctgtgtataatgaatcttttggatgtcgtcagaggcagggtctgcgtctgtgccttctcwattttaaaagcggagtttggctttgtttttaaagtgctagtcaccagactgcacccttgccagcgcttcgcagctctcgaagtaaattatcgcaggatggcggccctcacctaggagaaccaggaaggcaggcagcgctagaacrac

SEQ ID NO: 11584 - DNA, 181 bp, Homo sapiens
  misc_feature 9: n=a, g, c or t
  misc_feature 16: m=a or c
agaaggcantggcagmaggcagtggcagcaggcagtggcccaggcagaaatagctcccgcgcgattcactggagccttccccgggccctggtcccggctaccgggactcgcgcgtccggatctcaaaagcggcagaggccaccgaaggacaggaagcactttggtccagaccacactcccg

SEQ ID NO: 11585 - DNA, 448 bp, Homo sapiens
  misc_feature 433: k=g or t
tttcagagaccacctgggaaattcctctgaccttagggctttttcaccctgtcattgttactaaacattgaacttgaacatactgactgacagtgtgtgttttggcaggggtggcgcgggcagggggtgcatgccattcttttactacacgtggaggagtatgattgcaaaagcggtgtacccatttatttaaacgggtacgaagtatatatgaaactggatggggacagaatcgggtagttaatgcagctctgtgtcaccaagtccccgctcttggcactttcccatgcacccttcccactctctatccctgtccctccacagctctctctgaacattcactctaggtaacctgaccagatccccacctaaggaaccccgggggctggcttctctgatgacagcagcctcactgtccgacagcagatatggkgccctggagtcgtgc

SEQ ID NO: 11586 - DNA, 359 bp, Homo sapiens
  misc_feature 9: r=a or g
gcctttgcrgccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcctcgtgcttcagcctggagacgaaattgccgttatcccccccattagtggaggatagtgcttttgagccatctaggaaagatatggatgaagttgaagagaaatctaaa

SEQ ID NO: 11587 - DNA, 331 bp, Homo sapiens
ttcagaagttggcatctgtttgactttatttctgctgtgctgctgaaattttaaaaatctttttgtgatcttctaaagacatgaggaaatgggggattgagagaaaggtgatgaggatgagattcccttctgctatgttcttcaacctgtattcttgccaaaattcttctcttcatggactagcaaggaggacaatatggctggtgcagagagagcactgggaagagggatgtaagaggaagtaaaaaaagacaagaggaagccagatcctgtagggacttacaaatcattgtaacgactttgactaataaaagtgagcaagatgggacgg

SEQ ID NO: 11588 - DNA, 702 bp, Homo sapiens
  misc_feature 127: r=a or g
  misc_feature 128: k=g or t
  misc_feature 142: r=a or g
  misc_feature 246: s=g or c
ctaaaatgcattccattcctctgaaagcaaaacaaattcataattgagtgatattaaatagagaggttttcggaagcagatctgtgaatatgaaatacatgtgcatatttcattccccaggcagacrktttttagaaatcartacatgccccaatattggaaagacttgttcttccacggtgactacagtacatgctgaagcgtgccgtttcagccctcatttaattcaatttgtaagtagcgcasagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacacc

SEQ ID NO: 11589 - DNA, 250 bp, Homo sapiens
taatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccacc

SEQ ID NO: 11590 - DNA, 129 bp, Homo sapiens
tggaggcagattgctcagccttaacttctctatccctcagtcttattatctgtaaaatggggataaaattaataatagtttctattccatagggttgttggagtgaggaaacaaaagctaaattaaaac

SEQ ID NO: 11591 - DNA, 304 bp, Homo sapiens
  misc_feature 17: m=a or c
  misc_feature 18: n=a, g, c or t
atggccgtcgtgctcamnggtgggaccatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagac

SEQ ID NO: 11592 - DNA, 253 bp, Homo sapiens
aggagaaacagaaaagctacctggagaggtgacattgacattgaagttgactgagtttctgcagttgtattttttaacctgcaaggccattgacaatgcagaagaacccagatttcaagagaaacagagctagattcagacaacacctccaccaccactactgtctgcatcagtcattattcaacatttgaatcatgctcaaacttgcagacttgacttaaagcttagatgcttcatctccaaaagaagctgg

SEQ ID NO: 11593 - DNA, 339 bp, Homo sapiens
  misc_feature 15: s=g or c
  misc_feature 97: y=c or t
  misc_feature 140: y=c or t
  misc_feature 212: m=a or c
  misc_feature 275: w=a or t
  misc_feature 278: s=g or c
  misc_feature 284: s=g or c
  misc_feature 286: s=g or c
gaaaccggcgcggasaactgaggcccgagccttctcgggacccgggggacgcctaaccccgcgagatgaggaaactgaggccgcgaggagcgcgcayacagcagagaagcagcagaatcgggaatcaaacccagctctgyctgaaccccagagcctgtgcctttaaccactggctaggctgaactgcctttgttcttcactgtccccatcamctctttcaaaactcagcctctccttccctcatcgttacatctctaaggctgcactgctctctwaasattcasasaaacctgcaaattttcttcctcataattgggagaagactcactggccgaatgg

SEQ ID NO: 11594 - DNA, 210 bp, Homo sapiens
gtcaataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttcccccccctttgctctttatatctgacttcttgttgttgttggtgtttttttt

SEQ ID NO: 11595 - DNA, 60 bp, Homo sapiens
  misc_feature 12: n=a, g, c or t
actaaaggttcnacaactaaaagctgaactaaattgaacttctctcacacaaccactgac

SEQ ID NO: 11596 - DNA, 384 bp, Homo sapiens
  misc_feature 128: s=g or c
aaatcctcagcagatttttgttcaagagctgcttccagattggcttctagctgccagtgtgaccttgggcagaaccttcaatgtctgtggggctgtgttttcttatctggcaaatgggaattatgctsttgcctcgggaatgttggaaggtcaaagacagtaagaagtacaaaagctgcagagaatcagtactgcctgcacaagcatgtacaggagagtcccctgtcttatctggagtcagggttctggggatccgcctctcgtgcgtgttatcccatctccaagcctgggactcctgggacaatcagaaggtgtgctacctgggtgcaccctgctttgggaaaaggctgagtccaaccacctggctcactttttgggtgggac

SEQ ID NO: 11597 - DNA, 178 bp, Homo sapiens
ttaaggttgaaaatgtcatggtaagaacatgctttattggctcattaagagaaactacacaaggttgaaaaattttaaagtatctttatactgatttttaaaaaattataacaactttttagatctaggttaacttttttcctagtctcacatatattcaaaagctgccctccaccac

SEQ ID NO: 11598 - DNA, 154 bp, Homo sapiens
  misc_feature 80: y=c or t
acacccgaagcgtccgggaatcttcactttttccgttgctagcagtggaagggtcacagaccaaacactaaggcctgagyggtgacaaccgaggcgagatgatggtcaacagggaatgcctcgtgggagaaaaaagacaattttattctcagcg

SEQ ID NO: 11599 - DNA, 426 bp, Homo sapiens
aggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggaccgaatgatttatatggggtcaggtgctccacaaaatagacctatgagaccaaaaatgaccta

SEQ ID NO: 11600 - DNA, 331 bp, Homo sapiens
aggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgc

SEQ ID NO: 11601 - DNA, 204 bp, Homo sapiens
tctcggagcgtcccggcttctcccgcgcggggggcgagtaagccagcggcaggaccagcgggcgggggcccacgacaaaagctggcaggctgacagaggcggcctcaggacggaccttctggctactgaccgttttgctgtggttttcccggattgtgtgtaggtgtgagatcaaccatgagttccgttgcagttttgacccaa

SEQ ID NO: 11602 - DNA, 357 bp, Homo sapiens
  misc_feature 8: n=a, g, c or t
  misc_feature 41: n=a, g, c or t
  misc_feature 332: r=a or g
  misc_feature 333: m=a or c
aagcgtanctcttctcctttaccaagatggcggcttgtccntgtttcgccacagttcctaccttatgagctcggttttcttatgcttataagagtggaacagcaaaagctggcaggctgacagaggcggcctcaggacggaccttctggctactgaccgttttgctgtggttttcccggattgtgtgtaggtgtgagatcaaccatgagttccgttgcagttttgacccaagagagttttgctgaacaccgaagtgggctggttccgcaacaaatcaaagttgccactctaaaattcagaagaggagagcgaccctccaacctacaaggatrmcttccctccacttcctgagaaagc

SEQ ID NO: 11603 - DNA, 453 bp, Homo sapiens
  misc_feature 179: s=g or c
  misc_feature 184: r=a or g
  misc_feature 359: n=a, g, c or t
  misc_feature 360: n=a, g, c or t
  misc_feature 420: n=a, g, c or t
  misc_feature 421: n=a, g, c or t
cgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaacaaaagstgccrggaaaagaggatatctcccctcaaggagctcacagtctacttggggagataaggcatgcttgcaattagctgctaaaatacaagataacaacaacaaatacaagataatactaagtaataggctcatttaaaggggtacaggtaaagtctagagcaagggaggatgacttccatnngaagaaaaggataagacctcatgataatgtgccatttgaaaagggtatcctcccctgggnnctttccagagtccctcaagtcaaccctcactt

SEQ ID NO: 11604 - DNA, 189 bp, Homo sapiens
atttttttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctggtgagttagaactaggacgcgg

SEQ ID NO: 11605 - DNA, 382 bp, Homo sapiens
  misc_feature 317: k=g or t
  misc_feature 328: n=a, g, c or t
  misc_feature 329: n=a, g, c or t
  misc_feature 330: n=a, g, c or t
  misc_feature 331: k=g or t
  misc_feature 379: n=a, g, c or t
atttttttcgtcttagccacgcagaagtcgcgtgtctagtttgtttcgacgccggaccgcgtaagagacgatgatgttgggcacggaaggtggagagggattcgtggtgaaggtccggggcttgccctggtcttgcctcggccgatgaagtgcagaggtttttttctgactgcaaaattcaaaatagggctcgtataaaattacgttatttacttcataaaggtcttacacatttttgttcagtttgttcctaggtagttgattttttaaaatgtttttgtaagtggtatcatttttaaattttattttctattttktttcttttgannnkagggtcttgccctgtcacccaggctggagtgcagtggtgcaatcatgnctc

SEQ ID NO: 11606 - DNA, 230 bp, Homo sapiens
  misc_feature 197: s=g or c
  misc_feature 213: s=g or c
atttttttcgtcttagccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagasgtttttttctggtgasttagaactaggacgcgg

SEQ ID NO: 11607 - DNA, 321 bp, Homo sapiens
aaagctgcgtagtgctgaacattaagctttctgggccactggaacaaagaactaggatctcacaggaaaagctgggtaactcaagcagctattctttctgtagggaccagaacacgagaatttgaagagcatggcaaagccctttctctcccaagccccaggcagagtacaagctcatttttctcggtggttattctgatatcccattttggtgtgtcataatacttcaaactggaaagtcacctggtcgagtctagggaggagggagtggaagggtctctgcttctgtacaaaatctccaggatttacaaaaatgtaacc

SEQ ID NO: 11608 - DNA, 172 bp, Homo sapiens
cccttttccggtcggcgtggtcttgcgagtggagtgtccgctgtgcccgggcctgcaccatgagcgtcccggccttcatcgacatcagtgaagaagatcaggttagaaaatggatttctgactggaatctcaccactgaaaaaaagcacacccttttaagactactttatga

SEQ ID NO: 11609 - DNA, 449 bp, Homo sapiens
  misc_feature 131: n=a, g, c or t
  misc_feature 243: n=a, g, c or t
  misc_feature 432: n=a, g, c or t
  misc_feature 433: n=a, g, c or t
  misc_feature 446: n=a, g, c or t
tttattatatataataaagtagttgcaccagtaatgtttagactttctctctcttcttcctggatctttaggagcaattaagccaatgagaaatcagacccacaccccaattctgatgtaacagccttggnaaagaggttgcagtgaaaagctggtcctgctgtggtggagagaatggaggaaagataataaaaggccaaacctttgctccaactttctccttagcttccctttggatctggnaaagctggggacccacacggcagagccatggtactggaggagccattaacaaagctttcaataaacctctctttcttgaagttacctgagaatggatccattccctgcaactgaagattctaaggaactgggtttctcagtatacaatgggaatggttgggaggaggtaaagagtagaagacagtatcnngaatccagagccnagc

SEQ ID NO: 11610 - DNA, 286 bp, Homo sapiens
agtgtgccatgggatctgtgtttcctggtcttttcatggtttttacatctttggcggagttaaggccagttattttgtctaatgtccctcagtttgtgtttgatactttctcatgattagactcagattagacagttttgatggcaatacagaggagatgccattttcttgctgcatcacatcaggtggtacttaatgtcagcttgtaccattactactgatgttaactgatcacttggttaagatggtatttttcagtcacccacaaaagctgtatataatgcca

SEQ ID NO: 11611 - DNA, 401 bp, Homo sapiens
gtattccaggcgcctgcaactaaacgtggccgggtctgcaagctaggtgccagcggggaaagtttccctgcttcttatcgtctgctttaacgccttaaatagcccgctgaaggctgcagcaggtgctaggtagcagcctcccggccctcgggaaaggcggggtggggaggcgagagcagcttagcctcctcgacctcccttcctggtgacggacgaacagttcccgtagaatttcgcttcaccgagtgaccttgagcccagggcgacggtcagcttgttaattcctggctgcaggaactttgtgagaattttaatgcatggaaaagctgtccatgttccaactgctgtacatccaaaagtctcagtgtaatagcaggaccaaaatattctgtcaatcagct

SEQ ID NO: 11612 - DNA, 341 bp, Homo sapiens
  misc_feature 31: s=g or c
  misc_feature 298: n=a, g, c or t
  misc_feature 300: k=g or t
  misc_feature 301: r=a or g
acttccggcagcaggtggtggggccatggcscttctccgagctgtgcgtaggtttcggggaaaagctgtgtgggaaaggcctctccatgggctgtggtgctgcagtgggcaggaggatcctaaggagagtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacntkrtactcccagggcctcctcactctcaacaccgtgtgcctca

SEQ ID NO: 11613 - DNA, 491 bp, Homo sapiens
agcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaagacccatacatcacaggtgtattacctgactgcttaaccgatgctctgatgtggtcagtgacc

SEQ ID NO: 11614 - DNA, 366 bp, Homo sapiens
  misc_feature 10: s=g or c
  misc_feature 31: m=a or c
gctgtctatsccggctgaggacccgcggccmtgcgggtggctggctttaccattagcgggggcctttcctgaggacggcgtacggagtgtggggaatgaaggatggcagcatgccgtgcattaaaagctgttttggtagatctcagtgggcacacttcacattgaagatgcagctgtgccaggcgcacaggaagctcttaaaaggttacgtggtgcttctgtaatcattaggtttgtgaccaatacaaccaaagagagcaagcaagacctgttagaaaggttgagaaaattggaatttgatatctctgaagatgaaatattcacatctctgactgcagccagaacgtttactagagcggaaacaag

SEQ ID NO: 11615 - DNA, 374 bp, Homo sapiens
  misc_feature 342: k=g or t
  misc_feature 350: w=a or t
agctgtcttcttcactacggtaaatgcattacgatggctgcactctcctgtaaaggttcaggtagaggaaggtgtaggatgaagtccggacaccatcatttgggtttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattatggctcatgcagcctcacaattaaagaaaaacagggatttagaaatcaatgctgaagaagakcctgagawaaaaaggaaacaccgcaaacggtc

SEQ ID NO: 11616 - DNA, 367 bp, Homo sapiens
tggtcaagtgaagaagcgcatacggtggatgccttggcagtcagaggcgatgaaagacgtggtagcctgcgaaaagcttcggggagtcggcaaacagactttgatccggagatgtctgaatgggggaacccagccatcataagatggttaccttacactgaatacataggtgtaaggggcgaaccaggggaactgaaacatctaagtaccctgaggaaaagaaatcaaccgagattcccttagtagtggcgagcgaacggggactagcccttaagtggctttgagattagcggaacgtctggaaagtgcggccatagtgggtgatagccctgtacgcgaaaatctcttaatcatgaaatcgagtagg

SEQ ID NO: 11617 - DNA, 321 bp, Homo sapiens
  misc_feature 269: k=g or t
atatagataaaggctgtcctctagtgtaaagctgtgaaaactacagctaatccacagttttcttttgtttaatttcttttctttttaaattacttttcttcaaaattaaaactgtagaagaacctggttcttcccccaaaattttttttaaaagcttctgcctcatcacaaaattctccaccctgccatactctgtggaaccagggactcatagcatttgtgggactggagttgatgttttctgagcagttttctgtcctgagcttcckcattatgttgcagtgaaagggatggtatgggtaaaattctggatttacttgc

SEQ ID NO: 11618 - DNA, 185 bp, Homo sapiens
  misc_feature 147: w=a or t
  misc_feature 149: n=a, g, c or t
  misc_feature 171: m=a or c
  misc_feature 174: m=a or c
  misc_feature 181: m=a or c
  misc_feature 182: y=c or t
  misc_feature 185: m=a or c
acacgcacgccggcgtgccagtttataaagggagagagcaagcagcgagtcttgaagctctgtttggtgctttggatccatttccatcggtccttacagccgctcgtcagactccagcagccaagatggtgaagcagatcgagagcwanggatgttgcttcagagtgtgamgtmaaatgcmygcm

SEQ ID NO: 11619 - DNA, 243 bp, Homo sapiens
  misc_feature 113: m=a or c
  misc_feature 160: m=a or c
  misc_feature 232: n=a, g, c or t
  misc_feature 233: n=a, g, c or t
  misc_feature 234: n=a, g, c or t
tggaagattttacaaattctcagaaacacctggaaataatttaggaaaagcttttgactctaggctcatagatagagactgtacatgaagaataattaatagcaattactttmttgtctttagtctttcgtcagatttgtttctttgaaaagagcaaggmaggttaaaataatctgtataatataaattgcccatgcaatgcaggtcagtttgttttatgcaggtagcagtnnnacgaacttg

SEQ ID NO: 11620 - DNA, 441 bp, Homo sapiens
  misc_feature 45: s=g or c
cccccccccgcgcatggggaggtaggctcggaccggcccgcggastgctgcagtccttcgcgccctcctcgccctccccaccgacatcatgctccagttcctgcttggatttacactgggcaacgtggttggaatgtatctggctcagaactatgatataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcaccatctccccaa

SEQ ID NO: 11621 - DNA, 180 bp, Homo sapiens
cagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccga

SEQ ID NO: 11622 - DNA, 629 bp, Homo sapiens
cagagaggtaggcagataagccaacgtgaagagatggattcagcaaagctctctcaggccgccgagggattgtgaggctggctttggattccatgaagtggatgccatgaagagctgtcaattgttggttttggatgagggactactttctgattggaaaataaaggaccccttttttccgtcctaatggcagtactgtcttcagacagaacaagatatgtgttcttgtggagaagaaagaattgggcagaattttcaaaaataattactttaactgcctttaaaaaaaaactaaatttatctaactttaatgcagtagcgctctgaaaactattttccgtttgtttttactacttgtagacacctcagtggaccagtttttggtccctttggatgcatgttataaatttcataggaaaaggaaaattatagggaggtttacttagataagggatgaaaattcatgtcttttttttaagttgaaatcattttgagttgtatgaaagacaatggtgttaccaaatttttcccagaaagactaaatgctttttcttctttgccagtcttcagggttctgccttagctctgcttcaccagggtttataatatatctagcttttaagttgctg

SEQ ID NO: 11623 - DNA, 201 bp, Homo sapiens
  misc_feature 8: n=a, g, c or t
tatatgantaatagaaaatagtccaacttttaacaacatgagctgaaactaaaccaaagtactcttctttccaagtcatgaaaaggaaaccttaaatatatttccaagaaatcctgaccatagtctgtagatctgtttttaaaatattttccgctatcttcatttctaagtttcaatattcctagatttggtagtttgaga

SEQ ID NO: 11624 - DNA, 161 bp, Homo sapiens
tacctgctttgcaaaaattacaatggagtaactatttttaaagcttatttttcaattcataaaaaagacatttattttcagtcaaatggatgatgtctccctcttttcccctattctcaatgtttgcttgaatcttttatattttttttaattctccccca

SEQ ID NO: 11625 - DNA, 302 bp, Homo sapiens
  misc_feature 2: d=a or g or t
  misc_feature 6: y=c or t
  misc_feature 7: n=a, g, c or t
  misc_feature 8: s=g or c
  misc_feature 119: m=a or c
  misc_feature 138: w=a or t
adgtgynsagcgtgtgctttagtttcgtgggaggcctggcatccccgagagggaggggaaaggtaaccactcctttgtggaggtcgccagggtcattgtcgtggatttgcacagtcggmtgggcggtgcaatggcggwgagtttgagcgagaagaatccgcaggggccctggagccggactggccagtctctaggggctctccatgtgctgtcctgaagggaaagtccttttctaaaagagagccacgcttaaggcgtgcctttcgtagagactttgctttttcttgctagtttatgaacca

SEQ ID NO: 11626 - DNA, 298 bp, Homo sapiens
gtagttagtaaggagccggatgattgcctcagcaggtgtgaagcgtgtgctttagtttcgtgggaggcctggcatccccgagagggaggggaaaggaaagaaaaggaacagccaaagtggactttttgaagaagattgagaaagaaatccaacagaaatgggatactgagagagtgtttgaggtcaatgcatctaatttagagaaacagaccagcaagggcaagtattttgtaaccttcccatatccatatatgaatggacgccttcatttgggacacacgttttctttatccaaatg

SEQ ID NO: 11627 - DNA, 386 bp, Homo sapiens
gacttccctctagaatcctccaacatggagcctcttgcagcttacccgctaaaatgttccgggcccagagcaaagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaactgc

SEQ ID NO: 11628 - DNA, 148 bp, Homo sapiens
cccgcctcaaaggaagaagagtccaccttgcgaccgtatccgctagcgcggcctgggatgcgcttgggctccctggtgaaaaagcaaaatataaaattcgattcaaactgtgattacatctatggaaaatacagcctttgccgaccac

SEQ ID NO: 11629 - DNA, 250 bp, Homo sapiens
  misc_feature 105: m=a or c
  misc_feature 106: n=a, g, c or t
  misc_feature 109: r=a or g
agggggcgggctctctgacgaaggactggaaggtggcggtggtgaaggtgcaggccgttggggcggctcagaggcaggtgactatgaaaggcttatatttccaamnagrgttccacagatgaagaaataacatttgtatttcaagaaaaggaagatcttcctgttacagaggataactttgtgaaacttcaagttaaagcttgtgctctgagccagataaatacaaaggtattggttcttttattatggc

SEQ ID NO: 11630 - DNA, 254 bp, Homo sapiens
  misc_feature 69: r=a or g
atggtctcgatctcctgatctcatgatcttcccgcctcggcctcccaaagtgttgagattacaggcgtragcaccacacccggccccactggtgtctttataagaggaaatctggagacacaaagaggcactggggtgtgtgtgcagagaggaaagggcatgaagacacagtgagaagccggatgtctgcaagtctaaaaggaaggcctctgggaacccaacaccttgctgacacactgatcgtggacttccag

SEQ ID NO: 11631 - DNA, 367 bp, Homo sapiens
cctcaggcgatgtctgtctcgaagctctcaggttagaagaaaaggaagtacggcatcataggattttagaggcgaaatcgatacagacttcccccacggaagagggcggggtgctgacactgcctcctgtggatgggctgccagggcgtcctccatgcccccctggggctgaaagtggacctcagacaaagttctgttcagagatttctttgattgtgtctccaaggcgaatatcagtccagctcgacagccatcagcccacacagagcatctcacagcctccaccacctccatcccttctgtggtctgctgggcaaggacagcctgggtcacagccgccccattctatttctaccgagtttcaaac

SEQ ID NO: 11632 - DNA, 352 bp, Homo sapiens
  misc_feature 335: n=a, g, c or t
aaaaaagaccaggtgcatatccagatgtaatcaaacctgtaaaaacacttaatggtttttgcatattaatggattgattaaacatttatggagttggtgtctactctgcttttaacattgctctttgacaaaccatatgaagtgttgccatcccatgttttgggataagaaagctaaggctcttagagattaagtaattggtctgaggttttacagctaatgaatgaggctgtgattcttggcagatgaggtcagagaaaccagcagggcccggatcacatgaacctcatatgccactggagaattttaagctcctatccaccagctgtaaaacntcagaccaattacttaa

SEQ ID NO: 11633 - DNA, 223 bp, Homo sapiens
  misc_feature 13: s=g or c
  misc_feature 220: n=a, g, c or t
  misc_feature 221: n=a, g, c or t
ctatgagatgtastgtgcaaactaattccaattagcacattttgagaacccaaaaggatgttgtgacttaaagatgatgagaatttaagtgtaaagaagactacacttctttatgctgtgaaattttcatagaaattttggatctggaaggattttgttctaagactagttttagcttagtgataaaaggaataggatgacattggtagtgagcgaaggnnag

SEQ ID NO: 11634 - DNA, 174 bp, Homo sapiens
cacctatctgttttgcctgccatcattccttcgctttaataaggtcatttctgacctggttgaaaaggaatataagccgtgttaattttcagggtttaccaatgttgactatctataccttcacctacagtggagaagcggtgataaataggagtaacagttacccaagtttcc

SEQ ID NO: 11635 - DNA, 479 bp, Homo sapiens
  misc_feature 96: s=g or c
acggaactcggctgcggctccatggtctgagttgtcagccgttgttttttcgtgctcgctagtcgccgccgccgctccgccatggggaagcgacasaccaaaaggacaaaatgtacattacctgtgctgaatacactcacttttatggtggcaagaagccaggtaaggcatgcagtctttctgttccccgttgggggagtggtattaaggaactgtgtcttcaggatacagtgagctgtaaaaatagacaacaagaacacggaaactatggtagacgaatgggctgaggacacagttcatgaaagagaaatatactcaagatagaagaacctgcttcatcttagtggtgatttttgtaaaatgtaatttaaaatattccccgatgctggggtcgcccggggctttgttcttgcgatagtttactgagaatgatggtttccaatttcatccatgtccctacaaaggatatgaactcatca

SEQ ID NO: 11636 - DNA, 438 bp, Homo sapiens
  misc_feature 207: r=a or g
  misc_feature 326: m=a or c
  misc_feature 339: r=a or g
  misc_feature 372: m=a or c
  misc_feature 373: m=a or c
  misc_feature 377: n=a, g, c or t
  misc_feature 385: r=a or g
agttcccagaaattaccatgttaaggtttgtttgtttatttagctcatctcaaaaagatgacaaagtcaactagatacttttccttgttctacaatttcagcctagattaactggtttgttcagttatgagctccacatcataacctctcagcagagcccagccgagatcctggtacacagcactcagtcaaggattatcctttgarttaattcattctccaccctgacctttcttcacattacagaatgttctcctgggcagcgttgtgatctttgccaccttcgtgactttatgcaatgcatcatgctatttcatacctaatgmgggagttccaggrgattcaaccaggaaatgcatggatctcaaaggmmacanacacccartaaactcggagtggcagactgacaactgtgagacatgcacttgctacgaaaca

SEQ ID NO: 11637 - DNA, 450 bp, Homo sapiens
  misc_feature 161: s=g or c
  misc_feature 172: n=a, g, c or t
aagattgattgtgatcatttgacttgtcccatttcctgctctgactactttctttaataaatagaagctgggaaaataataaacagagctgtggaacatatctttgggcatggagtgttggaaaaggaccttcttgagggtataagggccgtctttttctsaaatgcgagcncttcttgaaaatctcacctgaggctgtgcatggtgtctcacgcccataatcccagcactttgggagaccaagatccaaaaagttggcagctcttgcagaagccttaaaggaagtctcccttacaaaggcccagctggggtttagaactggaagaactagaagcagcagcactgcttgtccaggaggaagaaactgcattaaaagcagcccattcagtttctgggcagcagacactttgctccagctctgaggcaagtgattcggaggactcagacagc

SEQ ID NO: 11638 - DNA, 857 bp, Homo sapiens
  misc_feature 723: w=a or t
  misc_feature 724: k=g or t
  misc_feature 789: n=a, g, c or t
ctccagtagcaatgttgccatattatttatttcccaaacttagtggacaatggagtcatttctacctagagtaccagtaaacatctcccagtgtgctatagtagaaaatgtctactcctcactgctgacatgttaaacttactcttggtttagagcatgtgtagaaacacctaaggtagctctatgctaaataatgaagagtagcacaagaatgaatgtatttgctgatacgttgctcacattctcaagcaaaaattcaactgcattaaccgatctgagagttttcctttaacctggactgtgtttctcaagcacattttttctttgttcactgcccaaggactagaactgtatttttaaggttgttttcccctaaaaggacctttagtaagcaaatttattattaaatgtgcacatcttattcacccaagggaataaaagctacttcgtaatgttgttactaaattttatcttgaaaataaataacagtgtttgaggacagaagaaactaggactgttgttgagataaaatctgttttcagcctgactgctttagtcactggacgagcatcagctactgcggtgtcagatcacttctcgagtagaggtctgcctagtgagtgagcaggagaacatcatcttaatagcctttggctcacccagagtcagggagagatgaaaataataggtcagaatgcaagtgacttaatcacagtcttcctwkaattatctgtttatgttgcatgaatgcataagaaaaaaattctgtcatgttcccaaggtagaatngtaataagcatgtgccagtgtgaaagctggaaggaaaaaagctattctctaacaggagacataaagat

SEQ ID NO: 11639 - DNA, 204 bp, Homo sapiens
aaaaggacgctagctgttgcacctgttcctccctgcgcgtaacttcctataagactgttttctctgattgacttctggtggcttggcttcattatgatgtgtttatgttcacagaaatttttgtaatttctctatggtaacaactttttatgccttaggagtgtctctgaggcaggattctaagagattctctttgactcaatg

SEQ ID NO: 11640 - DNA, 454 bp, Homo sapiens
  misc_feature 266: n=a, g, c or t
  misc_feature 307: s=g or c
gaagtcggtgtttggagaaaaggactcaggtgaggactggaggtaggatgaagcggaataatggtttccggagcgtgggaacgggccggaagtgactagagcaaatgttaagcggggggcaaagggtgcggggcacgaaaggtgtccttcactcacttccagaagcggtgatgggcagagaatcagcaatctaccagacgctccttgggccttcaagggaagggaatttgcgtggcctgctccaggcaaactgaaaaataggtganatctgcggaagcgggggttcagccctttctctcctgtagcscctccctgctttcaaccgccgagtctctcccagcctagggaagagtctgggtcttgtgtgtcactccttagtgtgacacgctttaatatgttgaaaaatctcaggagttttcaaatttaaagtgaagccgtacggaaaagaacctgc

SEQ ID NO: 11641 - DNA, 483 bp, Homo sapiens
  misc_feature 279: w=a or t
  misc_feature 280: n=a, g, c or t
  misc_feature 281: n=a, g, c or t
  misc_feature 282: n=a, g, c or t
  misc_feature 416: k=g or t
atctctcctctctgttcttcgacctctgggagtgaatcctacccttcccgtgtactgaagatccagcgtttagttctcctttgatttcctctccctctggccacccctgcccccaatcgtaaaaggggtcagtctgctcaggcctgctttgatgggaccccgaaggccaggaaggaactggtcctgggttttctaagagctgggggcggatggaattctcctgcctgcgggtctttaaagactgagacccgggaaaaggagaagatgaaggaagccaawnnntgcccgctataccaatgggcacctcttcaccaccatttcagtttcaggcatgaccatgtgctatgcctgtaacaagagcatcacagccaaggaagccctcatctgcccaacaacagaaagcggccctgctgaakaacaacaccgccttgcagtccgtttctcttcgaagtaagacaaccatccgggagcggccaagctcgg

SEQ ID NO: 11642 - DNA, 403 bp, Homo sapiens
  misc_feature 13: k=g or t
  misc_feature 386: w=a or t
aacactcacacakagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctcccccwccaacccgcgtccccca

SEQ ID NO: 11643 - DNA, 541 bp, Homo sapiens
  misc_feature 13: k=g or t
  misc_feature 342: n=a, g, c or t
aacactcacacakagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaaagcctgtactaggttacncggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacgactactggttatattccagaggtgtgtgcag

SEQ ID NO: 11644 - DNA, 669 bp, Homo sapiens
ttgctgcagtactatgtcatattattagtatgaatctcatttcccaaagggtttgtattctgctaaaaggagatgccaatgttgaatgaagtctgaaactctagtatgtgcatagtttgacgtgcagcatgcacaccaggccttaagatgggaatgtagcttaatgattttctgtttcccataccatttctaatcttttgtgtaattttctcttaactgattgctctgatattgtaaacacaatagatgtagctctatcatgtctagcataatttaaaaaatcagtgtttttaggatttgggaaaataaactgtaaatgtttatttgataggtaaatatagttttattgtcacatgctaaatattgcatgcatattgactaattggaataaccatttactcaattatggacagcttattgaaatagtattgatttagaaaaagtatattgcatttctaaaaaacatctaccaaggttactcgtctgaatattgcttttagccgtgttttataacatagacgagcagtagggtctgtttattagcaaatttcctatttgttccaatacaaactcactttattctaaagtatattaatgaaaccagttcctgtgatgtaactgtaagccttctcgacttagacttaaaaagtggtcacatagattaatttt

SEQ ID NO: 11645 - DNA, 136 bp, Homo sapiens
ctagtatttcttcactgtacattgagacacagcacactgcacaccaaagatgcaatacccaaaggaaactgtgtgatttctcctgacaaatgatgggagcctttctttatgagatactcgaaaaggagattttgag

SEQ ID NO: 11646 - DNA, 277 bp, Homo sapiens
  misc_feature 106: m=a or c
  misc_feature 107: w=a or t
  misc_feature 116: r=a or g
agacagagaatgttctaacgctgggggcggctgcggatgaagtccttggggagaaaaggagcaggccaagggcgatggtggagtagagctgcctctcagaggcagmwtgagctgaragggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagata

SEQ ID NO: 11647 - DNA, 183 bp, Homo sapiens
aaggcacagacaccaaggacagagacgctggctaggccgccctccccactgttaccaacatgaagctgctcgcagcaactgtgctactcctcagccagcaaagtttctggatacaagattaatgtacacaaatcagaagctcttctatacaccaacagtgaccaagcagagaatcaaataaaa

SEQ ID NO: 11648 - DNA, 470 bp, Homo sapiens
ataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccc

SEQ ID NO: 11649 - DNA, 164 bp, Homo sapiens
atgtgatcctggggaagacagactgcgggtggagggcagtgctgaaaaggagcctctggaagagagggccttctcccgcttctctcctcctcctctccacgctggggggatcctggtcacctctgacaaaattctggggacgctgggaacactgaatcaacatg

SEQ ID NO: 11650 - DNA, 319 bp, Homo sapiens
atttattatagtaattctttattaatgatcaattattgtaatgggagtgggagggcaggttgtggacaaacatcaggcaagcatgtatctgccttcagctagatccaatccatgacccacaagagacccttccctgaagcagttgccaggtggcctccttgccaccctctcagaaatgaccaaaatatatacattcccctctgtcctgggccaaatcttgctaaaaggagctctctttttagaggttttgtttatcagggtatcacacttaactgtcgtggataatcttttcctccagagagtatagatgtttaaagga

SEQ ID NO: 11651 - DNA, 115 bp, Homo sapiens
atgtaatagtctacgcaagagactgggcttgagctagggcagtaggtatggaaaaggaggaaagacattcaaggatattctggagacagaatgaagaaggttgctgagagtaggg

SEQ ID NO: 11652 - DNA, 219 bp, Homo sapiens
  misc_feature 176: n=a, g, c or t
aatctgactaataacaaactgagctaacaagaaatactagaaaaggaggaaggagaacattgctgcagcttggatctacaacctaagaaagcaagagtgatcaatctcagctctgttaaacatcttgtttacttactgcattcagcagcttgcaaatggttaactatatgcaaaanagtcagcatagctgtgaagtatgccgtgaattttaattgaggg

SEQ ID NO: 11653 - DNA, 185 bp, Homo sapiens
agaaagaaaaaaagagagacagttaaaagagaccaaggaataggaataaggatgttgttggtaggttgtaaaaggaggaattaatcaattgtaatttactaaagtgtgagcaaattaagacaaatgaagggaagcccagagtgaactaatttcccttgacctaccatgtgaaggtatctacaccc

SEQ ID NO: 11654 - DNA, 272 bp, Homo sapiens
  misc_feature 144: y=c or t
gcttctctgtggtcttgacaagcgctgcctgggctccgccggctcactaataactgagtgaccttttctttggctgtattatgtctggctgggaagggattgcattttgcagctgagagccggagcttccttcagctcggctcytcgcacgctgctggggtaagttgtcttgaaccaggacggagagagacagcctcggactgcagttgcctaaaaggaggacacctgtggctcagatgcggtcaacaccattgcttggcgtatccttgagg

SEQ ID NO: 11655 - DNA, 439 bp, Homo sapiens
  misc_feature 280: r=a or g
  misc_feature 333: n=a, g, c or t
  misc_feature 342: n=a, g, c or t
  misc_feature 364: s=g or c
  misc_feature 377: m=a or c
  misc_feature 381: s=g or c
  misc_feature 382: s=g or c
  misc_feature 397: n=a, g, c or t
  misc_feature 399: s=g or c
  misc_feature 412: s=g or c
  misc_feature 417: s=g or c
  misc_feature 418: m=a or c
  misc_feature 424: m=a or c
  misc_feature 432: m=a or c
  misc_feature 436: k=g or t
gacgtagatctcatgtgaccaggagtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagrgaggtagacagatacaagatgaaatcctgtcaaaaaatggaaggaaaaccagnaaatgagantgaaccaaagcatgaggaagascaaagcctgaggmaaasscagaagaggaggagnasctagaggaggagscaaasmaaaggmcttttagmgaakgct

SEQ ID NO: 11656 - DNA, 453 bp, Homo sapiens
  misc_feature 340: n=a, g, c or t
aggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaacnaggaagcagaaggaaaccccagaggagggccgaatcagcctggccagggatttaaagaggacacacccgttaggcatttggaccctgaagaaatgataagaggagtagatgag

SEQ ID NO: 11657 - DNA, 92 bp, Homo sapiens
tcgcgctcgggagctggcgaggcggcggcggctcctcaggtcagtttgaaaaggaggatcgagctcactgtggagtatccatggagatgcgg

SEQ ID NO: 11658 - DNA, 297 bp, Homo sapiens
  misc_feature 293: w=a or t
ccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgwattg

SEQ ID NO: 11659 - DNA, 182 bp, Homo sapiens
  misc_feature 161: n=a, g, c or t
cagttggaggcaggcgctcgctgaggcaaaaggaggcgctcggcccgcggcctgacagggacttagcccgcagagatcgaccccgcgcgcgtgaccccacacccacccactcatccatctatccactccccgcgccgcctcctcccaccctgagcagagcngccgaggatgataaacaccca

SEQ ID NO: 11660 - DNA, 448 bp, Homo sapiens
  misc_feature 29: s=g or c
gagagcggttcttgccgcatcctgcgcasccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggacccccttctgtcagctgtggggcttgacactacttgaacaagaaaaggagggggaaactgcaccacataagtgaagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactg

SEQ ID NO: 11661 - DNA, 511 bp, Homo sapiens
atcgcggggaaagcagtggctccaagtgagccagaggagagctgaggagaggagggggaggccgacgacctgggccctgggcctctgaaggtctggcgtattctgacaggacacagtgagcgtctgtagaggagaggcttgaaataaaggagcacgaatattgcctggatttctggaggcctactttaaggctggccaattctgcaagaaaggcaaggaggaggagactggctcacagctctggaggacccccttctgtcagctgtggggcttgacaccacttgaacaagaaaaggagggggaaactgcaccacatcagtgaagatccacctccagtggctgctctgctggtggtggagttgctgctgacaaccaccctcaacgggtctgcacccatccaggaaatatctgtcttcctttagcttggttgtacctgttctcactctatctgtattattgaattattgactgagactgtgtttgggaaggaggctgagtgactactggactg

SEQ ID NO: 11662 - DNA, 133 bp, Homo sapiens
ttgaccccattggccattgcctggctaatgagaacccctggttctcagaattttaaccaaaaggagttggctccaaccaatgggagccttcccctcacttcttagaatcctcctgcaagagggcaactccagc

SEQ ID NO: 11663 - DNA, 259 bp, Homo sapiens
  misc_feature 92: m=a or c
atagggaggcggctgaacaaggttgtgggggtaggaagctagggttagaggcaacccgtgaggctagaaccccgaacgtggtcggttggagmaaatatgtccctccggaggcacattgggaaccctgagtatctgatgaaaaggataccacagaacccaagataccagcatatcaaatcaagactggacactggtgagtaaagattagaaaattagaattaaaaaaaatctaatagctaattattgacagaaagcaacc

SEQ ID NO: 11664 - DNA, 295 bp, Homo sapiens
  misc_feature 46: s=g or c
  misc_feature 54: r=a or g
  misc_feature 82: m=a or c
  misc_feature 167: m=a or c
  misc_feature 168: s=g or c
  misc_feature 202: r=a or g
  misc_feature 213: w=a or t
  misc_feature 269: w=a or t
cactgctgcagatgacaagcagccttatgaaaagaaggctgcgaastgaaggaraaatacgaaaaggatattgctgcatatmgagctaaaggaaagcctgatgcagcaaaaaagggagttgtcaaggctgaaaaaagcaagaaaaagaaggaagaggaggaagatgmsgaagatgaagaggatgaggaggaggaggaagatraagaagatgawgatgaagaagaagatgatgatgatgaataagttggttctagcgcagtttttttttwcttgtctataaagcatttaacccccc

SEQ ID NO: 11665 - DNA, 434 bp, Homo sapiens
attggggatactgcaaagaaattgggtgaaatgtggtctgagcagtcagccaaagataaacaaccatatgaacagaaagcagctaagctaaaggagaaatatgaaaaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatg

SEQ ID NO: 11666 - DNA, 103 bp, Homo sapiens
attttgcaacgccataggcttccagcgactgctggtgatgtttctgatgccgacaaaaggatcaaggtggcgaacccgtggtggagatggatggtgatgagat

SEQ ID NO: 11667 - DNA, 214 bp, Homo sapiens
ctttcggaagccgcttagttcgcagtacaaaatggatctgtacatcaaaaggatggattaaacgatgatgattttgaaccttacttgagtccacaggcaaggcccaataatgcatatactgccatgtcagattcctacttacccagttactacagtccctccattggcttctcctattctttgggtgaagctgcttggtctacggggggtgaca

SEQ ID NO: 11668 - DNA, 246 bp, Homo sapiens
  misc_feature 111: n=a, g, c or t
ctttcggaagccgcttagttcgcaggtgccgcacacttaagtattttgaccctttcgtacaaaatggatctgtacatcaaaaggatggattaaacgatgatgattttgaancttacttgagtccacaggcaaggcccaataatgcatatactgccatgtcagattcctacttacccagttactacagtccctccattggcttctcctattctttgggtgaagctgcttggtctacggggggtgaca

SEQ ID NO: 11669 - DNA, 394 bp, Homo sapiens
aaaaaggatgtacagaggatccccaaccgcctgcgaaacccaagccgccgcgtaggagcgtgcgttcgggccctcttctcccacctgttcgactccccatccccaggatgtcaacctcagtccctcaaggccatacctggacccaacgggtgaagaaagacgatgaggaggaggacccgctggaccagctgatctcccgctctggctgtgctgcctcccactttgcagtgcaggagtgcatggcccagcaccaggactggcggcaatgccagccacaggtgcaggcgttcaaggattgcatgagtgaacagcaggcgaggcggcaagaggagctgcagaggaggcaagaacaagccggtgcccaccactgagaccccaaaccacctatccccag

SEQ ID NO: 11670 - DNA, 180 bp, Homo sapiens
attgcaggattaggagaaaaggatgttttcgacgctcatagtttggcttttaaaggtgtttatctttgggtttaatccatcacaacttctctgctaaatttaaaggtatctttgaaacattgaattgtcaattccatttgctttgtaaggaatcaaaatttagctctaagaataatcagg

SEQ ID NO: 11671 - DNA, 345 bp, Homo sapiens
taattaaggaaaatttgtataaatatttttaaatctcctaccaccttcaaaagctgcaaaccagagtaagctttatcaaactttaaggaccagttaattctcattttacactaattataccattagtttagaaaaagatgggaagatactcaactcatttatttgataaggctagcataatgctgatgccaaatagtaagaagtttcacaaaactatggacccaattcactttataaatacagaggcaaaaattctaaaaatgttagcaggttgatgcagccatctgttaaaaggattataagatatcatagccaagtaaggtttttccaagaatgttaggatag

SEQ ID NO: 11672 - DNA, 318 bp, Homo sapiens
  misc_feature 2: y=c or t
cycttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggaggagtcgagccgagctgatttgatcgaggagcgcggttaccggacgggctgggtctatggtcgctccgcgggccgctccgccggctggtgcttattgacaaggaagctggattcaagggcagggaggaaacaccttgttagtagatagag

SEQ ID NO: 11673 - DNA, 215 bp, Homo sapiens
  misc_feature 4: r=a or g
  misc_feature 10: k=g or t
tcaraaatgkcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcg

SEQ ID NO: 11674 - DNA, 291 bp, Homo sapiens
agagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcggccaaaggatgccattcgagccctgaagaagcggctcaacgggaaccggaactacagagaggtgatgctggcattaacagtgctggagacatgtgtgaagaactgtggccaccgcttccacatccttgtg

SEQ ID NO: 11675 - DNA, 528 bp, Homo sapiens
  misc_feature 92: s=g or c
  misc_feature 328: s=g or c
  misc_feature 329: y=c or t
cacctccccgccttgttgtccaacttctcccggagcagccggagagcaggcgtcgggacgcagcaaagagaggagaggccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactsyttcagttcgaggacatgcaggaaatcattcagaactttgtgcgggttcatgtggatgcccctggaatggaagagggagccctgtgttccctttgggatatcagtacccatctctggaccagcttgcagacatgatcccttgcgtcctgcagtacctaaatttctctacaataattggagtggtgttggagctggagcct

SEQ ID NO: 11676 - DNA, 335 bp, Homo sapiens
  misc_feature 160: s=g or c
aaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggastgcaggaggtgcagatcacagaggagaagccactgttgccaggacagacgcctgaggggccaaggaggctgagttagctgcccgaatcctcctggaccagggacagactcactctgtggagacaccatacggctctgtcactttcactgtctatggcacccccaaacccaaacgc

SEQ ID NO: 11677 - DNA, 304 bp, Homo sapiens
  misc_feature 122: r=a or g
  misc_feature 170: s=g or c
  misc_feature 198: m=a or c
aaagtgaaggtggaagcggccgcggcggcagcagaccccagagtcagaaggagtgagaaccctgacccctaatcccactgcatccagccaataggagcccagtaagtgaccccaccccgcargctgcaggctccttcctgtgcaggtctgtccaggccaccatggcggastgcaggaggtgcagatcacagaggagamgccactgttgccaggacagacgcctgaggcggccaagactcactctgtggagacaccatacggctctgtcactttcactgtctatggcacccccaaacccaaacgc

SEQ ID NO: 11678 - DNA, 302 bp, Homo sapiens
aaaaggcaagtgaaggtggaagcggccgcggcggcagcagaccccagagtcagaaggagtgagaaccctgacccctaatcccactgcatccagccaataggagcccagccaccatggcggagtgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccag

SEQ ID NO: 11679 - DNA, 237 bp, Homo sapiens
  misc_feature 57: s=g or c
aaaaaaggcaagtgaaggtggaagcggccgcggcggcagcaggccaccatggcggastgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccag

SEQ ID NO: 11680 - DNA, 196 bp, Homo sapiens
aaaaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccag

SEQ ID NO: 11681 - DNA, 107 bp, Homo sapiens
taaggggagagtgcgggtctgagattctagtagtttaaaaggcacgttagagacttttctaagaaagttggaaggacggggcagagttagggaccctgttaaaggag

SEQ ID NO: 11682 - DNA, 145 bp, Homo sapiens
ctctttttcttgtctctcgtcaggtctctgacattgacagagcctggacgttggaggaagccccaggacgttggaggggtaaagtaaaagtccacagttaccgtgagagaaaaaagagggagaaagcagtgcagccaaactcgga

SEQ ID NO: 11683 - DNA, 157 bp, Homo sapiens
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagccc

SEQ ID NO: 11684 - DNA, 402 bp, Homo sapiens
  misc_feature 391: n=a, g, c or t
  misc_feature 392: k=g or t
  misc_feature 394: n=a, g, c or t
  misc_feature 395: n=a, g, c or t
ctttttcacattcgggaagcgtcgggattaggtgaaagtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacactankgnnaaatata

SEQ ID NO: 11685 - DNA, 316 bp, Homo sapiens
  misc_feature 38: k=g or t
agcgtcatcatttctataagagagcgtgtgccgaagcktcggcctttcacattcgggaagcgtcgggattaggtgaaagaagctgagctgaacacattacgatggatgatggaaacataagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgt

SEQ ID NO: 11686 - DNA, 508 bp, Homo sapiens
  misc_feature 430: r=a or g
  misc_feature 474: k=g or t
agttctataagagagcgtgtgccgaagctcgccctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggcctcggggaaaggttccgtgcactcggggactccggtgaagcctgttcagccgtctgtgtcatgtggccatcttgagtctactctgtcgctcttgtgccctagcaccccgagaaccgtcagtttgagccagatggaagctgagctgaacacrttacgatggatgatggaaacataagactatcaagaaatccaagkggtaatgggcgaagtttattcagcatccggcaat

SEQ ID NO: 11687 - DNA, 301 bp, Homo sapiens
  misc_feature 244: n=a, g, c or t
  misc_feature 274: r=a or g
agagctggaggagagcgcgctggaaagacggggagttgggtcggtccgggccgaggctcctacatgggccgcgtccctgctgcgttgtgcagcttcggactctgtcctacaagtccccagccccggcgctgacttctcgccgctgccagggagacacccgggccgccctgcctttttttggaagccctgtcaaaaggcagctgcatgtccgggaggcagcaggccagcttttcctggatgattncaaaatgaagaatttcatcacctgcttcaragacccgcagttcctggtcaccttctt

SEQ ID NO: 11688 - DNA, 438 bp, Homo sapiens
  misc_feature 7: w=a or t
  misc_feature 73: k=g or t
acgtggwgctgggccggggaaatggcggcttcaggagagagcgggacttcaggcggcggaggcagcaccgagkaagcatttatgaccttctacagtgaggtgaaacaaatagagaagagagactcggttctaacttcgaaaaatcagattgaaagacccgtcctggttcctcttacttcaatttgaacccatttgaggttcttcagatagatcctgaagttacagatgaagaaataaaaaagaggtttcggcagttatccatcttggtgcacctgacaaaaatcaagatgatgctgacagagcacaaaaggcttttgaagctgtggacaaagcttacaagttgctactggatcaggagcaaaagaagagggcctggatgtaattcaggcaggaaaagaaacgtggaaacactgtgaaagagcctttgtgctctgtcag

SEQ ID NO: 11689 - DNA, 328 bp, Homo sapiens
  misc_feature 109: s=g or c
  misc_feature 110: r=a or g
agtgtgggagggagaagtccagggcggacaggctgggcgcacccgtgctcgcgcaccccaagatggctgagaggcaggaagagcagagagggagcccgcccttgagggsraaggcaaggccgacgcggaggttaagctcattctgtaccattggacgcattccttcagctctcaaaaggtgcgcttggtaattgctgaaaaggcattgaagtgcgaggaacatgatgtaagtctgcccttgagtgagcacaatgagccttggtttatgcgtttgaactcaactggagaagtgcctgtccttatccacggggaaacataatttgtgagg

SEQ ID NO: 11690 - DNA, 206 bp, Homo sapiens
  misc_feature 21: r=a or g
  misc_feature 105: n=a, g, c or t
acttttacgtttccggcaaarcatcagtgtctgtgggtagttggaatcttcagttcctgtgagcgtcggcgtcttctgggcctgtggagtttcttggacaggggncgcggggctccaggacggcgcccttagcgacaccatggcccgaaatgcagaaaaggccatgacggccttagcaagatttcgccaggctcagctggaagagg

SEQ ID NO: 11691 - DNA, 310 bp, Homo sapiens
  misc_feature 74: w=a or t
  misc_feature 244: m=a or c
  misc_feature 252: n=a, g, c or t
  misc_feature 292: m=a or c
gagactggaggcaggggaggctttcacaatcaatcaattaacgaacatctattaaactccttctgtatgcctgwcactgaggaaacaaagagttatacaggaggttcttattacttgaaggcagttggtactgcacaaaaggccattagtgaatttatttaaaagggggaccaaaattttagagtaatagtggaaggggtagggtttgattaggatgctagcttgaataactaaaagctattamaatatacntaattttgtctcatttaataaaattgagtgctagatatamcaatgcactaattcttag

SEQ ID NO: 11692 - DNA, 499 bp, Homo sapiens
  misc_feature 378: n=a, g, c or t
  misc_feature 386: m=a or c
  misc_feature 408: y=c or t
  misc_feature 409: s=g or c
  misc_feature 410: s=g or c
  misc_feature 466: n=a, g, c or t
  misc_feature 474: k=g or t
  misc_feature 476: n=a, g, c or t
agatttcagctggaagggaaggagctgacaggaaggcgctgtgcagagcctccccacccccgcccatccccccagttactgacagaggagccatttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgcnttccccamcccagcagtggcccctccccaysscctccctctgttcgtcccgtttgatgagaggctgtttactggggtggggtggcganatggcttkanggggctagagcataaggctcagg

SEQ ID NO: 11693 - DNA, 196 bp, Homo sapiens
caacgctctctattccctagatggtttggccgtagtcaatgtcaaggacaacccgcccatgaaggacatgttcaagctgcttatgttccccgagagccgtattttccaggccgaaaatgctaaaatcaaacgagagtggctggaagtgctggaggacaccaagagggccctcagtgagaaaaggcgaagggagcag

SEQ ID NO: 11694 - DNA, 368 bp, Homo sapiens
cttcccgccaggccccctccacccgatcgccgcgcgctctccgaaccaaaaggcgacctcacgaaatgcccctttgagctcaaaggctagttacccccaggggcccttccactctcggggacaggcgaaacctctttgtctctgcctcggcctgcggcccccagcccagcctccgcgctttccctccgccagtccttgtcaatcaaacctggtgccaaacgcggcagtgaagttttcagggacacatttgcttctccccttgaagaaccagttacaaagcgtgatgtcctctctggggtcccatcagaacaaagaaacaggtctaaagaccctcattccagagagcatcctgccccatattcagaatg

SEQ ID NO: 11695 - DNA, 231 bp, Homo sapiens
atgctgggattacaagcgtgaccaccacatcgggccgtttaaagcttattttaagagcacacaaaagttgagcacaaagataagattaaatttagcaacacagaatgataaagaataaaaaagatactgagtaaacttttttgacagaaaactgattatccaaggtaattatctcatatttgcaggctaaagtacttacacagaaaccaaagtccacctacagattctact

SEQ ID NO: 11696 - DNA, 590 bp, Homo sapiens
  misc_feature 61: k=g or t
  misc_feature 140: r=a or g
  misc_feature 514: y=c or t
  misc_feature 515: s=g or c
  misc_feature 516: n=a, g, c or t
  misc_feature 582: n=a, g, c or t
ggctctctgatccagcccgggagaggaccgagctggaggagctgggtgtggggtgcgttgkgctggtggggaggcctagtttgggtgcaagtaggtctgattgagcttgtgttgtgctgaagggacagccctgggtctargggagagagtccctgagtgtgagacccgccttccccggtcccagcccctcccagttcccccagggacggccacttcctggtccccgacgcaaccatggctgaagaacaaccgcagtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccysnaagctggcagctctgaaccctgagtccaacacagctgggctggacatatttgccaaattttctgcntacatcaa

SEQ ID NO: 11697 - DNA, 240 bp, Homo sapiens
acaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtccc

SEQ ID NO: 11698 - DNA, 399 bp, Homo sapiens
acaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagccccctatcaaggagcaatggataatcaagaaaagtctataacatttaagagaatagccaagatacagtatcagagctcaaaatcaattttctgtgtattcacttctaaacattaatgtgaaatcaaggagcaatggataatcaagaaaagtctataacatttaagagatagccaagatacagtatcagaa

SEQ ID NO: 11699 - DNA, 284 bp, Homo sapiens
agtgacatttgttttttgttttgaagttgttgagtttagcagagtatgcgttcatagggtgtgaattgcaggatgtagttctggggtcctccctaccagccgaccccacatcaaggttattctgggaagccttatccaaagccgactataaaatatggggctgaacattgtcaaaaggctaaacaggaaacagacataaataactattcaatcttaattcagtcctagctactttctcacacatattttataatgtgttttaaaaaacaatttccttaaaaaaa

SEQ ID NO: 11700 - DNA, 221 bp, Homo sapiens
  misc_feature 138: n=a, g, c or t
  misc_feature 197: y=c or t
cttaccatgtgttacagtggcctacagttttcagtacagtaacatactgtgtaggattgtagcctagggggcaaaaggctatataccatatagcctagatatgtagtaggctgtaccatgtagttttgtataagtacnctctgtgatgttccacaatgacagaactgcctaaggacacatttcctagaacttatccytgttgttaagcaacacatgactgt

SEQ ID NO: 11701 - DNA, 292 bp, Homo sapiens
  misc_feature 179: s=g or c
  misc_feature 188: w=a or t
  misc_feature 193: n=a, g, c or t
  misc_feature 203: n=a, g, c or t
  misc_feature 204: r=a or g
  misc_feature 207: r=a or g
  misc_feature 214: m=a or c
  misc_feature 219: r=a or g
  misc_feature 220: y=c or t
  misc_feature 225: m=a or c
  misc_feature 289: r=a or g
gtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgscaaaaagcwagctnggacaaaagnrgaracaaggmcatgrycaaamagcaatcttccaaggaggagctgcccttctagtgctgctagccctaccctgcagggaccctcaract

SEQ ID NO: 11702 - DNA, 362 bp, Homo sapiens
gtgtttcccctcctgagcgggtggaggaggcccaagcggtgctgggcgcgctcccccttcctttccctccggcgtcctctcccggccctctcgcgctgcactgtctctccgacgcaagactgtcccggcccggatatggctcgtggacagcagaaaattcagtctcagcagaaaaatgccaaaaaggcaagctggacaaaagaagaaacaaggacatgaccaaaaggctgctgccaaagctgccttaatatatacctgcactgtctgtaggacacaaatgccagaccctaagaccttcaagcagcactttgagagcaagcatcctaagactccacttcctccagaattagctgatgttcagg

SEQ ID NO: 11703 - DNA, 395 bp, Homo sapiens
  misc_feature 367: n=a, g, c or t
tacacatgcgcagggttgggcgggtcttcttccttctcgcctaacgctgccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccaccggtgggccttacttggatcaggggtacagatatcaattgggaatctctaaggtaataagttgggggggcccggataaggtcatatctggagaggcaaagtcaaanttgtctttctagtaaaacttcaggcttt

SEQ ID NO: 11704 - DNA, 251 bp, Homo sapiens
ttatacggcgctggccccgccccttctcgagaactcgcagagctgggctggtaaaattgcagtgctgaagacactggacccgcaaaaggctgtccctcccaaacctgggattctgggctcactgagttcacctgcgagtcagccctacctgcactgctctggtctagtacaaacaggctgctggcattgaggtaggtggcagagagagtaatggtcccatggcccaggggcaaggtgaagactgctcctat

SEQ ID NO: 11705 - DNA, 441 bp, Homo sapiens
  misc_feature 168: y=c or t
  misc_feature 356: s=g or c
  misc_feature 357: k=g or t
  misc_feature 411: k=g or t
gtactttacatgcagtgctactctttcggcattcctggttgaactacttaaaagttcagtagccatgcaagaacaggtgctgggtggaaaaggctttttagttattggctaattacttgaaaagtcatcaagagttcatataactagacctgtcttggagcaattttyatcttttgcaaaataccttgatggtttatctcatggagtacctttgctgaagcagctttgtgatcatattttgtttattaacccagccatctggatacatacacctgcaaaggctggagagcaatggcgcgatctcggctcaccgcaatctccgcctccctggttcagcccattctcctccgtcagcskcccgagtagctgggattacaggttcaactttccctatatacatatttgtctgckgaatttattggaactgctaccatctacacc

SEQ ID NO: 11706 - DNA, 466 bp, Homo sapiens
  misc_feature 381: s=g or c
  misc_feature 382: k=g or t
  misc_feature 436: k=g or t
gtactttacatgcagtgctactctttcggcattcctggttgaactacttaaaagttcagtagccatgcaagaacaggtgctgggtggaaaaggctttttagttattggctaattacttgaaaagtcatcaagagttcatataactagacctgtcttggagcaatttttatcttttgcaaaataccttgatggtttatctcatggagtacctttgctgaagcagctttgtgatcatattttgtttattaacccagccatctggatacatacacctgcaaagacggagtttcactctcattgcccaggctggagagcaatggcgcgatctcggctcaccgcaatctccgcctccctggttcagcccattctcctccgtcagcskcccgagtagctgggattacaggttcaactttccctatatacatatttgtctgckgaatttattggaactgctaccatctacacc

SEQ ID NO: 11707 - DNA, 167 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacggg

SEQ ID NO: 11708 - DNA, 133 bp, Homo sapiens
ccttacctataaatagaaattataatagtacccacctgtaatggttggttcagtgagataatgcctgtgtatgccttgggcctggaaatgtccctaatgcagaggacattcactatcaaaagggagagaaggc

SEQ ID NO: 11709 - DNA, 465 bp, Homo sapiens
  misc_feature 31: y=c or t
  misc_feature 330: y=c or t
aaaaagaagtccacttccccagggtaacaayattttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtggcccggcatcatctcttactgcgctgctcctcatagctgtcctcctgggccccatctacgtcccctggaagcagaagacctgactctccttccttcctcccctgccacgtgggaccctcactctgctgcctccttccyttcctgagaggctcagcttgagagaataagccagtgagaagcttctctagacttggctccaaacatctcccctcccaagacatctgcctgcccacaggctcctgttgctccttcacacagacctggatgccccag

SEQ ID NO: 11710 - DNA, 426 bp, Homo sapiens
  misc_feature 124: r=a or g
  misc_feature 321: n=a, g, c or t
  misc_feature 322: n=a, g, c or t
  misc_feature 359: r=a or g
  misc_feature 423: r=a or g
aggaaaccgcgtgacaacaagatggcggcgctgcgggacggctagcggccctgcgtgtactttcccaagcaccaccaggccaaaggtctctcagttcagagcagaaagccgtatacccagaggrgcaggcagataacagaaacttccagaaacctctgtggagacagtggaagaggcaaaagggagttcctgacagctggattctagaagtagaactatgagctcacctttggcctcccttagcaagacccgaaaagtgcccctgccctcggagcctatgaatcctgggaggcgaggaatccgcatctatggagatgaagnngaggtggacatgttgagtgatgggtgtggctcagaaraaagatctcagtcccttcctgctatggcggcataggtgcccctgtgagtcggcaagtccctgcrtcc

SEQ ID NO: 11711 - DNA, 172 bp, Homo sapiens
agaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcggggga

SEQ ID NO: 11712 - DNA, 491 bp, Homo sapiens
  misc_feature 326: n=a, g, c or t
  misc_feature 457: r=a or g
  misc_feature 460: y=c or t
  misc_feature 466: r=a or g
  misc_feature 469: r=a or g
  misc_feature 471: w=a or t
  misc_feature 491: r=a or g
gtctactcttaagccatcttggtaaatttccccaacagtgtgaagttagaattccttcagggtgatgccaggttctatttggaatttaatattaccaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaancaataaacgatttaattctcttgaatgaaatgacaactgtatggatttgggactggcagagatttggactttccctacccactccccctgataataatgttgaatgcttctatcacaattcaagttcaaargcyctgcarggrawagaaactagctgctggctar

SEQ ID NO: 11713 - DNA, 268 bp, Homo sapiens
taagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggc

SEQ ID NO: 11714 - DNA, 214 bp, Homo sapiens
aagtatctccacggtcgaaaagggcgtgcagggccggcttggcgtcgccactgccgggatcgccgggcccctgaaccgaagagctttcccccctctttcgcactcctcttttttgtcttccatagcttgtgagaaaataatttctgagcatttttacttttaaagccatctcgtccctacgaggtttgcgcctctgggcatgtagtctacacag

SEQ ID NO: 11715 - DNA, 251 bp, Homo sapiens
  misc_feature 220: m=a or c
aaaaagggctaaggctggggccggggaagctgcctctaggttagcgaagggtaaaggaagtcagacactgacgcgagtggcctcccgatcccgcagtcgagtggagaaccgagtcccgacctaaggtcgaatcatcaggcgtccccgtcacccaacaacccactcaggcacttccggcatacaagaattaaattctgaataagtctgcaggtaggatggmcagttattttaaagcagctgtcagtgacttg

SEQ ID NO: 11716 - DNA, 198 bp, Homo sapiens
ataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaag

SEQ ID NO: 11717 - DNA, 123 bp, Homo sapiens
accttaaatgttagaaaaggggagtagttctaaaatgtttgtagaaacgaggatttgggggtaccaacctagattttactagagcatattctttggaggtgttctttttttctactttttttt

SEQ ID NO: 11718 - DNA, 269 bp, Homo sapiens
taatttaaaaaggggttctcaagatggcttactaccaccttaatgatgtggtcccaatcatcaaggctccctacccaatatgtgaaattattaatattaatgattctattctgtcaacaatcagtaaatattttgttcttatagattggctaatatgttctgtttaatgcctgtttcaacagtctctcagctgcagtttgcttccacctccgaaagggacacaatacaccttttctaggttactgatggggtaccacaatagctttttt

SEQ ID NO: 11719 - DNA, 320 bp, Homo sapiens
  misc_feature 178: y=c or t
  misc_feature 186: y=c or t
  misc_feature 188: m=a or c
tctttcttttgtaaattgcccagtttcaggtatgtctttatcagcagtgtgaaaatggacgaatgcactaatacaacaggctccctggtcccccaccttctcggactaagtcctctgcagtgttgactccgtgttctatgagcttctggcagtcatctagtggtttaatggtctgttyaatggtgycmacctcttgcaaaagggtcaccaatcgctcatccaggagcttcccatgggttccctttaaatcatgaaaatgttgtttgagaacatcgcttgtctgtgatgcactctctttgatctctatgcctcccacagcc

SEQ ID NO: 11720 - DNA, 476 bp, Homo sapiens
  misc_feature 26: n=a, g, c or t
  misc_feature 27: r=a or g
  misc_feature 136: m=a or c
  misc_feature 139: m=a or c
  misc_feature 157: n=a, g, c or t
  misc_feature 258: r=a or g
ttctaaggccagtcagcgaatgtggnrgatgaggcaggatgttttaaatgagccagagatgatccacaaagtgaacagtcgacacagaggtctttgagttggatggttgcaaatatattgacattagagtgaaaamtcmttcctttgggtaaactanagaaagataaagtatactaaaaaattttaagatggtgttatacaaaaaaaagtttgggtctaacgtgtccacaaagactgtcaagtgaagaatggtggagrttcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaa

SEQ ID NO: 11721 - DNA, 275 bp, Homo sapiens
  misc_feature 150: k=g or t
  misc_feature 151: r=a or g
  misc_feature 205: n=a, g, c or t
gcttggtgcgcccgctgtcaccgccatggctgccccgtgtttgctgcggcaaggacgagccggggcgctgaagactatgctccaggaagcccaggtgtttcgaggacttgcttctacggtttctttgtctggcggaatcagggaagaagkraaaagggtcagccacagaattccaagaagcaaagtccaccaaaaaatgtagtgnaaccaaaggagaggggcaagctcctagccacccagacagcagctgaattgtctaaaaacttatcttcacc

SEQ ID NO: 11722 - DNA, 474 bp, Homo sapiens
cttgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaa

SEQ ID NO: 11723 - DNA, 247 bp, Homo sapiens
accaactccaactgatggcccatcattcactgttatgagacaaagttctttaacattccaaagctctgacccagaacagatgcgacagagtttgctgactgcaatccgttcgggagaggctgctgccaaattgaaaagggttaccattccatcaaatacaatatctgtgaatggaaggtcaagactcagccattccatgtcccctgatgcccaggacggccattaaatgttaccctgccacaccact

SEQ ID NO: 11724 - DNA, 441 bp, Homo sapiens
gttgtgggtaacgcggacgtggaagaacctcgtctgcggaggaaaaggtagatgttaaatggtaactacgcgcgaggttctgaggagccctgggaacaggaaggcagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaagaactcctgtagcctgtaataccagctgtgggtactactctcagtgttggagatcatcaaaatacaattggaccagacctttggaaataattctgtgtctcaaatgccctgtggagcac

SEQ ID NO: 11725 - DNA, 239 bp, Homo sapiens
aatgacattcactttgagtgtggacagttgtgcctttgggacagaagcagttgtttctacctttgtcattttgtacaacagctatagtgggagaactattttctcccaaaattaccactaaagagacctagaaaataaaacaatgtcattttgtatgtttacaaaagacaaagcagtctttccactataaaccaagtagaggaaaaaagcaattgaactaatggtatctttatcaccgc

SEQ ID NO: 11726 - DNA, 355 bp, Homo sapiens
  misc_feature 120: n=a, g, c or t
agtgcttgatatcacagaggaaactctgcattctcgcttcctggagggtgtccgcaatgttgccagtgtctgtctgcagattggctacccaactgttgcatcagtaccccattctatcanaacgggtacaaacgagtcctggccttgtctgtggagacggattacaccttcccacttgctgaaaaggtcaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaa

SEQ ID NO: 11727 - DNA, 455 bp, Homo sapiens
tttgactattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctc

SEQ ID NO: 11728 - DNA, 320 bp, Homo sapiens
  misc_feature 314: m=a or c
aatgttctgtggtaaatcctgtatgcccaaaattgtgttttatgcaatgatttttgttgttgctttatcctaaccttgtgaaaaaatagttggtttggttttttggttcttgtctcaccaaactgggaatattgtcagattacccattctccaaggagtggggtacatttacattaaggggtccagttacattaagctgatgtaggcttgatgtcatttgacatcaaggcctttagaatttttctacagcaggaagcacagtgaactttcctaaaaggtcaggatgtgacaatgggaaggtggggagtcgtatmaagggg

SEQ ID NO: 11729 - DNA, 179 bp, Homo sapiens
  misc_feature 20: s=g or c
cagttccatccatccctacsactccatttacccaggaccctcctcttcaacatcctaatacactgtgatcaatatgccaaagcttcagtaaccttgcactatgtgaaacaaaaggtcccacactgcatagcctggcactcaagaccccctaatcccagtctcccttgaattaccgccca

SEQ ID NO: 11730 - DNA, 222 bp, Homo sapiens
  misc_feature 25: y=c or t
ctcctcacttccggcttcgctgctyttggttctggttctggaggctgggttgagaggtcgccggtccgactgtcctcggcggttggtcagtgtgaatttgtgacagctgcagttgctccccgcccccgagcagccgaggtgcgtgggggaaggggaagaaggaaaaggtccgggtcgcgtttccgctcagtttttgccagggttgaggcgattccagagagc

SEQ ID NO: 11731 - DNA, 238 bp, Homo sapiens
agtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacaggttccggtgattgtggaaaaggtctcaggctctcagattgttgacat

SEQ ID NO: 11732 - DNA, 476 bp, Homo sapiens
  misc_feature 4: y=c or t
  misc_feature 451: k=g or t
  misc_feature 464: w=a or t
aggygcactagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgatatgtcttgtcgttcaagacttgcaacactaaacgagaaattgacagcccttgaacggagaatagagtacattgaagctcgggtgacaaaaggtgagacactcacctagaacagtgccgtgctgctgctgggaagttgctttacacaacacaggccacatgggaaaggccccagcagccttcagctccttcctttctccttaaagagcaacagggcttattcttgtttttcttttttcaaaagtgtggcctttgggctctgccatctgkggtgtggtgtggwatgtgggaagaa

SEQ ID NO: 11733 - DNA, 229 bp, Homo sapiens
  misc_feature 4: y=c or t
aggygcactagaggcctgtagggtcggggcgcctgcgcagtcgctcttcctcaggcggcggccatggcgggacaggaggatccggtgcagcgggagattcaccaggactgggctaaccgggagtacattgagataatcaccagcagcatcaagaaaatcgcagactttctcaactcgttcgcctactcagcaggaagacaatgaggatgaagacctttatgatgatcca

SEQ ID NO: 11734 - DNA, 292 bp, Homo sapiens
  misc_feature 49: n=a, g, c or t
  misc_feature 98: n=a, g, c or t
  misc_feature 99: w=a or t
gaccgaggggcggacgcgcggcggggcagaccgctggggactgcgggcngcgctgtgtccgtcgccatgacagatcagacctattgtgaccgcctggnwcaggacacgcctttcctgacaggccatgggcgcttgagtgagcagcaggtggacaggatcatcctccagctgaaccgttactacccacagatccttaccaacaaggaggcggaaaaggtgctgaggagttccggaaccccaaggcatccttgcgtgtgcggctctgtgacctcctgagccacctgcagcggag

SEQ ID NO: 11735 - DNA, 244 bp, Homo sapiens
  misc_feature 94: s=g or c
acctggtcaaggccgttccttcagtgttttcagacgccctgggaacgcggctgcagggtccggtcttcggtttgcacagctagaggccgcgcasagcaaaggatgagcggaaccttggaaaaggtgctgtgcctgaggaacaataccatttttaagcaagccttttctctcttaaggtggaattctactaagtatcagtcggccctacaagacaaagcccacccacggcattggaaagtacaag

SEQ ID NO: 11736 - DNA, 384 bp, Homo sapiens
tgcctgacatgtatcatctacttgttgactgacctattgaggtgccttcatgacaccttttacattcatgataggtctcaggaagacagcagtgtacttggtggaaactcatgtaaaaagtgggttgtagggagctaaacagtgagtacacatggtatatggatacggaatggaataatagacattggagacttcaaaaggtgggagatgaaagggggatgaggtatgaaatcctacctgttgagtacaatgtacactacttacgtgcacagtacactgtttgggtgagaggcacactaaaagcccggacctcaccgctacccagtatgttcatgtaacacagctgcacttgtaccccctaaatgtatacaaataatctaaaat

SEQ ID NO: 11737 - DNA, 220 bp, Homo sapiens
tataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatag

SEQ ID NO: 11738 - DNA, 390 bp, Homo sapiens
agcaaagtgcccatggtggcggcgaagaagagaaagatgtgttttgttttggactctctgtggtcccttccaatgctgtgggtttccaaccaggggaagggtcccttttgcattgccaagtgcataaaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttcctctttattgc

SEQ ID NO: 11739 - DNA, 394 bp, Homo sapiens
  misc_feature 344: r=a or g
agtgttcccggtgcaggagtgtagcacttttgcttgttggggctgcatccagaaacctggggaaaatctgtccactggacgtcccagaagaccggcatcatcactcccaccaactggactgctggccggtagcaaaagaccagctggaaatttcataaaaggttagacaatccacagttactcagtgttacgcaacaggtctctgcagcacagagcacgaactggggagtcaggatgctggagtccagccctgcctctctgcggattccctgcctgaccttgggaaagcctcttggggtctcggggcatagggcaggactgagacgttgagaccccaagtgcaragaagacacatttctcctaccacgagtaatcaaaaacactatgaaactgt

SEQ ID NO: 11740 - DNA, 181 bp, Homo sapiens
cctataaagcagacgccgcgccgcgctgcgacgctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacag

SEQ ID NO: 11741 - DNA, 492 bp, Homo sapiens
cataattttataatagtcatccttaggctaccacttccctttccactgggatattttttattttccttttttttgtttgaactacacactgttaaactaaaagtattgaatttattttgttttgttttttaacagaagctttgatatcagctgcagatcactcaatacatggccgagacaaatctacattggccggaagcagctctagatgagcctcttggctagacttagtccctccttattagtgattggcgattcaggccatgtcatagggcctttcagacaaaaggttcttatcccagtcagctggccaaaacattaactttggatttcttaccctgctacagcatcttctagaaaggcagcaagataatattgtggcagtgcacagataacatcagggtagacttgactggagaaaaccaaattctgcgcttgctcctgtgtgcccccatccagctgtgcatgcacacacaggacactttctagtat

SEQ ID NO: 11742 - DNA, 399 bp, Homo sapiens
  misc_feature 313: r=a or g
attttttggtccaggacaggcagtaggcgtcagggggcgccctaaggctccacggcatgtgcctgtattgctgggacatcgagccttcccaagtcaaccctgaaggaccaagacaacatcatccttcagaggtcactgagcggcagcttgcaaataaacgtattcagaatatgcaacacctaaagaaagagaagaggagactgaataaaaggttttcaaggccttctcctattccagaaccaggactcctatggtcatcttgataaagcaggagtctatttgaaggaaaccatgctccagacagaaatatgtrgattgtgaacatcaagtgacatatcatgaattgatcatccacaaaataaatgcaatactccaccatttcggaaaaataaacacagt

SEQ ID NO: 11743 - DNA, 477 bp, Homo sapiens
  misc_feature 445: w=a or t
  misc_feature 446: w=a or t
cagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattgagtggaaattgtactwwattttatataatgtcatgtaaaactttgctt

SEQ ID NO: 11744 - DNA, 361 bp, Homo sapiens
  misc_feature 112: k=g or t
  misc_feature 115: r=a or g
  misc_feature 122: n=a, g, c or t
  misc_feature 124: w=a or t
  misc_feature 129: k=g or t
  misc_feature 141: r=a or g
agacactctccaaaaagcagagacagcaggaagaggggagtggaggcagcccattcacctggggaaatgactgggttgtcgatggacggtggcggcaccccaagggggacgkggraccgttncwactakggctgcggagaragacagctgctgggagagaccacccatcccgctcctcttgccctctctttccggagactatgagaccgttcgcaatgggggcctgatcttcgctggactggccttcatcgtggggctcctcatcctcctcagcagaagattccgctgtgggggcaataagaagcgcaggcaaatcaatgaagatgagccgtaatagcagcctcggcggtgccacccactg

SEQ ID NO: 11745 - DNA, 293 bp, Homo sapiens
  misc_feature 98: s=g or c
agacactctccaaaaagcagagacagcaggaagaggggagtggaggcagcccattcacctggggaaatgactgggttgtcgatggacggtggcggcascccaagggggacgtggacccgttctactatgactatgagaccgttcgcaatgggggcctgatcttcgctggactggccttcatcgtggggctcctcatcctcctcagcagaagattccgctgtgggggcaataagaagcgcaggcaaatcaatgaagatgagccgtaatagcagcctcggcggtgccacccactg

SEQ ID NO: 11746 - DNA, 203 bp, Homo sapiens
  misc_feature 192: k=g or t
tattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagtkcagatcatcat

SEQ ID NO: 11747 - DNA, 243 bp, Homo sapiens
catgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttacc

SEQ ID NO: 11748 - DNA, 324 bp, Homo sapiens
  misc_feature 165: n=a, g, c or t
  misc_feature 168: r=a or g
  misc_feature 169: r=a or g
gaatgtttttaaaggaattttcttcttagaaaatgtctttggaacaattcttacagaagagtttaggatgttacattttccataatggctaacttatattgaatgtctaaaaattctagtttcccaaacgcagaacatttcattttgaaaaatactatagatacnatrraatgtaagcagatagagtagtcctaatctttccttgataccatcaatgaaaatgtgtcaaatactttccaggcagaatgcacagtgaaggatgatagtgatacaaaagtaaggcaacaaagagcccttctgctaatgaagcttaaattttactgg

SEQ ID NO: 11749 - DNA, 376 bp, Homo sapiens
atcattcaggagctatcagcctatttctacatactttatatctgttttggattatttggattccagttgtaagcctccatttagaaagggagcatgagaagcactgaaaagtaaggcactgtgatctacacggaaaccatatattgggctcacagctactgaatgagaccgactggtggagacagtttagtgaacctggtaaacactacacgtgaagagtggtgaaagggaacattgattactgaagtgccctggagagggaaagcactggtcaacatcacatggacaaatttcattgttttctaaagatggcctggaagtagtctttgccactgcttcctccacaaacagctcttcataacatgggctgcatgaa

SEQ ID NO: 11750 - DNA, 401 bp, Homo sapiens
  misc_feature 400: s=g or c
aaaaaagatggcttcttcctgacatgtctggcatccagtgggacatctgagactggctgaacatttcttctccatgaagcctcttcaatagtggtcgccaaacttctttacatgggacgccatgagacagattccaagagaataagtcctaatgcccaaacgcataccaagcttctgcttgcatcacacttactaatgtcccattggcgaaagcaaatcacagggccaaggccagagtcaatagggaaggggctacaatggggtgtgaatactggggagcatagtttatataaattggtgcaaaagtaattgcgatttttgccatttttttttttttttaaataaaagtaatggcaaaaactgcaattacttttgcactacctaatatatacggagagasc

SEQ ID NO: 11751 - DNA, 262 bp, Homo sapiens
taccacactttcggcagatgtgttccaaacaagaacttatcccattgagcagggtgggctggtggattattaattacccactgaatctattaggttggtgcaaaagtaattgcggttcttgccattactttcaataattgttggacctgctaatttccatggagttttgtgcatgttaggttactcttaaacaccacagaaaatggtgattcatctcttgactgcccccagagaaggctgaagaaaggtcaaaaacatcccc

SEQ ID NO: 11752 - DNA, 673 bp, Homo sapiens
acattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctg

SEQ ID NO: 11753 - DNA, 301 bp, Homo sapiens
  misc_feature 276: y=c or t
cagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagaygaacacataaataaaactacatgca

SEQ ID NO: 11754 - DNA, 203 bp, Homo sapiens
  misc_feature 115: m=a or c
  misc_feature 124: w=a or t
  misc_feature 130: n=a, g, c or t
aaaaaagcagctaaaccaaaagaagcctccagacagccctgagatcacctaaaaagctgctaccaagacagccacgaagatcctaccaaaatgaagcgcttcctcttcctcctamtcaacatgwgtgtcntgagagtccagtttgtatctgtaccataaccaggaggctgatggtgagtaggaggaagaggaagcgcttcatt

SEQ ID NO: 11755 - DNA, 120 bp, Homo sapiens
aaaagtactctgttgaaacctaagtgaaggaggacaacttggtgtagttgctctccagcactcccatccccaacatccattttcccaagctcactcccccatggatagaacctgactgcc

SEQ ID NO: 11756 - DNA, 390 bp, Homo sapiens
  misc_feature 23: m=a or c
  misc_feature 26: s=g or c
  misc_feature 37: r=a or g
  misc_feature 194: m=a or c
  misc_feature 195: m=a or c
  misc_feature 334: n=a, g, c or t
  misc_feature 358: m=a or c
  misc_feature 383: r=a or g
tgattcaggatgcgcgcgcagtmctsccgcccagcgraagttttcgctgggcaactgagaaggtcgctgtcaagatggagtttccaacccagtaaatccaagggccagaccgtgacctcataaagcatgatctccttctgtccagactgtggcaaaagtatccaagcggcattcaaattctgcccctactgtgmmattctttgcctgtagaggagcatgtagggtcccagacctttgtcaatccacatgtgtcatccttccaaggctcaaagagagggctgaactccagttttgaaacctctcctaagaaagtgaaatggtccagcaccgtaanttctccccgattatccctcttctmagatggtgacagttctgagtctgargatactc

SEQ ID NO: 11757 - DNA, 228 bp, Homo sapiens
cttattccacactgaatgtgaaattgcatgttcagatgtttactacgaggcctggctcacaggaagtgttcagtaaaagtatgcactgttagattactgataacgcggatagatttttgtttaccataaattgttccagatttatattaatggaaggaagtgtgcatttattagctattactcaactttacaatgcaaacatcttatttctcatctttaaacatgtcg

SEQ ID NO: 11758 - DNA, 461 bp, Homo sapiens
  misc_feature 28: s=g or c
  misc_feature 157: s=g or c
  misc_feature 160: k=g or t
  misc_feature 164: y=c or t
  misc_feature 165: m=a or c
  misc_feature 297: n=a, g, c or t
  misc_feature 336: n=a, g, c or t
  misc_feature 421: k=g or t
ataaagtcagctaggaacaggccgaggsagggagaactctccactcggaggaggagctggggtcctcttccatcccgtcttcatcctgcctggctgcgtgacctcgggaggcaccatgcaggagctgcatctgctctggtgggcgcttctcctgggsctkggcymaggcctgccctgagccctgcgactgtggggaaaagtatggcttccagatcgccgactgtgcctaccgcgacctagaatccgtgccgcctggcttcccggccaatgtgactacactgagcctgtcagccaacnggctgccaggcttgccggagggtgccttcagggaggtgnccctgctgcagtcgctgtggctggcacacaatgagatccgcacggtggccgccggagccctggcctctctgagccatctcaagakcctggacctcagccacaatctcatctctgactttgcctgg

SEQ ID NO: 11759 - DNA, 163 bp, Homo sapiens
atacttgaatgttctaaaaatttttttctttaaataattgaatagattgataagcttcatctatatgtgatatctttaattaatatctttaatgaatctgtgttgtaacttaacaaaagtcaaacttgaatgtcttttcctactccccaaaatgttattgaat

SEQ ID NO: 11760 - DNA, 219 bp, Homo sapiens
  misc_feature 168: r=a or g
  misc_feature 188: s=g or c
agtcagttgccggaagtcggcgtgaggtggggcttatgcggcggcgtggtgaaatagatatggcgaccgagggggatgtggagctggcagttggagactgagaccagtggaccagagcggcctccggagaagccacggaaacatgacagcggtgcggcggacttggargccgctccagctccaactcstcccgataaacaggccactgaagctctcgcc

SEQ ID NO: 11761 - DNA, 174 bp, Homo sapiens
  misc_feature 123: w=a or t
tgtttacttgctagaaaccattgttttattgcaaacgaaggaaaaatgaagagattataaaagtcagctaatgaagtaagatacgtagtaaagtcaggactattcaaaaagtaagaaagaaawtttggaatgagagaaacaggaaacaaagaatgccgaaaagatgaaaacaga

SEQ ID NO: 11762 - DNA, 415 bp, Homo sapiens
  misc_feature 150: k=g or t
  misc_feature 399: n=a, g, c or t
aaatagaaaatgcacagctttaaaatgggcagagttaaaatctattcccagctttatcacttatttagccatgctagcctaggcctctatttccttgtctccaaaatgagaataataaaatttaggtcaggattactatataaactaaakaatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcntgatcccccagatacc

SEQ ID NO: 11763 - DNA, 282 bp, Homo sapiens
cttcatctctccatctctgcgctgctgccggctgcgccatccagcacccagactccagcaccggccgaggacccccactccggctgcagggaccctgtcccagcgagaccgcagcatgtcatccgaaaagtcaggactcccagactcagtccctcacacttctccgccgccctacaatgcccctcagcctccagccgaacccccagccccaccgccacaggcagccccttcctcacaccatcaccaccaccaccactaccatcagtctggcaccgccaccct

SEQ ID NO: 11764 - DNA, 374 bp, Homo sapiens
  misc_feature 107: y=c or t
  misc_feature 356: y=c or t
taatagaagatggtggagctagaagtgatggatcactggaggatggggacgatgttcaccgagctgtagataatgaaagggatggtgtcacttacagttattccttytttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaayagtattcccaacttttgt

SEQ ID NO: 11765 - DNA, 345 bp, Homo sapiens
  misc_feature 298: n=a, g, c or t
  misc_feature 302: m=a or c
caagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgnggamcggtgacacgtgcttcagaccggtctggggtgcggcgcacacc

SEQ ID NO: 11766 - DNA, 361 bp, Homo sapiens
  misc_feature 267: n=a, g, c or t
ataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtangtgaatttatgagatttactgctctagaaagtatagatggcgaaaggaccgttttgtattgcttcctgattaccagtctgattataccatgtgt

SEQ ID NO: 11767 - DNA, 401 bp, Homo sapiens
aataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttggg

SEQ ID NO: 11768 - DNA, 295 bp, Homo sapiens
taacttgtacttggagcttttatgttcaagagcaaaatcatatccccattttaccttaaaagtccacaggtcctgaacttaattatactattgtacctggtaacctatttgaatacttaaatgcccagtgactgcatttcagggttgatgtatactacaacaatccatggctgtttttataattacatatgaggatccagtctgttgtttggatattacttagaggttaatgcagtcagtgtatgccaaatctgagaagtgttgttaagtaaaatcttgttacagatttagccct

SEQ ID NO: 11769 - DNA, 292 bp, Homo sapiens
  misc_feature 185: n=a, g, c or t
  misc_feature 201: n=a, g, c or t
  misc_feature 203: r=a or g
  misc_feature 205: m=a or c
ggaagacttaagatggcggcgtttgcacggagtgaatcactgcgtccttacgggggttgcaaggcgtccgaagtatgagtccactaacaaaagtccagaaactcgccagttaatagtattgtgtctctttcaaaatatcggagaataatttctttctcgctgatcgcctaacttctactgacgangcttggaagttgcagnargmtggagtgcaatggcgccatctcgtctcactgcaacttccgcctcccgggttcaagcgattctcctgcctcagcctcccaagtagctg

SEQ ID NO: 11770 - DNA, 315 bp, Homo sapiens
  misc_feature 37: n=a, g, c or t
  misc_feature 203: r=a or g
ggaagacttaagatggcggcgtttgcacggagtaatncactgcgtccttacgggggttgcaaggcgtccgaagtatgagtccactaacaaaagtccagaaactcgccagttaatagtattgtgtctcttcaaaatatcggagaataatttctttctcgctgatcgcctaacttctactgacgaagcttggaagttgcagaagrttggagtgcagtggcgcggtctcggctgactgcgacctccacctcctggattcgggctgttctcctgcctcggcctgccgagtagctgggattacgggcatgtgccgccgca

SEQ ID NO: 11771 - DNA, 237 bp, Homo sapiens
  misc_feature 134: s=g or c
gggtcacgctaacgccgcggtttcctccgctcgattggttctactgtgggtctggactgatctccatgtcctgttgtggggcttttacagcctttggattgtgaaaactgctgagagagacttgcaatccagtsacataagtataataaagaaatattggtcctcatggaagaagagcaagatttaccagagcaaccagtaagtatttcctttaacagtttaaagttgattgtagaa

SEQ ID NO: 11772 - DNA, 426 bp, Homo sapiens
  misc_feature 343: n=a, g, c or t
  misc_feature 347: m=a or c
gcctatttcacatccggtttgccctgggacgtattactactgtcttggtaaagagaaatcttttgttgtatagctgcagattggatattgggaagcaaatttgggtgtgaaatcttcagcaaaggagcacgcagagtccatgatggctcagaccaagtgagtgagaggcagagcgaggacgcccctctgctctggcgcgcccggactcggactcgcagactcgcgctggctccagtctctccacgattctctctcccagacttttccccggtcttaagagatcctgtgtccagagggggccttagctgctccagcccgcgatgaggaaaagtccaggtctgtntgamtgtctttgggcctggatcctccttctgagcacactgactggaagaagctatggacagccgtcattacaagatgaactta

SEQ ID NO: 11773 - DNA, 172 bp, Homo sapiens
gctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcgg

SEQ ID NO: 11774 - DNA, 363 bp, Homo sapiens
  misc_feature 10: n=a, g, c or t
aggaaacgtnaaaattgggatagtcggcagttctggcccctgcagctggaggtaccctgagttctgagggtcgtagtgctgtttctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagatgggtcaagggttgtggagagtggtcagaaaccagcagctgcaacaagaaggctacagtgagcaaggctacctcaccagagagcagagcaggagaatggctg

SEQ ID NO: 11775 - DNA, 127 bp, Homo sapiens
atagccacagtcctgagagtccaggcttctgggatgcccagctgggtataaaagtccctactaaccctgtttcaaattcagaggtttctttggtttagaatgcctcaatgagattttgatacatcca

SEQ ID NO: 11776 - DNA, 387 bp, Homo sapiens
  misc_feature 320: n=a, g, c or t
ctgcggccgcttccggacgtgaaagtttgctgcgtagggatagggagaccgggccggattgcggggagtgagcaggttcagcagtgacggcattcttaaaagtcctgcccaagtgagggacttggggtgtgggacagagtggcccccagggcagtgggcgttggaaactgagaggccctgcgaaggaggcttggggaggggctacggtgaccaggggacgaggtataggaagaggagggcggaaagccttgagggtgggcttcttggatcccaattgccccagaggcacaggcctgggcatcactgtattatttcccgantgggagaaggggctatttcccatgggaagacaaagtgggatgaatagtggaccttgagaagaggggg

SEQ ID NO: 11777 - DNA, 170 bp, Homo sapiens
  misc_feature 145: k=g or t
agtataaatctggaaaagtctagaatcttttctgtgaatgctatctcagtactactttaagtcaagtgtgatgctaatgatatcttaaaatttccaacaccttttgtgcagtgatcacaaagtctcaacttaatttgagactgtkactcagaacacgccttgcgtcacgg

SEQ ID NO: 11778 - DNA, 177 bp, Homo sapiens
aaattacaaaattaattattggctgtatcattttacattactaccatcaaagtatgagaagtctagttttcccatattctcaccagcatttggtattgtcacttcaaaataattattttagatgttctaatataactgaacaaaagtctggctgctcactgcttgaggaccaaaaca

SEQ ID NO: 11779 - DNA, 355 bp, Homo sapiens
caagaaagaggggtaagtactctctacttgctggaaaatcattgtaagtctgttgtgtatgaaattttaggaaaagtcttatatagttccctttccagactgttttcttttgactctaactataatcataagtctgtgcttccattatgaaggtcacattcctagcattcttgggaagtattagctcatactctcattcacatatgggaggttagatttttttcctctacccagagtccctttttagtttaccccacggcttagtttgctgtcagataccagttctctagcagattccccaacagttttttccccagtggggagggtggaagggagggactgatataagtaagga

SEQ ID NO: 11780 - DNA, 170 bp, Homo sapiens
catgtaactaatcagcactcagatcatgaaacagaacattaccagcaccccaaaagtcttcctggacacacggttgatttttaacattgaggtcaagcgctgcatttatcttgttgagttttgagcccaattatctacctgttcagctagttttggattcttgaatgata

SEQ ID NO: 11781 - DNA, 370 bp, Homo sapiens
atagaaaatggactgatccgaagcacagctgaatttcagcgtgacattatgctgatgtttcagaatgctgtaatgtacaatagctcagaccatgatatctatcacatggcagtggagatgcagcgagatgtcttggaacagatccagcaattcttggccacgcagttgattatgcaaacatccgagtctgggatcagtgctaaaagtcttcgagggagagattctacccgcaaacaggatgcttcagagaagatgggacacgagtgggtttggctggattctgcaagatcatcccaatgactctgagttgagcaatgactgcaggtccctcttcagctcatgggactccagtctggatcttgatgtgggc

SEQ ID NO: 11782 - DNA, 212 bp, Homo sapiens
atcctttctgcgcaggttcccgccgcactcgcgcagacctagcgcgtccaggtgggaggttagtgtggcccgggcgcgcctagtggtttcgaagaagatataaaatatgattagttcaaagacaaaaaagaggtagcaattgtggtattaggaaacaaaatcgacctttctgagcagagacaagtggacgctgaagtggcacagcagtgggc

SEQ ID NO: 11783 - DNA, 530 bp, Homo sapiens
atcttttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacactggtctttccctgatgttctcgtggctgctgttgggggcagagattgacgcccccggtctttgcctc

SEQ ID NO: 11784 - DNA, 365 bp, Homo sapiens
atcttttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactcttgtggttaaaactacacttcttcctgtgtccacatgggctaaaatctaccccctgcttctctcgaagcatcaccatccg

SEQ ID NO: 11785 - DNA, 153 bp, Homo sapiens
  misc_feature 147: s=g or c
  misc_feature 149: n=a, g, c or t
  misc_feature 150: n=a, g, c or t
atcctttctgcgcaggttcccgccgcactcgcgcagacctagcgcgtccaggtgggaggttagtgtggcccgggcgtccgctcctcagcggatgtggcagcccgagccatggctctcgccgtccgagtcgtttattggtaagcgcasgnncca

SEQ ID NO: 11786 - DNA, 162 bp, Homo sapiens
atcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgttctcctggttttcccccgtcccc

SEQ ID NO: 11787 - DNA, 329 bp, Homo sapiens
atttcctgggtatgtgtagtctggtgggaggtgggtgcattctgtgcccgtaccatgagaccacttttaagagtcgatgacaaagtgacactagttctctttcagtaaacttgggatagtcttgttccttggagccctagctgcaaagcctctgggaaaagtctttggtgaataaggcagaggaggaatgattgtacctgttagccatttgactgggggcaacagggtgctatgaaccagtggtagctgaataactcttctctgtccagtcatgattatcatgatcatagtgatttgctgccaccaattcctgaaaaatctgaagggcg

SEQ ID NO: 11788 - DNA, 369 bp, Homo sapiens
  misc_feature 329: n=a, g, c or t
  misc_feature 365: k=g or t
aagtgacgctacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcaggtcagagcttcggggagaaaagtgaagagcaagacggaactgacggggagaaaggctgggaaccagggtgtcgactttgactgaaatttgagacggagggcaccggagggcgagcactcgcctgtgattggcccgtgggcgtcgtcgaggtcccacgcagctgctcaattgnttggggggtactcggcagtgcagccatgactatackcccc

SEQ ID NO: 11789 - DNA, 226 bp, Homo sapiens
  misc_feature 180: s=g or c
  misc_feature 181: m=a or c
  misc_feature 193: n=a, g, c or t
  misc_feature 199: w=a or t
  misc_feature 201: n=a, g, c or t
aagtgacgctacaggggccagctatgctcccgggagtgttgatgttttccagtcattccggctgacagcgttcaagttggaatcctggaggggaggtgtttttcctgtcgtacgtgggacaggccacgctgtccgtccgcagtaccgacgcctgcagcagaaggccggaacaaggcgtasmaataaacttgcnggactwgnagagaaggctaaggacaaactcgcc

SEQ ID NO: 11790 - DNA, 301 bp, Homo sapiens
  misc_feature 292: n=a, g, c or t
aaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaagtaaggggttggtttggatattgtctcctgactgggatatgggcaggactgacagggagctggagtcctaacgaagcctgggctaggtgcaggaagaaccaacccagtggtctcctgacatctcccaangcccctccc

SEQ ID NO: 11791 - DNA, 358 bp, Homo sapiens
  misc_feature 33: s=g or c
  misc_feature 215: s=g or c
  misc_feature 216: m=a or c
  misc_feature 217: s=g or c
  misc_feature 218: m=a or c
  misc_feature 228: s=g or c
  misc_feature 229: m=a or c
  misc_feature 234: m=a or c
  misc_feature 262: s=g or c
  misc_feature 263: m=a or c
  misc_feature 310: m=a or c
  misc_feature 345: n=a, g, c or t
  misc_feature 346: m=a or c
atccctctttgtgtgctttggaaagccgcggastggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaasmsmaaagaagaasmaaggmaaaaaaaagaaacagaccagcaagaagsmagctgttgctcctgtgcaagaagaatcagatcttgaaaaaaaaaggmgagaagctgaagcattgcttcaaagcatggggctnmctccagaatccc

SEQ ID NO: 11792 - DNA, 189 bp, Homo sapiens
  misc_feature 97: k=g or t
  misc_feature 160: r=a or g
cccactgcactccagctcggggaacagagcgagaccttgtctctaaaaataatagtaataaaataaaaataacgttttatgactatttattgcaagktcagagttacagattgttataaattgttgagaaatttttgtgattagaatatgaaggaaaaarctttgttggtaaaagtgacatgttaaggg

SEQ ID NO: 11793 - DNA, 320 bp, Homo sapiens
  misc_feature 7: m=a or c
  misc_feature 148: m=a or c
gagaggmcggccaggactggccagaaaagagaggtgtggaatgcagtaagaaaagtgacgcggaccagaggggtcttgcctgttccgagagaatggaagggtgcatccactctgggagagcgtggacctggttcctgggggcgatcgmcagtcacccatcaacattcggtggagggacagtgtttatgatcccggcttaaaaccactgaccatctcttatgacccagccacctgcctccacgtctggaataatgggtactctttcctcgtggaatttgaagattctacagataaatcagctgcacttagtgcattggaac

SEQ ID NO: 11794 - DNA, 404 bp, Homo sapiens
agcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggaaacggtcgcccagatcaaggctcatgtagcctcactggagggcattgccccggaagatcaagtcgtgctcctggcaggcgcgcccctggaggatgaggccactctgggccagtgcggggtggaggccctgactaccctggaagtagcaggccgcatgcttggaggtaaagtccatggttccctggcccgtgctggaaaagtgagatgagcggcgagcaagttgaataaatcgtccatcaaa

SEQ ID NO: 11795 - DNA, 227 bp, Homo sapiens
taatctgtgccccttcctctccatctctggtgcccatccacctctccctactggcatcagctctggggtatctgatgcctgcctctttccaaattttatgtgcaaatacgacagccataaacaattcaggggactcaatattgagccagaaatatatgcacatggcaaacattcagatggcactaggattcatagtgaaaagtgagtctcctctcatgacccaaccc

SEQ ID NO: 11796 - DNA, 531 bp, Homo sapiens
cagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgta

SEQ ID NO: 11797 - DNA, 428 bp, Homo sapiens
atgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgtatttctatccctgcccatgtggagataacttctccatcaccaaggaagatttggagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccaaatcctgaacatttggaatgagcccagatagaaatatcgaatgcaaagctactggcttcacagaggca

SEQ ID NO: 11798 - DNA, 177 bp, Homo sapiens
gttaccccttcggccacccccgctgaccatggcagtgtttcatgacgaggtggaaatcgaggacttccaatatgacgaggactcggagacgtatttctatccctgcccatgtggagataacttctccatcaccaaggatcagtttgtgtgtggagaaacagtcccagccccttcagc

SEQ ID NO: 11799 - DNA, 320 bp, Homo sapiens
  misc_feature 7: n=a, g, c or t
  misc_feature 8: n=a, g, c or t
ataaatnnagagacaaaccggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatgtttaccaaacgagaaccagaagatacgaaaagtgcagattctgatcgagatgtttttaatagagatgaaccttgaagagattatgctaagtgaaataagctagtcaccga

SEQ ID NO: 11800 - DNA, 218 bp, Homo sapiens
  misc_feature 167: y=c or t
  misc_feature 214: y=c or t
tagcagtactccttttttaaaaacactgtaaaagtaaccacaaatatgtgaggacttactattttaaatggaatggaatgagctccatagattagttttgaatataaagtatataaaagtgcatcagtggtttatataggctttaaaaacatgttatcttacagtcytttaaagcagccatagagtttgtatcatttttcaagccaatttcagycagg

SEQ ID NO: 11801 - DNA, 423 bp, Homo sapiens
  misc_feature 376: r=a or g
  misc_feature 411: r=a or g
atgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcraatacagatcttccaagctaatccatgtcttccaraaaatctgtgtc

SEQ ID NO: 11802 - DNA, 217 bp, Homo sapiens
  misc_feature 7: r=a or g
  misc_feature 8: w=a or t
  misc_feature 9: r=a or g
  misc_feature 199: w=a or t
  misc_feature 200: k=g or t
ctatcarwrttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgwktgctttttcagccacac

SEQ ID NO: 11803 - DNA, 328 bp, Homo sapiens
atagtggactcacaacgctgggggagactgttttagtgatcacctgcaactgaggtgtggcaggagggcagaaaagtgcccgcttatccctaccactcctcattgctctggtaatatatagaagttgaaggaacatcctcacgaatctattgattactgtggtcctgatggctttcaaacaaccctaaagtcaccaggcagctcctatgtaaggcagtaaggacactctttcatttattaaatgtatgattcttctgcctcgctccacaaaggattggcagggatgggctacaaggtctgtgctaagtttctaaactgttggtttaag

SEQ ID NO: 11804 - DNA, 323 bp, Homo sapiens
  misc_feature 314: r=a or g
aacttagtccattgtgatgacttaaatagtatctttaggaagtatccaactctctctgagataaaagtgctcagtttgtcactctgcttttaaccctgggatggcttaagagtgtggggtgaggtgtgtggcctatgatcccctggcagtgggacactgactttttccatttgtttgatgttcactatttcctctggtctccgggataatacctttcaacctcctacttgtgtttgccttgctggcatatgctgatgatgttatggctagtataattcatggtcgggcctttttgtttggtcagaacatcatgrtacttccca

SEQ ID NO: 11805 - DNA, 357 bp, Homo sapiens
  misc_feature 78: s=g or c
attcataaaaaagccattttcccaggcagtggttgcaacatcgccgcggaggtagcgagctgagctgacagcgcggasctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagca

SEQ ID NO: 11806 - DNA, 296 bp, Homo sapiens
  misc_feature 134: n=a, g, c or t
  misc_feature 137: w=a or t
  misc_feature 147: r=a or g
  misc_feature 241: r=a or g
  misc_feature 260: k=g or t
  misc_feature 265: k=g or t
  misc_feature 268: n=a, g, c or t
  misc_feature 281: w=a or t
agtagcctggccctccctctttccaaaatggacaagtccctcttgctggaactccccatcctgctctgctgctttaggggtgagtccctagggttgacagctggtaagagtcctgaatttaggaacaggtgagngcwcccatgacaraggccttctcatgggagtcctatggcaactgaagcatgatgagcttctgttctaatgttatgccttctaccaggggtatgtcatgtccccaggrccttaactaaagctcttckccctkccnttatggggggaawtaggtagattagaga

SEQ ID NO: 11807 - DNA, 299 bp, Homo sapiens
  misc_feature 222: w=a or t
  misc_feature 223: y=c or t
  misc_feature 225: w=a or t
  misc_feature 226: y=c or t
  misc_feature 237: k=g or t
  misc_feature 238: r=a or g
aaagaggattatattatttcttctaaggaagtaggagttttcttcctaaaagtgcttacatattgtagtactattacttaaaagttatttatgaagttgggagccttctagtttgcctgtgttgatgtatttttgaaaaacaaaaaattgcaataaaggaatgagcttccatcggtgtgtatggtataccagatacagatggttgcaaggaaaccttttccwycwytagaatagtckrttagtaactgctaagtcctagcttgcatttttgaaaatgcctttctgcatgttagcaccca

SEQ ID NO: 11808 - DNA, 214 bp, Homo sapiens
gcatgctgcattgtgtcgggagttgctgacagccatggcgccgcaggtctggcgtcgacggaccctggagcggtgtctgacggaagtcggcaaagcacgggtcggcccgagtgcttcctcacgattcaagagggattggcatcaaagttcacttctttaacaaaagtgctttatgactttaataaaatattagagaatggtaggatccatggaa

SEQ ID NO: 11809 - DNA, 496 bp, Homo sapiens
  misc_feature 53: s=g or c
agagctgggagaaggcagtgagcgagcaggcggcaggcacggtccgtgcggasaggccgagcgagcgggaagacgcagccaccttcctcaccagccagcccacagcggtttgttccccttctcgggagtgcgccaatgcctgggccgacccaaaccctgtccccaaatggcgagaacaacaacgacatcatccaggataataacgggaccatcattcctttccggaagcacacagtgcgcggggagcgttcctacagttggggaatggcggtcaatgtgtattctacctcgataacccaagagactatgagcagacatgacatcattgcataggttaatgacatagtatctttaaactacacaaaagtggaacagctttgttcaggagcggcctattgccaattcatggacatgctcttccctggctgcattagtttgaagaaagtaaaatttcaagcaaagctggaacatgaaatatattcacaattttaaactt

SEQ ID NO: 11810 - DNA, 345 bp, Homo sapiens
  misc_feature 10: s=g or c
acttgggacsggtccctgagtaggtgaggaggtgggtaggagcttgcttatagaaaagtggaatcgagtagtccttgctggtggagccgctgccggccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggacagcggtccctgcttg

SEQ ID NO: 11811 - DNA, 244 bp, Homo sapiens
cgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaagaggaagacaaacataaagatgaagtgcttaattcaaggtcacacaatgtcggggatggacctccagatttccttactgacc

SEQ ID NO: 11812 - DNA, 306 bp, Homo sapiens
aaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagag

SEQ ID NO: 11813 - DNA, 382 bp, Homo sapiens
gcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattact

SEQ ID NO: 11814 - DNA, 305 bp, Homo sapiens
cacagtctcctggggactcctgagggttaatggatggagcagtctgacttgcagatgctgattctcatatcccttaactctgttttcacatctgaaaattgagaggtatggactcaatcaatggagtcctcagactccattgcctcagactacctagggaactttccagattcaacatgcccagccccactctcacagattctgtttcaaccagtctggggttgggcccagaaacttgaaaagtggttgtgatttgcacttttaataatctctaatccactataacaagttgtctctaatacctc

SEQ ID NO: 11815 - DNA, 430 bp, Homo sapiens
  misc_feature 339: k=g or t
acagcctgcggcgcacggaggcggaccgcagtcgagtctgcagagtgttgggtctgtagccagcaaattacttcatcatctagattatccattcagttgatcctaattagcaaggataacaaggtaacacaaggcttacttatattcacccaacaaaagtgtctctgtggagccacttcccagtgaactacatactgagataggggttcctggatgagaaggaccaaggacagaaccgagaagagtttaggggcaggttatgcgagatggaaatggcgcagataacggagggaaggatttgagggctcaaacgtaggcgtctgtgtttcgcaaaagttkgagacgttctaggctgcctctcgttgcctccatctcgctctgcgcgggttttggaggacattagcattctttcttgtatctccgttgattc

SEQ ID NO: 11816 - DNA, 251 bp, Homo sapiens
tttgttccccttggaaaatgtcctctggagtatcccttacagtcttaagtcatcaggagaggcttggggcccagatccagctgggtcctcaaacaaagacatgtatgtgaagtagtaacattgattattgtagcaaaagtgtgaaattttgatgatggctttactgtaccctttggtctgattgttacttctcttttttattattatttattttattttatatttagaaatggggtgtttggttttttttt

SEQ ID NO: 11817 - DNA, 128 bp, Homo sapiens
cttgtcgtatcccatttaaaggccaatttctgtattcaggcaggcatatgtacatacatgaataaagccaacaaaagtgtgcacatgtattcagtaacagaatttgtccttttatttttgaaggcaga

SEQ ID NO: 11818 - DNA, 358 bp, Homo sapiens
  misc_feature 265: n=a, g, c or t
tcctaactccactggctgcggcatctgtgggaaaagtgtggctgggtcttcgaggagccgcaccaatggcttccgtgctgtcctacgaaagcctggtccacgccgtggccggagccgtggagtggttaatgtgttgctaacaactccactctgggtggtaaacaccagactgaagcttcaaggagcaaaatttaggaatgaagacattgtaccaactaactacaaaggtatcattgatgcttttcatcagatcattcgcgatganggaatctcggctttatggaatggcacatttccctcattgctgttggtcttcaatcctgccatccagttcatgttttatgaaggtttaaaacga

SEQ ID NO: 11819 - DNA, 252 bp, Homo sapiens
  misc_feature 13: k=g or t
  misc_feature 37: m=a or c
  misc_feature 210: r=a or g
agctagcgcggckgccgccggcccgcaatggtgctamcctggttgctgctcgagactgcgcgcagggcggtcctcgggtccgcggaggctgcgctctgcgcatgaaaatgacagatgaaaatagaaaagtgtggctggtctgaagtggatgaagtaggtgaagctctacagatgaatccaagagacttcaaagagaagtacaatgaagtraaaccatccaaatctgacagctagtgttttcttatttagccg

SEQ ID NO: 11820 - DNA, 214 bp, Homo sapiens
cgcgttctattgtaatcctcaatgttggaggtggggcctggtgggacgtgattagatcatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgcgc

SEQ ID NO: 11821 - DNA, 85 bp, Homo sapiens
cgtggagagtttctattttaaacaagaaaagttatcaggaacttttgtgctgccttaaaaacatcactttttaaaattcaccagc

SEQ ID NO: 11822 - DNA, 371 bp, Homo sapiens
  misc_feature 144: w=a or t
caatctcttcacctctaaaacactaaagtgtttccgtttccgacggcactgtttcatgtctgtggtctgccaaatacttgcttaaactatttgacattttctatctttgtgttaacagtggacacagcaaggctttcctacatwagttataataatgtgggaatgatttggttttaattataaactggggtctaaatcctaaagcaaaattgaaactccaagatgcaaagtccagagtggcattttgctactctgtctcatgccttgatagctttccaaaatgaaagttacttgaggcagctcttgtgggtgaaaagttatttgtacagtagagtaagattattaggggtatgtctatacaacaaaagggg

SEQ ID NO: 11823 - DNA, 371 bp, Homo sapiens
aaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaa

SEQ ID NO: 11824 - DNA, 462 bp, Homo sapiens
  misc_feature 13: y=c or t
  misc_feature 431: m=a or c
agcgggttgaggygtaagccctgaggaggcagcgttttctgggcttctgtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggacacatcagtaattattcttgcaggggmaatgctgtctgtagctgagcacttcctggag

SEQ ID NO: 11825 - DNA, 428 bp, Homo sapiens
  misc_feature 13: y=c or t
  misc_feature 159: w=a or t
agcgggttgaggygtaagccctgaggaggcagcgttttctgggcttctgtctggttctctctctccagaaggttctgccggttcccccagctctgggtacccggctctgcatcgcgtcgccatgatgggccatcgtccagtgctcgtgctcagtgagtwctggggatgccaggaaatggacccccttttcgccctcttctgtccatacttttcagtgttgccccagctccgtcccccactgaccgggccactgagccttccaatcatcgtcttcattttggaagcccagtgtcccgctttcctctcttctcttaacctgttcgcttctctgcacaaactcaaactggccttattctcgccgagcctctttccttgacgtgtgctcgtcttgggaagctctttcccactccgcgttctgtccctcaacc

SEQ ID NO: 11826 - DNA, 97 bp, Homo sapiens
gtaaaagttcagatttattactatgtcatgaaacacagtacattcaaatcaaacggcagttttctttctaagtaaatgatttccagtcatctaaaag

SEQ ID NO: 11827 - DNA, 162 bp, Homo sapiens
actgaggaggcggacaagacggtcggggctgcttgctaactccaggaacaggtttaagtttttgaaactgaagtaggcctacacagtaggaactcatgtcatttcttgtaagtaaaccagagcgaatcaggcggtgggtctcggaaaagttcattgttgagg

SEQ ID NO: 11828 - DNA, 298 bp, Homo sapiens
  misc_feature 277: s=g or c
agtattgtttggagccaggtagagtgaagtcctacagagttatcaggttccagaccctgccttctcttctgaaagggtttggaaatcccttgtctccaggttgctgggattgacttcttgctcaattgaaacactcattcaatggagacaaagagaactaatgctttgtgctgattcatatttgaatcgaggcattgggaaccctgtatgccttgtttgtggaaagaaccagtgacaccatcactgagcttcctaaaagttcgaagaagttagagcsctatacactttcttttgaact

SEQ ID NO: 11829 - DNA, 116 bp, Homo sapiens
  misc_feature 18: y=c or t
  misc_feature 20: y=c or t
  misc_feature 71: y=c or t
actcaccctctcttttgyayaggcttaaatcaagtgatgcttacaaaaaagcctggggcaataatcaggayggagtggtggccagccagcctgctcgtgtagtggacgaacgggag

SEQ ID NO: 11830 - DNA, 425 bp, Homo sapiens
aaaaacggacggccatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacggggttggctctggaacctgggctgagatggattcggggagaggctgggtggagcttggcctctacggtctgttcttgcagattcaggagagaaagtggtatgagagcagtgtggtttgtaagttccccaacttccccgctggctcacactgtctccccagaccaatggcctattagcccccaaaaag

SEQ ID NO: 11831 - DNA, 318 bp, Homo sapiens
  misc_feature 278: n=a, g, c or t
  misc_feature 279: n=a, g, c or t
  misc_feature 280: s=g or c
tcaatttattcgtttccccgcccctttcatgaccttcaccgggaggctgaggtcggagtcccgattttctcctgctgctgtggcccggacatggcgactcccggccctgtgattccggaggtcccctttgaaccatcgaagcctccagtcattgaggggctgagccccactgtttacaggaatccagagagtttcaaggaaaagttcgttcgcaagacccgcgagaacccggtggtacccataggtaagtgggtgcggtaggaactgcacaaggagannscagtgatgtcggagggaaggaagtagagaaggaccaga

SEQ ID NO: 11832 - DNA, 350 bp, Homo sapiens
ttcctctctttactcttgcccagcccttgtgggcccctccctctcaactcagtccctagagtgtcctgcctctggctttcgaccactctggaccacaggctctgtcctggggccattctcatctctgtggcagcctcacccgctcactctcttgaacaaccttgtgtcctacttcatagaaaagttgacactaaaggaaacagctgcgtgagccttgctgctgaatttgtgcagggaagcgctgaggacaccataccctgtgttacgcagggacgtcactgccataattggcatccctgtgccccatttctctaactcctccctcccctctgtttccctcccattagccc

SEQ ID NO: 11833 - DNA, 174 bp, Homo sapiens
tatcaactgcctcttaagatttttgtgagggtttactggattaatatttgttaagcacttgcacagtgcctggcatatggtaagtgctaagtgcttgttaaggagaagatagatttttgtcctttgggagaggaaagtgatgtgacaaaagttggaaatcaaagcagtcatggc

SEQ ID NO: 11834 - DNA, 192 bp, Homo sapiens
gtcccgtcggctgcggccgcgcgcggccggggtcgcccaacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcct

SEQ ID NO: 11835 - DNA, 308 bp, Homo sapiens
  misc_feature 160: n=a, g, c or t
aacgggacagtggtgcaggccaatcgcaaccagtcctctggaggcagggagactggggtggagacttcggagactgcagttgcagttgttccgtgtaggctgttgttgactctcgtatgaaagcccacgcgatccaagtgccctgcaggttttggtccangggaaaagttggtctctgcagatgactgtaaatgactacctggaggtcgattaaagtgcggtactgcgggattcagccgatttccttcttcctctgactgcccggaaatatcagccaaaggccagcggtagtaattaacacaattacc

SEQ ID NO: 11836 - DNA, 263 bp, Homo sapiens
  misc_feature 10: n=a, g, c or t
tagggtgcancgccaggtccggtgttggggtgtccgagttgccgccggagaggagtggcctcgcccgcttggtgagtctccaggagtgggacggagggagctggccgggatgaagtctgagactatgtcctgagaagaaagagtgtatcgtattggttgaaaagttggtggggtcgggcttaagcggaggagggggctctctggcccttactcggcagatgggcccggagagaggacgggaggtgccgggagaacatcgaggg

SEQ ID NO: 11837 - DNA, 416 bp, Homo sapiens
tagggtgcagcgccaggtccggtgttggggtgtccgagttgccgccggagaggagtggcctcgcccgcttgagttttgattcatcatggataatctgtcatcagaagaaattcaacagagagctcaccagattactgatgagtctctggaaagtacgaggagaatcctgggtttagccattgagtctcaggatgcaggaatcaagaccatcactatgctggatgaacaaaaggaacaactaaaccgcatagaagaaggcttggaccaaataaataaggacatgagagagacagagaagactttaacagaactcaacaaaatgctgtggcctttgtgtctgcccatgtaatagaacaagaactttgagtctggcaggcttataagacaacatggggagatggtggagaaactcacct

SEQ ID NO: 11838 - DNA, 262 bp, Homo sapiens
  misc_feature 121: n=a, g, c or t
attgcgcaggcaagcgcgtacgcagaagcgtgcgcgcgcccgttcaacgtccggagcatcggtgcagtttcgagggtaaagcctttggcgcggtgatgtggacttttgttctctaactacnaactcccagcatacgtcacccctcacgtgggcgctaggtgtggtttcgtgggatagggtcaccagtgaaaagttgtgcagagcccaacatgagcttcatttccaagctgccacctatctctgcctcctgcgtagatccgga

SEQ ID NO: 11839 - DNA, 190 bp, Homo sapiens
  misc_feature 12: m=a or c
  misc_feature 75: s=g or c
  misc_feature 84: s=g or c
ctacaccagccmaaggaaagaaagctgcaaaagttgttcctgtgaaagccaagaacgtggctgaggatgaagatsaagaagagsatgatgaggacgaggatgacgacgacgacgaagatgatgaagatgatgatgaagatgatgaggaggaggaagaagaggaggaggaagagcctgtcaaagaagcacc

SEQ ID NO: 11840 - DNA, 273 bp, Homo sapiens
  misc_feature 45: n=a, g, c or t
gcatataagaaccctaataggtaggtattatcatctccattggancaaggcagagcaaggagttcaaacacagaaaatgtataattcaagtgtaatgttctttctgccatgttcctctgcctgggtcctgcctggaatcttaaaagtttaattgctctgtcacataaggtagcagatacattgtcctgttaaaatataattaaggccttattttttagacaggagaagacctggttctgtgggagttgtgacagaatagcctttattgcctga

SEQ ID NO: 11841 - DNA, 448 bp, Homo sapiens
atacggtaagagcgaaacaggaggaagccagctctgtgcctggaggggactcgccgccatctcaggtctcttggctttgccagggcccaccggagaaaactgacgacccgtttctgtaatccttatgggagaccaaccttgtgcctccgggagatccactctcccacctggaaacgcacgggaagccaagcctccaaaaaagcgctgcctcctcgctccgcgttgggattatccggaaggaactcccaacggaggtagtaccactctaccctccgcacctcctcctgcatcagccggcctgaagtcgcaccctcctcctccggagaagtagagaaataaatttctcccaccctaaaccagtctttgagtgattgcagtatgactccatttccctggtgcattcatataatagttcacctggtgaaaacaatgagattatttacaatgc

SEQ ID NO: 11842 - DNA, 198 bp, Homo sapiens
  misc_feature 62: n=a, g, c or t
  misc_feature 63: n=a, g, c or t
  misc_feature 66: k=g or t
  misc_feature 146: s=g or c
  misc_feature 148: n=a, g, c or t
  misc_feature 158: k=g or t
  misc_feature 162: n=a, g, c or t
  misc_feature 166: k=g or t
atctgttctgcccaggttttcagatttaattgttcacgatagtgttttttaaatctttcatnnackgttacttgcatctctttacttttcttgattaatcttgccaaaagtttgtctatcttataaaatcttttgaaataactagscntttgaatttkgttnatckatattttgttgatttattctctaatttctgcc

SEQ ID NO: 11843 - DNA, 215 bp, Homo sapiens
tttaaattaaactgcatctcaattcaaatacaaagtaggaaactctgatcactaactttgccaatctgtcaatagactatcaaaagttttagcaagacagaattgtccttttgaaaatcttataccacatccctagacacaaggagaattactttgttcaagttgtcaccttgtgacataaacttaaaactgccttcgccacagtggtaacagtc

SEQ ID NO: 11844 - DNA, 333 bp, Homo sapiens
  misc_feature 24: s=g or c
actttttttttccaagcggctgcsgaagatggcggaggtgcagaggaggaaattaaattggaattggtgattttgggccaaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgcc

SEQ ID NO: 11845 - DNA, 432 bp, Homo sapiens
gcggggcttgtgggaacggcccaccgcaggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactt

SEQ ID NO: 11846 - DNA, 303 bp, Homo sapiens
  misc_feature 243: r=a or g
  misc_feature 255: n=a, g, c or t
gcggggcttgtgggaacggcccaccgcaggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaartgttaggcgcgncgtgcgaagagaccaccccctctacctagttccaaaacactttcatcg

SEQ ID NO: 11847 - DNA, 214 bp, Homo sapiens
agctttcttatcacactcacactctttcctggaaagaccttaggaaagaatgttttcaaccctattagagatcaaaaacatgcaaattaacataacgagatgctatttgcttcctataaaattagcaaaagtttttttcagaacaatgaacaattgtgatgaggccaagatctgatggttattctcatacagtactttgtgtgtggcagagcgg

SEQ ID NO: 11848 - DNA, 329 bp, Homo sapiens
catacatacttaacgaacctacaaattttttttgagcacctacctatgccagacactgtcaattgcttaatataaattaactgctttaaatctcattaacataatggagtctatgtggtaccccgattatactcatgaggaaactgaggcacagagaggttgttatttgcccaaggtatactaggaatagggccaggttacaaccccagatacctgggagtatacatttgagagagctcttggaggtaaaataaacagaacttggggactgagtgtagagtcttgagggaggaggagttaaagtccagtaagatttctactgctagaca

SEQ ID NO: 11849 - DNA, 319 bp, Homo sapiens
cctctgtgttgattaagactgctattcgttgttgtaaggctctgacaggcattgatctaagtgtgtgcacacaatggtaagtactaattcatttcttgattagaagtgttttactgatagtttatgtagttgttcttatcgatcagccttttccccccggcttattttagcaaccctggtcaatgcaggtaatctcaaaggaaaatccccatttgtagctaaagtttatttggtgccaaaatgttttgggggaaaagggattaagaactaatcaaaataaactgaaaatttaaatgttttgttatgttgtactttggaa

SEQ ID NO: 11850 - DNA, 211 bp, Homo sapiens
ccagtcttttattttaaaataaatacttagtcctaacctagtgaattatcaatagcatttaaaattccttctatcctgataccatgaacagtaattttcccttttaagttatgatttgactctaattttgggtcttgtatctggtctttaaacacctttcgttaccctttggaatagaacaatcatgctactgttagcaaaattattgtag

SEQ ID NO: 11851 - DNA, 166 bp, Homo sapiens
atattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccga

SEQ ID NO: 11852 - DNA, 319 bp, Homo sapiens
agtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaaagcagtcctataaagagaaacgaggaggctttgtgttggtgcatgcaggtgcaggttatcattctgaatccaaagccaaggagtaataaacatgtatgcaaacgagcttgtcagaaggcaatt

SEQ ID NO: 11853 - DNA, 359 bp, Homo sapiens
  misc_feature 241: s=g or c
  misc_feature 242: w=a or t
tcgaaaaccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagswgctccaagaaggaaccaagagaccgaggccttcccgctgcccggacccgacaccatgaattttgatgttataaagggcagccagtacgcatcatgtggtctcagcgtgatccatcac

SEQ ID NO: 11854 - DNA, 194 bp, Homo sapiens
aagtataaatgaggagtgagttaaaataactcatgggttttaaacatggatgtctgggaaaatggttgaccaaagtgggaactatgggaggccagagtggtttaggacagaagttattaatttggtaatggccaagctgagtttatggtgacagccctatgagggtgtcctaaaggtcactgaactagatcagg

SEQ ID NO: 11855 - DNA, 140 bp, Homo sapiens
cttgtttttcggttgccgtggttactacgggctcctctttcatccgggctctactggtgaaaataactgcagacggctggtaaaaagttggaatagctttcgttaagcgtcggatgtgtagagtgctgagttaggggctg

SEQ ID NO: 11856 - DNA, 238 bp, Homo sapiens
atattacaggtatcagttaagaaaacaaagcagtggtgttttaccactctgcagagaaagctaaggttgctaaccaaacaaaataactttacactgacaatgccaatttttacatttctttcagaacaagggacactcaaactaccagagaaacggaccaatggactgcgaagaactcctaaacaggtggatccaggtttaccaaagatgcaggtcattaggaactattctggaacac

SEQ ID NO: 11857 - DNA, 342 bp, Homo sapiens
caaaataagaagtggctcagattccttatgtgataacctgtaagaagtagggataggaggctgggcgtggtggctcccagcactttgggaggccaaggtgggcggatcacctgaggttgggagttcgagaccagcctgaccaacatggagaaaccccatctctactaaaaatacaaaattagcttggcatggtagtgcatgcctgtaatcctagctactcgggaggctgaggcaggagaatctcttgaacttaggaggcagaggttgcggtgagccgagatcgtgccattttactccagcctgggcaacaagagcaagactccatctcaaaggaaaaaaaaa

SEQ ID NO: 11858 - DNA, 410 bp, Homo sapiens
  misc_feature 236: w=a or t
  misc_feature 257: n=a, g, c or t
  misc_feature 276: n=a, g, c or t
  misc_feature 321: s=g or c
  misc_feature 364: s=g or c
  misc_feature 378: r=a or g
  misc_feature 395: r=a or g
agaaaataagatcatttgctgcgaatggagaacatctcaggcagccctgatgctccaccgtccttgcagagagaagcttgctcagagtggttactgaaaacaggaacctgcccttctgcaagccctgtgccttcctcgttcctagcagaggaagtatgcggccagtttagcaactgcagttcttctgtgtagcatgggctgcttctccacaaccgcgagaggcccggctgcctgtwtattctggagcagcagcagtngacagacggagaggcagtnactctgcacccagcaatccctctgcagacagctcccacaggagtsatgcccagtgtgtgaaggctctgggcatcaccagcggccccasggaaaaagaaagaratgggaaacagcatgaratccacccctgcacc

SEQ ID NO: 11859 - DNA, 378 bp, Homo sapiens
  misc_feature 141: s=g or c
aaaagctgaatattcttctggagcccttggaggggctccaaactgagaggggagggaagaccgcaggaaaggcggacctcagtgtctgaaaagccagcttagagtgggagggcctgggagtagaagctgctggttgcgcascacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaag

SEQ ID NO: 11860 - DNA, 253 bp, Homo sapiens
agagcatcttttggggggagggaattcagcggatcagtcttaagaggagcttttttttggagcgagaaatcatataaaataaaatgaaataaaacaaggaggaaggcaaccagctgttagggggaaaataaggcagataaaggagcggggagagaaattaattgccaaccaggaggagttgggctgtatttttcaaaggtggggagagtggagcacacaccttgaggaggaaagcgagaagaaagaaaaaagc

SEQ ID NO: 11861 - DNA, 260 bp, Homo sapiens
  misc_feature 147: k=g or t
aaggcaaccagctgttagggggaaaataaggcagataaaggagcggggagagaaattaattgccaaccaggaggagttgggctgtatttttcaaaggtggggagagtggagcacactgggacagacttaaaggcaacagataaagakgtggagatgtgtgtttgtcaaatagatgaccttctgtcttcaataacatattctcctaaattagaacgtaagacatcagagggcataataccaacagacagtgacaatgagaa

SEQ ID NO: 11862 - DNA, 352 bp, Homo sapiens
taaacagtatgatgaagcagatgagggagttgagtgttgagtaaaaagtgacgttaatggtgataagaagagaggtgagggtatgaggggagtgggggacaatgagaaagaattagggttaaggggctgtgctatgagaggggctgaaaataagggcgttggggaaatagagtgagccggtcagataggcggtgggggtgggcaagtgggatacttgggattgagatgatgcagaggttgcagccactggtaaggatgaggtctagggtgtgaccttgagaggatgggtcgcacagtcactgaggaagaggaggtcaacgaaccagaggctggagggtcgcatctggcatgg

SEQ ID NO: 11863 - DNA, 333 bp, Homo sapiens
ttgcgcgtgtgtgtgtgttttagcgattctgatatagagtcactctttaactgatgattttagttgtcttgtgacttatagtcctcttagctttcttgaggtttggaattgttagacctgcagatttagaaataacatttttgaaataatgttttgatctcatcacctttcttaaattaatttctgtattttaaagccaagcacattaactgtaaaataataggtactaattgttaatcttttcttgacaatggttataacatgttattgggtgcaacgccctcaagttaaaagtacaccacagtatttttcttcctgggaacttatggccct

SEQ ID NO: 11864 - DNA, 275 bp, Homo sapiens
atcgcgccactgcactccagcctgggtgacagagcgagactccgtctcaaataaaaaacaacaaaaaacaaaaaaaacttaaaattctttgcttgttagtgaccttgatcatggttctctttgtacgatagttgggcatctgtatttccacttgtgtgaatttgcctttaaattttggttatgggtttcaccttttaaaataatcaaacatatttatcttttcctgtgtgataggtttttttctgtatcttttcctgttaaacacacagacccct

SEQ ID NO: 11865 - DNA, 467 bp, Homo sapiens
  misc_feature 353: n=a, g, c or t
  misc_feature 407: n=a, g, c or t
ttactttactgaactacttacaggcacatttcttcataaggccacacctaatccaaacaagacagtctcccaacactgaagttccaaaataatccttaccactttgtaaaccatttatagctttgaaagtgttaagtgattccttcgttattatttatgcatgttcatgaacttctgctgtacattggaataggagttaacacattcacatttactgtctattttcttgtgtgccttatgagatggcttttctgactgtatctcaatagtctttctttctatgcaggtttataatcagtacaactactgttttctaaaatactactactcaaggctcggagtttgtatttaanttacactgaccaagtacaatgtattccatttcaggaactgaatatttgactgtnaacctttttcccatacgtccagtgtggcatggagcatatggacttgacagacatctctca

SEQ ID NO: 11866 - DNA, 267 bp, Homo sapiens
  misc_feature 13: s=g or c
ttgacctgcgtasaatatgttgatttttaaggtatgttttgtaaattaaaaaaatgctattataaaataatgactttgaagagatggtaatatttctattgaacatattaatggaccactgctatcatgtagtttttaatttagaaggctcaattttagtttttattagaaagaatattgtttagtatcaaatgactattaaaagtatatagtgcaataaaaagaaagacgtgaaggaatgtggaaacattaaaacaaaatcgaacc

SEQ ID NO: 11867 - DNA, 82 bp, Homo sapiens
gacagtccacattaaaataatgagtgttggctctgtgtttgttaatgttttcattaatgcttctattgaaattaattttgcc

SEQ ID NO: 11868 - DNA, 373 bp, Homo sapiens
  misc_feature 7: s=g or c
  misc_feature 8: n=a, g, c or t
  misc_feature 51: s=g or c
  misc_feature 67: s=g or c
  misc_feature 124: r=a or g
  misc_feature 147: y=c or t
  misc_feature 193: r=a or g
  misc_feature 225: n=a, g, c or t
  misc_feature 226: s=g or c
attttgsngcgagttattggcaagttcccctgcagttgtttgtggctgtcsctgtggctggttctgsggtgtgcggccagccatggagcgctctgggcccagcgaagtgacaggctcagacgcrtcgggaccggacccgcagcttgyggtcaccatgggcttcacggggttcggggttcggtaaaaaagctcrcacatttgacttggaagcaatgtttgaacaanstcaaagaacagctgtggaaagaagtcacaaaacactgggccaccaggaacacacctgtagcccagcaaagttgaggccatcgactggctcatcacaacaaggaaggctgtgcaccactgggacccagcagcagctcagcagcagcag

SEQ ID NO: 11869 - DNA, 263 bp, Homo sapiens
ccaggtttttatgtccttggaaatttatgcatatttttagaggtaagacccatcctcatcttcttcctaatccttgacatattgtgaacacagatatatatacaattaagtagttccctgagttacaaatatacttaaatatactttaacttattatagaaggcttacaaaaactgtggataaataacatatatttatcttagttaatgaataactgatgctgaaaataatgtgaatgtcaaattagttctctttttttctag

SEQ ID NO: 11870 - DNA, 249 bp, Homo sapiens
acaaatgtggtccttctagactggaagcacattaggaccttgagtatttttaagctcacttctactatggaatttggccactgaaatagactctggttcacagccacttcttgtacaaaatggcagggtgttaccaaacacctaaaattgactgggtctctgttttaactctttggtgtgttaaaataattctcatgttcacaagaggagggggaggtaaaatggttatgaataatgttaatgttgaga

SEQ ID NO: 11871 - DNA, 343 bp, Homo sapiens
ttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctag

SEQ ID NO: 11872 - DNA, 475 bp, Homo sapiens
  misc_feature 442: s=g or c
ctgagttggaaacccttctttcttggattattcccttgttttagtgaagcacatcttctaatagagaaagtgcataagagttacatttttgagaccttgtgtgtctgcaaactttgattcactgctcaaactttagtttgggagggtacagaagtgcaggatgaaaataatttttctagaattttgttccactatcgtattattactgttgagaagtgcggtgatattctgatcctcatacctttatctgagacgtgttctttctctttggaagtgttccttttttttgttgttgttttttgtttttcgaggcagagtctcgctctgtttcccaggctggagtgcagtggtgtgatctctgctcactgcaagctccgcctcctgggttcatgccattctcctgcctcagcctcctgagtagctgggactacaggtgcctgcsaccacgcccggctaattttttgtagagacgggg

SEQ ID NO: 11873 - DNA, 283 bp, Homo sapiens
tcctgtgtttaaggagctggaatatcagaagtctcagcccccacagcccggagataagtttgtgtctgttgtcagccagttcatcacagtagccagcttcagcttctctgatgttgaagaccttctagcagaagctaaagacctgtttactaaagcagtgaagcactttggggaagaggctggcaaaatacaaccagatgagttctttggcatttttgatcaatttcttcaagctgtgtcagaagccaaacaagaaaacgaaaatatgagaaagaaaaaggag

SEQ ID NO: 11874 - DNA, 207 bp, Homo sapiens
acttctgtttctcaagagcatgttctgtcacactttccacactgccttccccaaattcactctgctcaagtcccccactccatcctcgtgcctccacacagtctgtagataatgctgtactttatttcatcacgaaaatacaagcactgagttgatactgcttcatcctctgaacactccctacctataaaccaatctatattccca

SEQ ID NO: 11875 - DNA, 472 bp, Homo sapiens
ttacatgctcttctgcccagactgttagtaatctagggaccccctttggagctgataagtacagttcagccttttctcctcaaatatataatgactttaacatttcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagct

SEQ ID NO: 11876 - DNA, 238 bp, Homo sapiens
  misc_feature 183: n=a, g, c or t
caatcagataagaagtatactttgattaagtaaaaaaatccctattcttggaaaatacacaataaagtattttgaggtaaagggccataatgtatgcaatctactctcaaaaaattcagaaacatatatttgtgtgcatttgcatgtgcaacagtacacacaaacatacataaagagagcaantgataaggcaaataaggtaacatttaacaataatctgatacacataaatagagaa

SEQ ID NO: 11877 - DNA, 215 bp, Homo sapiens
cgccaggcaattcagtttctgaaaatacacctgtgggtctctagccttgaacatccttggatgctgctttaaatggctgatcctcaatgcttcccttctaactcacaggcccgctcccctacatcaatctcacagaaaaagggacctcttattcatttttttgttttgcagagacaggcttactttgttgcccaggctggttttgaactcctggc

SEQ ID NO: 11878 - DNA, 293 bp, Homo sapiens
tgatagctggtggggaggaggaggaggagtaggcaagtgcagttgatggaggacctactggagagctagagggatgcggctgttttgtgttttctatttcctgtccctggaatagtgccagttctacttctccggttttgacaccctccgtaggccagtttctttagagaacattcttagacttttactgctagcagttctgttcaggtgagggagaaaagggcatggtggagagaaaggaatctaattgtctctagtcatgctgataagttttgaaaatacagaacattagg

SEQ ID NO: 11879 - DNA, 141 bp, Homo sapiens
cagaaataactttggtgcaccaggaggcttgcactgtttgcttgcatgctttatacactgtatcttcggaacagttttacatccacagcaaagttaaacagaaaatacagagttcatcccctaattacctcttctctccct

SEQ ID NO: 11880 - DNA, 326 bp, Homo sapiens
  misc_feature 225: n=a, g, c or t
  misc_feature 270: n=a, g, c or t
  misc_feature 286: w=a or t
gatgtgttattccttctctgcatcgaaggatcaggaagtttgtgctctctgcgtggctaagtttttcacctactaggacgggggtggggtggggagaacaggtgtccttctaaaatacagcacaagctacagcctgcgtccagccataacccaggagtaacatcagaaacaggtgagaatgaccactttaactcaccgggcccgtcgcactgaaataagcaaganctctgaaaagaagatggaaagtgaggaagacagtaattgggaganaagtccagacaatgawgattctggagactctaaggatatccgccttactcttatgg

SEQ ID NO: 11881 - DNA, 372 bp, Homo sapiens
  misc_feature 129: n=a, g, c or t
  misc_feature 291: m=a or c
  misc_feature 292: m=a or c
aggtcccatcatggcggctgaagaggcggatgtggatatcgaaggggacgtggtagcggcggcgggggcacagccaggaagtggtgaaaatacagcatcagttttacaaaaagatcactaatcttgatncatcttggagaacagagaatggccttattccttggaccttggataacaccatcagtgaagagaacagagctgttattgagaaaatgttgttggaagaagaatattatttatctaaaaaatcacaaccggaaaaagtctggcttgatcaaaaggaagatgatmmaaaatacatgaagagtctgcagaaaaacagcaaaaatcatggtacactctcctacaaaaccagccagttactcagtaaag

SEQ ID NO: 11882 - DNA, 322 bp, Homo sapiens
  misc_feature 78: k=g or t
  misc_feature 79: k=g or t
  misc_feature 92: k=g or t
  misc_feature 93: k=g or t
  misc_feature 94: k=g or t
tgctcttgactgataacagctctgtcaatattttgatgccacaataaacttgatttttctttacattccttttatttkkcctttctctaaakkkaatttgttttataagcctatcgttttaccatttcattttcttacataagtacaagtggttaatgtaccacatacttcagtataggcatttgttcttgagtgtgtcaaaatacagctagttactgtgccaattaagacccagttgtatttcacccatctgtttcttcttggctaatctctgtacttctgccttttaattactgggcccttattccttattttctgtgag

SEQ ID NO: 11883 - DNA, 238 bp, Homo sapiens
gagattgtctgaaggagtttggctaacttccatcttgggaatacctttcacagaggctgatgctaatgggaatgtgattgtctggtaatgtaacagcgttaatattgtttttattgagttagctggactactagctattgtatgctggagaaaatacagtttatggtacaatgatctaatgttgatagcttgccagacatctctcttgctaagcatgtaattcatctaagtaaccccg

SEQ ID NO: 11884 - DNA, 399 bp, Homo sapiens
  misc_feature 239: n=a, g, c or t
  misc_feature 283: n=a, g, c or t
  misc_feature 321: n=a, g, c or t
  misc_feature 322: n=a, g, c or t
  misc_feature 323: n=a, g, c or t
  misc_feature 340: n=a, g, c or t
  misc_feature 341: w=a or t
  misc_feature 368: n=a, g, c or t
  misc_feature 374: n=a, g, c or t
  misc_feature 375: y=c or t
  misc_feature 382: n=a, g, c or t
  misc_feature 385: n=a, g, c or t
ttcgggcggggcctcctggtctcgcgggattgcgcgcctgctagtcgcttcctctttctgagggtggtgatcccccatcacggagtgtcctggtggcggtgtacggtttcgaacacttcagtccacaaggataacaaccaacattttcagagcacttggcaatttacaaaatacatctgcctgaaggtacagcactaccagcctcattttacgtgtgtgaaaactgaagcacagaagantggtgacttgtcagacgctgcataggtggtcagcattatggtcntcatccctccatcaaccttaatcacatactgcatgtgnnnagcaggaagaggggtcnwgagaataggaggggagatcaaaggagncatcgnygtctatntgncatcaaaactggca

SEQ ID NO: 11885 - DNA, 341 bp, Homo sapiens
  misc_feature 287: n=a, g, c or t
ctttatgacattttggtgtctagagttacttgggaagaccaagttcgatcattgctctttgatcaataaaatacattttttcgctctgtgaggaatgtattttacttatgaatggtttttaatattttaggctgttgccaaaatggttcaacagtgctgtacttatgttgaggaaatcacagaccttcctatcaaacttcgattaattgatactctacgaatggttaccgaagcaagatttatgttgaaattgagcgtgcgcgactgactaaaacattagcaactcnaaaagaacaaaatggtgatgtgaaagaggcagcctccattttacaggagttaca

SEQ ID NO: 11886 - DNA, 286 bp, Homo sapiens
  misc_feature 2: s=g or c
  misc_feature 16: n=a, g, c or t
  misc_feature 18: s=g or c
  misc_feature 165: s=g or c
  misc_feature 175: s=g or c
  misc_feature 255: s=g or c
  misc_feature 259: s=g or c
  misc_feature 286: n=a, g, c or t
asatcgcgctgggganasgccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacasccccttcgtsccaagctggagagcagtggcatgatctcggctcactgcagcttctacttcctggcctcaagcagtctttccacctcagcstctsaacgcactggaattacagatgtgagcn

SEQ ID NO: 11887 - DNA, 416 bp, Homo sapiens
ttttttctgccctttcccttgcgggtcgcaccccgcccaggcccctctcccgccccaggtctctcagtcttttttctcagggcgtgtagcttcctgcacacccggaagcagatcgcgcggggaaaagatcacagcgctgccgcgtcagtttccgtctacctggactaaacatttgcttcgccccgtctgcctgaatcgaacgtgcacttggcagtcttcccttgtccatacccgtttcctggggatcgctacggaccttaaaataccagcaacagccccttcgccccaaggtcttgctctgtcagactagagtacagtgccatgatctccgctcactgcagcctcaacctcctgggctcaagcagtctttctgcctcagagtgctgggattacagacgggagccaccacgccaggc

SEQ ID NO: 11888 - DNA, 409 bp, Homo sapiens
  misc_feature 115: s=g or c
  misc_feature 354: n=a, g, c or t
  misc_feature 355: k=g or t
  misc_feature 356: n=a, g, c or t
tttttggtcggctgtgtagactgttgggtaggctgcgtgctagcttcggcgcggatccctgggcgtccgtacgtcggagtccttcgtcctccagggtccctgttctttgcgccascgggaaccactatctctgcactcctggggttttgttacatggctgctttcctcaaaatgagtgttagtgtcaatttcttcagacctttcaccaggtttttggtgccatttacccttcataggaagagaaataacttaacaattttgcagagatacatgtcttccaaaataccagctgttacttatcctaaaaatgagagtacacccccttctgaagagctagagttggataagtggaankntacatgaaatctagtgtgcaagaagaatgtgtttcaacaatctcaagcagtaa

SEQ ID NO: 11889 - DNA, 197 bp, Homo sapiens
tgaacaatgtaaataatttgtttccttgcaaatatttaaaaatttttcccaaatgattttaaatgtattttgtttaaatgcaaaataccaggtgcatttggaatcatcccagtggggagcttgttactggagtaggaaagagataagctggaaagaaattgtgtgctatggcaaatttttatactacttttaggcaa

SEQ ID NO: 11890 - DNA, 415 bp, Homo sapiens
  misc_feature 274: m=a or c
  misc_feature 275: k=g or t
  misc_feature 276: r=a or g
  misc_feature 316: n=a, g, c or t
  misc_feature 320: m=a or c
  misc_feature 325: r=a or g
  misc_feature 329: w=a or t
ttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatamkrttgtaaatattcaataactacagtgtttaaaaagcatgcntcamcatargagwagcagcaatgtaattatttgaagtaacacttaacacactccgctgcattgaatgcagtggattgatcagaatgttaagactgacat

SEQ ID NO: 11891 - DNA, 360 bp, Homo sapiens
agtacagagacacgtagtaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccg

SEQ ID NO: 11892 - DNA, 535 bp, Homo sapiens
  misc_feature 123: m=a or c
  misc_feature 282: w=a or t
tcttcaggtccttgcgccttatttggttttgtatattcaacgaactgaaatatttggaattcctatttctacgtatttggtggtccataagactttgtcaaatgtaaacctacagtttgatamgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttwtctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtata

SEQ ID NO: 11893 - DNA, 149 bp, Homo sapiens
  misc_feature 115: w=a or t
  misc_feature 116: n=a, g, c or t
  misc_feature 118: w=a or t
gaagcttgaaagacttggtaatggcgacgggtttggtaagtaggaaagtttcggttgaggagtaagagctgccgcgggagagtaacccgcgcgggggaggccgacgtcggtcggwngwgggggtacgagagctgctggtggtgttgtcg

SEQ ID NO: 11894 - DNA, 304 bp, Homo sapiens
  misc_feature 79: r=a or g
  misc_feature 134: k=g or t
cattttctcattaccatggtcttacgaggatagatgttgtatttatccttgttttacagatagaaactgagacatggaragtgaagtaactggctccaatcccagtgctaagtggtcaagccagggtcagaatkgtaacagttgagttcatgagtactggcccttaacaactctgctggagtgcctcctttggttaaatactagtagttcatatgtcggaaactcatccttcattttcttcaatgaaaatacggcattttacagcagtgctgtccaatagaattgttgaaattatggaaatacc

SEQ ID NO: 11895 - DNA, 405 bp, Homo sapiens
agttcttgataaattgccttgaagtttaccttgtgctggagagccttatgataactccaaagactttcttacggtataatacatgttgtttaggattgtgtttcttagtcactgaagataataaatattaaaatggatgttttcatcagaaaattttcatgttttcctttaaggtaacataattgtaagaattgtttaataaaatactcaggaaattctaaaggtttctcccaatacctaaacatttctgaacatcagtattgcagttgtggaagagcagaaggaggatacatttgtttgtgttgctccccaaaattccaccttgcatttgcatcacaaacttccctcaattgaggcagttttctttgttagaacattaagtctgtgtattgtaatagagtgggc

SEQ ID NO: 11896 - DNA, 291 bp, Homo sapiens
gcttctgcttccgcgaccccggcggtgcagggcgggtggagtcgcggagtagtcctcatggccgccccgccggagcccggtgagcccgaggagaggaaggtagaattagaagatcatgtgatgttggagtaggagggtttatcttggtgactttgggatgctggtttcattgtaggtataattatgcaaagcaaagaatccaggaaagaattgccagagaagaaattaaaaagaagatattatatgaaggtacccacctcgatcctgaaagaaaacacaacggcagcagca

SEQ ID NO: 11897 - DNA, 521 bp, Homo sapiens
  misc_feature 331: s=g or c
gaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtsgtggtggagcaataaattctagacaagctcagaagcgaactcgggaagcaacctccacccccgagatctccttggaagcagaacccatagaactcgtggaaactgctggagatgaaattgtggacctcacttgtgaatctttagagctgtggtggttgatctgactcacaatgactctgttgtgattgtt

SEQ ID NO: 11898 - DNA, 174 bp, Homo sapiens
taaatgtgaacagtagtgcaatcagttgaaaatactggattataatctctaatgtgagttatttcatgaagtgtgtgagcaaataataatatctgtgccagttaccaatgtattacctcccattgcctcctccaaatgtagttctccttgcctgctctgcaaaaatgtatctgg

SEQ ID NO: 11899 - DNA, 319 bp, Homo sapiens
ctttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcaggg

SEQ ID NO: 11900 - DNA, 204 bp, Homo sapiens
ttcctttattgcctagctgcttgtgtttgagtggttgtcctatgagcaatgcatttggagttcttcagctttcactacttctctgttgcttgctaatcatgtaactactaaaatactgtacaaaattgttttttcacactaacaaatgtgtatatggagaagagggctcatgtgatgatcatttgtgaacttagatttttgagg

SEQ ID NO: 11901 - DNA, 377 bp, Homo sapiens
tacagcttaattttctcataagaacctcaggttgagaagggattagattatctagttatcacctctagttgatgtgataagatggggaacttaaattcaaagactagagtttcttacagttttgtaaggtaaatactgtcatcaagtttgatcaccaggactgtttagtttcccttaaaatacttttactgagttagagttaatgttatgcctttagtgtgtactaagaagtgttataagaaaaggacttaaaaaaatcttttgtataaaataacaataactgccattcatttaacccttagtgtatgccaggcataatttgttacaagcaacgaattttcaaactttaactgtatctctgatgctggtgatgatct

SEQ ID NO: 11902 - DNA, 120 bp, Homo sapiens
atttgggattgttagaagtcatagctttaacataaaatagaaggagcaaagtatgtacagctacaacctttagttagaagagggaaagaaattaggaaaatcaagggagaagagcacaga

SEQ ID NO: 11903 - DNA, 855 bp, Homo sapiens
tcgggtcaggtaaaaatggcctcctggcgtaacttttcaaggttttttggaggctttttgtaaattgtgataggaactttggaccttgaacttacgtatcatgtggagaagagccaatttaacaaactaggaagatgaaaagggaaattgtggccaaaactttgggaaaaggaggttcttaaaatcagtgtttcccctttgtggcaacttgtagaaaaaaaagaaaaaccttctagagctgatttgatggacaatggagagagctttccctgtgattataaaaaaggaagctagctgctctacggtcatctttgcttagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgcccaaccctgtgatcagaacctccaaatactgccatgagaaactagagggcaggtcttcataaaagccctttgaacccccttcctgccctgtgttaggagatagggatattggcccctcactgcagct

SEQ ID NO: 11904 - DNA, 104 bp, Homo sapiens
caaaatagaatatctctgagataataaatagaattattccatatcagaggaatgattgacaattgatgtaaggtggccttttttttggacgattgatgtgaggg

SEQ ID NO: 11905 - DNA, 457 bp, Homo sapiens
  misc_feature 5: w=a or t
  misc_feature 419: r=a or g
  misc_feature 420: n=a, g, c or t
ctgtwtttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactagaaaacatcagagtgaattttccatgaatgtttttaatattctcatctcaacattgtgatatatgctactaaaaaccttttcatatacatcttacctcatttcaagtgaattattttaatcttttcctctctttccaaarntttacaggaatgtttagtgtaattggatttcgctatc

SEQ ID NO: 11906 - DNA, 143 bp, Homo sapiens
taggcccctgtttttgtgattgagggaagttccaagttcattggaaagcacctgctgcttaaaacaattttaaaaaaaatagctttcttgagtacagcaaatcaaaactccatcccagggctttcaaaatagactggtacgca

SEQ ID NO: 11907 - DNA, 244 bp, Homo sapiens
aattttcgagtgaaggacccggagccgaaacaccggtaggagcggggaggtgggtactacacaaccgtctccagccttggtctgagtggactgtcctgcaggtaaagtacttctcttcctggtcaggttgtcacgctcttacttcctgccttgtccgcgagcgcctggaaaatagaggccttgagcccgagcggcgaagtccgggcttgaagctgccgctgggagatttctcttgctgtcaccc

SEQ ID NO: 11908 - DNA, 148 bp, Homo sapiens
gatcaagcttgtcatttatatgtgtataaattatatatattgacttttctatagtatttcttttaaataaatcatacagttctcacaacagcattgaatgtactttattttaaaatagagggcccttattttataaaatgtatactcc

SEQ ID NO: 11909 - DNA, 472 bp, Homo sapiens
cccgcctgcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgcacgcgtcgggccctgcggagctggattcgcagctcagatgccttctcgaagctcgctcggtctgtgattgagtagacaatcaggtatgcgtccccgacctgcatgcagtggtcatggagccattcattttcccccttattttcccacatatccaggagtataatcgttgcactttccccatcaaccatcagggttcgttcata

SEQ ID NO: 11910 - DNA, 468 bp, Homo sapiens
  misc_feature 43: r=a or g
  misc_feature 203: k=g or t
attcctaccttagcgcacttaacggttaggagaggagaaagcrgcaaccggggttgtagttcatgggcttgactgcttcttttctccgcgggcgccgaccaggcctggctcgcgcctctcccaggacccgccggctgcgagatatgtaagccgcgatacttccgcgaccgcgctcgtcttggtttccgtggttgttgctgggkcaacagcaggctcctcccctagctttgtactcgctctgcgcgctactaattggtgctagccgtctgcggggggcggggtgaagctgtgatggacattttcctcctccgctccattttgggaaaatagcgtctctccagctacggcaaagggttccgccattttgggcgtggctaggaagctgccatgttgagtgtggctgaggaagttgagtgcagtttctcccagataccttctttaccaaaaaagcaatcctaactgctccgt

SEQ ID NO: 11911 - DNA, 316 bp, Homo sapiens
  misc_feature 129: y=c or t
aagtataccaattttaaggttagaattaaaattttgcacatatgcttcttgatattctgaaatgtattctgtggcttaattatcttattcatacacatttcacttggctttttacccctaggaaataaytgtccaagtatatatctcgtcttctttcttgtaactttgattaaactgcttacttcaacttacaacattgtaaagccagaatacctcattttaacagtgaaaaaaaatatgatgacctgatgtgttctcttgtatttgattgaactacctaaataggcttaactgtaataataaatatacaattttg

SEQ ID NO: 11912 - DNA, 333 bp, Homo sapiens
ataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcac

SEQ ID NO: 11913 - DNA, 297 bp, Homo sapiens
  misc_feature 19: w=a or t
  misc_feature 63: y=c or t
ttagagtgagttgtgtaawtgtgaagggccaaaatatctttaacagaatcattgctacaaagytgtaaagaatgggtggccttatttgttgtcgcgggtttatagtaatagtttacaatacaataagaaagctctttcagtttttttgtgatactgaatctctgtgaaaatggtaggatgctttcttccattttacaaaataggaaatttaggcataaggagagaacttctccaaggccgcatgttaaattggtgacaaagttggaactgtaactcccatattttcactactactgc

SEQ ID NO: 11914 - DNA, 260 bp, Homo sapiens
tgtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactattagctttgaagtttaaatccaatggagaagactcaagaaacagtccaaa

SEQ ID NO: 11915 - DNA, 456 bp, Homo sapiens
actgagctcgtaagtgtatctcataactataagagctacatgaagaaaataggaataacacacctggtatttaaacacaatcttcaaaattcttgcaacattaaacatagtaaaatgccagaatataaaatgaggtgtgctaatggtcacaggattgaggccagcattacagtttggggtgatttttcttttatttgctccctcactttgtttcctagatgctagtaggggtatctgggttgcttgagataccattttgcaattgccccttctctttctgcctaccatcttctcaggccctgatgagcttattggtaggcaactgggctgctttagtgttgaacttgtactttagaaactgaagtggaatcattgaaaactttcaataaagctttaaagttccatttacttttgaagcacagctaagctcctctgaaggcagctggtttgttgcaa

SEQ ID NO: 11916 - DNA, 196 bp, Homo sapiens
aaaataggaggtgactccgcattcctcttgcttggaaatgatccccaggatggaattgtgtccagggtgtgaggttgtttgtgaatcagtcctttcagatagaatatatgaggcttgaaactacatagtgcttatcaccaagaggtatataggtttgtcagagcaagaagaccactctcccctccacctgaccccg

SEQ ID NO: 11917 - DNA, 218 bp, Homo sapiens
ttggtaaccttaaattgtgtgttttggtaagtaataactaactgtttcctcatagctagttctcaagctgcatgtaagattttaacgggaagagaaaataggcctggacctgaaggtctcaaatatgttgagaagaaagtatgaactataaggaacttgagatgtagatttattttgcaggaaatacgaggaaaataggaaagaagtgtttgccgcat

SEQ ID NO: 11918 - DNA, 145 bp, Homo sapiens
agcagttcttccaccttttcgatgactgttgaaatcctgaagattagctgtccgactggttaggtaacacaagatgattcaaacacagctttcatgtttgagaaaataggtaacttgtgattcttagtccttgcactaataaagc

SEQ ID NO: 11919 - DNA, 468 bp, Homo sapiens
  misc_feature 311: w=a or t
  misc_feature 366: n=a, g, c or t
  misc_feature 367: r=a or g
  misc_feature 385: k=g or t
  misc_feature 386: k=g or t
  misc_feature 387: s=g or c
  misc_feature 388: s=g or c
  misc_feature 412: n=a, g, c or t
  misc_feature 413: k=g or t
taatctctgcggcagtcttctgtcggaagtgacgttgctatcccagaatcctcagagaaggagtagcgcgttcgtgcgtcctagttccagtacagcgtggagggtttaggcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctawatgagaagaaacttcaagaggttgatagtttatggaaagaatttgaaactccagnrgaaagcaaacaaaatcakkssacagctctgatggaggggcaaaankcaataagcagctgaaaaaagttctgaggaaaatagtaaaagaagcccatgaaccg

SEQ ID NO: 11920 - DNA, 480 bp, Homo sapiens
  misc_feature 299: n=a, g, c or t
  misc_feature 301: w=a or t
ttaatgaagctattgaggcagaaattcccttggttgtgtgtatcactgaaggaattccccagcaggacatggtacgagtcaagcacaaactgctgcgccaggaaaagacaaggctaattgggcccaactgccctggagtcatcaatcctggagaatgtaaaattggcatcatgcctggccatattcacaaaaaaggaaggattggcattgtgtccagatctggcaccctgacttatgaagcagttcaccaaacaacgcaagttggattggggcagtctttgtgcgttggcattggaggnawccttttaatggaacagattttattgactgcctcgaaatctttttgaacgattctgccacagaaggcatcatattgattggtgaaattggtggtaatgcagaagagaatgctgcagaatttttgaagcaacataattcaggtccaaattccaagcctgtagtgtccttcattgctggttt

SEQ ID NO: 11921 - DNA, 241 bp, Homo sapiens
  misc_feature 142: r=a or g
  misc_feature 215: m=a or c
  misc_feature 216: r=a or g
  misc_feature 234: r=a or g
cgcttcctttcttatttttaaagaaaatagtcccctcctaataggagaccagctgcggcggtctctggccgcccagcgtgctcagcaaagcatgcgggtccttggaaccccttttccgggaaggcggctgccaccaggcaarttctcaaactgcctagctgcgagtgaggggcctgtagtggggcctccgaatgcaatagccgaggaggaggggmrgggatcccgctttacaarctctcag

SEQ ID NO: 11922 - DNA, 152 bp, Homo sapiens
cagggtattttgggagagacacacatgaaactggtatcagtgattatgcaaaatagtctaggacctggagccccagtgtccagcacatagtgtgtgttttagaaatactaatgagtagacagttgttgcctgggtagagtggggtagtgggg

SEQ ID NO: 11923 - DNA, 644 bp, Homo sapiens
  misc_feature 17: y=c or t
  misc_feature 375: r=a or g
  misc_feature 381: r=a or g
  misc_feature 385: y=c or t
  misc_feature 404: k=g or t
  misc_feature 405: y=c or t
  misc_feature 415: y=c or t
  misc_feature 437: s=g or c
  misc_feature 448: r=a or g
  misc_feature 459: y=c or t
  misc_feature 463: w=a or t
  misc_feature 557: n=a, g, c or t
tagatttggggataggyggtggagttaagagcagtgttttgggggcaggaggtggatctcataaagtacattgtcaaaggtgaggagaattacaaagaaacttcttaagggtgggggagatgataaagaaccttcttaagagtggggcagattacaaagtacattgatcagttagggtggggcagaaacaaatgacaatggtggaatgtcttcagttaaggctgttttcacttctgtggatcttcagttgcttcaggccatctggatgtatacgtgcaggtcactgggatatgatggcttagcttggactcagaggcctgacattcctgtcttcttatgttaataagaaaaataaaacaaaatagtggtaaagtrttgggrtggygaaaatttttggggggtgkyatggagagayaatgggcgatgtttctcagggstgcttcaagcrggattaggggyggcwtgggaatctagagtgggagagattaagctgaaagaagattttgtggtaaggggtgatattgtgggattgttagaagaaacatttgtcgtataanatgattggtgagggcctggatatggttttgtattaattgagaaactaaacagaagacacaaggtccaaataagagaaggagaaaaac

SEQ ID NO: 11924 - DNA, 229 bp, Homo sapiens
gatgatagaaaatagttacatattgctttactctgtgccgggcattattctaacacttcacgtctcttcacagatctgatccttataactgcacagtgaggcaggctctgctatcatgcccattttacagatgaagagactgagatttagaggttatataacatgcccaactgattggtttgggaataatcaaactgagattataaattctgcataatttctttttaca

SEQ ID NO: 11925 - DNA, 375 bp, Homo sapiens
ctcccggcgcggcagctgtctgggctctgcgcgccgcctaggtgtctgggcgatctatgggcaagagcaagggccacgatgacagattacggcgaggagcagcgcaacgagctggaggccctggagtccatctaccctgactccttcacagcttgattgcacattgatccaaccctcctaacaactagtcttccaaaatataaatggactctcctgataccacattctccttcagtagtgcttcacttgacaaggtcctgctaagtattatcagaaaatccacccagcttcaccattactgtgacgtctgaggctggagaaaatgatgaaactgtccagactaccctcaagtttacatacagtgaaaaataccca

SEQ ID NO: 11926 - DNA, 411 bp, Homo sapiens
  misc_feature 28: s=g or c
ctggccgccgcccgctccggcgcggcastgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacccagcttcaccattactgtgacgtctgaggctggagaaaatgatgaaactgtccagactaccctcaagtttacatacagtgaaaaatacccagatgaagctcccctttatgaaatattctcccaggaaaatctagaagataatgatgtctcagacattttaaaattactagcattacaggctgagaaaatcttggtatggtgatgatttttactctagtgacagctgtg

SEQ ID NO: 11927 - DNA, 236 bp, Homo sapiens
aatcacacaggatccggagctggtgctgataacagcggaatcccccgtctacctctctccttggtcctggaacagcgctactgatcaccaagtagccacaaaatataataaaccctcagcacttgctcagtagttttgtgaaagtctcaagtaaaagagacacaaacaaaaaattctttttcgtgaagaactccaaaaataaaattctctagagataaaaaaaaaaaaaaaaaaag

SEQ ID NO: 11928 - DNA, 502 bp, Homo sapiens
  misc_feature 475: w=a or t
gttggccctgtgatccctcaagactggtccacggagtgtatgaccacaaacagccatcaaggtactgaggacagtacagattagtgtgcacagagatctctgtagaaagagtagctgccctttctcagggcagatgatgctttgagaacatactttggccattacccccagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatctttttgtatttaaggattctgagattttgcttgagcaggattagataaggctgttctttaaatgtctgawatggaacagatttcaaaaaaaaacccc

SEQ ID NO: 11929 - DNA, 482 bp, Homo sapiens
  misc_feature 358: m=a or c
  misc_feature 359: n=a, g, c or t
  misc_feature 360: r=a or g
gccagccgccacttccgagagcgcctgccgcccctgcgccgccgagccagctgccagaatgccgaactggggaggaggcaagaaatgtggggtgtgtcagaagacggtttactttgccgaagaggttcagtgcgaaggcaacagcttccataaatcctgcttcctgtgcatggtctgcaagaagaatctggacagtaccactgtggccgtgcatggtgaggagatttactgcaagtcctgctacggcaagaagtatgggcccaaaggctatggctacgggctgccaccccccaccaaagttaaaatataattgtcattccaggaaatcaaaatcttttagaatagcacactccaaacmnrgtgatgggaacactactaattccttagacttcctttggcagcattacttttgataagaagtctccaaataaaatacaaaattttggcacagacattttaatcttgtcaagacaatgtaagga

SEQ ID NO: 11930 - DNA, 335 bp, Homo sapiens
caagagatccagagatatgaaattacacttcaggtttaaaccttaaggggaaatattctttgtcaaagaattaaagattagatgccataaaatatactttctgtacactcatcaacccaggtcaggagaaactaggttctggagtcctacgtggttagttctaggaggtaccaacagtctctcaaccaaaggatgagcaatgagtcatcttagaagggataaataagaacatcatatccagatagggaaacatgcttcagtttctgggtggatttgagagaaggaagtatatacaaatatatgaagaaaaaggcaatgaacaaaggagaaatggt

SEQ ID NO: 11931 - DNA, 607 bp, Homo sapiens
  misc_feature 571: n=a, g, c or t
  misc_feature 577: w=a or t
ataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacattaantattgwcttaagttgtaaaaattgagagtacaatat

SEQ ID NO: 11932 - DNA, 141 bp, Homo sapiens
accatttggtgtctgcctcttggggtagtgactgccattatgttagccttggactggcaaagaaaatatagcatacaagatgctatatgaatctggatactgtgaagaaaatcttacccctaaacaattcttaatgacccc

SEQ ID NO: 11933 - DNA, 143 bp, Homo sapiens
ttacttatccccaccccatttctgagaaagtaaccttttgatttgcttatgtgctttatgacttcttttgtgggaaaatatataacctaaagtttcttgttttatgtgtacagttcagtggcattaagcacattcatattgtg

SEQ ID NO: 11934 - DNA, 217 bp, Homo sapiens
cctttattagcgacccttaaaataacaagaataattaatctgctggtttagcttaaatttggtcttatgacaggcatgcacacgagctggcttgtcattaccctatcctcctccatgattctgtcttgtgaaatcatgaatggaatttctatgaaaatatatagcaaataggttcctgacaaaattactattcacataattcatcatccttaagtga

SEQ ID NO: 11935 - DNA, 511 bp, Homo sapiens
aaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaaggccactactgattaggacacttatggagaacgtgggtagcact

SEQ ID NO: 11936 - DNA, 393 bp, Homo sapiens
  misc_feature 358: n=a, g, c or t
  misc_feature 385: w=a or t
acacttctgtaaaattaatggccagtttttcctgacaatttataggaacagtatctttcaacatactccctacattatccttcaatatctgcaatacttgtctttagtaactgtatttctggtaagattatgatttcatgagaaacaattgaaaatatatccgatctaattaaattaggtcagcctgctattgctctcaggtgttgcctgtcttcacgaatgattagtatcgattgacctctttcttaggtggttttaagtcttcagttctcgtcagcatgaactaacttctcatcatggaggcacatagtaactgcattctcagaagatttatgcagttaaccaattgatacaagtnttctttttcttgaattttttttttttwaattgagg

SEQ ID NO: 11937 - DNA, 168 bp, Homo sapiens
caaaatatatgtaattcaggaacatgctcaaattgaatttcttctcttccctttaaagctgcctctcctggtttgttgttgttttcctattgtggtcaatagcagtaccatttacctttttagctgttaagttattaaacaggttattctttttagttatcttcccca

SEQ ID NO: 11938 - DNA, 139 bp, Homo sapiens
  misc_feature 103: n=a, g, c or t
cttggcactatgtgatgcattaaatacccatatttgtgttgtgtatctgacatgtatcttcctattaaaatatcagcaccacaagacaggaactgttcatttntttcatggaggtattggtttcatgtggtatttctag

SEQ ID NO: 11939 - DNA, 399 bp, Homo sapiens
  misc_feature 151: s=g or c
  misc_feature 328: r=a or g
agttcagagagaggagagggagaaggagagaggggcagaggggaagggagagagggagagcacgcgagacggaaaggagcgcctcagagtctctgaagcacgcaagagataaccgattaggaatttttcgggcaactgtcacccggatagstgtcagagaatcatcatcaccgcaactctgacgtttcctacaagaagttagagacttaagcagtattggcatcggatggaaatgggatgcatgctgctgtggaaaatatccctgagctgaagaagtgcaactatgtgttgtgtgtgctaaatgcccagaagaacccagacccagtgrgtaagagagacgaaatgtggagagaatgactaacgacaaatccgtgaatttgttctctggagttgctaatt

SEQ ID NO: 11940 - DNA, 87 bp, Homo sapiens
  misc_feature 7: m=a or c
ggagttmgcgacagggagggatgcgcgcctgggtgtagttgtgggggaggaagtcttttatctcttacccacctcccatccttcccc

SEQ ID NO: 11941 - DNA, 175 bp, Homo sapiens
agccggagttagcgacagggagggatgcgcgcctgggtgtagttgtgggggaggaagtggctagctcaggtctgtgtggaaggaggaaggcagggagaggtagaaggggtggaggagtcaggaggaataggccgcagcagccctggaaatgatcaggaaggcaggcagtgggtgc

SEQ ID NO: 11942 - DNA, 433 bp, Homo sapiens
agccggagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcaggtcccccaggcagaacagccacgctccaggccaggctgtccctactgcctggtggagggggaacttgacctctgggagggcgccgctcttgcatagctgagcgagcccgggtgcgctggtctgtgtggaaggaggaaggcagggagaggtagaaggggtggaggagtcaggaggaataggccgcagcagccctggaaatgatcaggaaggcaggcagtgggtgc

SEQ ID NO: 11943 - DNA, 442 bp, Homo sapiens
  misc_feature 386: s=g or c
  misc_feature 387: n=a, g, c or t
  misc_feature 388: r=a or g
  misc_feature 389: w=a or t
  misc_feature 402: k=g or t
  misc_feature 411: r=a or g
agccggagttagcgacagggagggatgcgcgcctgggtgtagttgtgggggaggaagtggctagctcagggcttcaggggacagacagggagagatgactgagttagcgacagggagggatgcgcgcctgggtgtagttgtgggggaggaagtggctagctcagggcttcaggggacagacagggagagatgactgagttagatgagactagggggcgggctgggggtgcgagaaggaagcttggcaaggagactaggtctagggggaccacagtggggcaggctgcatggaaaatatccgcaggtcccccaggcagaacagccacgacaatcaaaataggcaatacaaagggagatacaggtttagtgggagtaacttattgtgsnrwttttgtactgcakgtaaacaarcaaacatcaatttcttgaaggaaactggttc

SEQ ID NO: 11944 - DNA, 352 bp, Homo sapiens
agccggagttagcgacagggagggatgcgcgcctgggtgtagttgtgggggaggaagtggctagctcagggcttcaggggacagacagggagagatgactgagttagcgacagggagggatgcgcgcctgggtgtagttgtgggggaggaagtggctagctcagggcttcagaggaacagcagcacctgggagagggaatgagcttgttgggctgaggctggacggagtgagtagcagtctgcctggcagcagtacagagctgatatgttgagttgatgagtttcctgaggcaggtctgtatttcagcttgtacctagaaggcaaggaccaggccacctttgtatccccgtg

SEQ ID NO: 11945 - DNA, 272 bp, Homo sapiens
  misc_feature 270: r=a or g
gtagccctaggagaagtcatcaccactttgtccaccatgggtgaattatgaatcagtagctatgccaggcctcagctgggccacatctggagaactggggtgagggcacaacatcacaaaatatctggccccagtctggtcactcatcccttttagggcaacaaggaaactatcctgtggcctgagagcacaatacctgagacaaaggccagcagaaacatttgtctgccctcaccctttctgccccagcttccacctgctccccatctrcc

SEQ ID NO: 11946 - DNA, 478 bp, Homo sapiens
  misc_feature 310: n=a, g, c or t
  misc_feature 311: n=a, g, c or t
  misc_feature 312: n=a, g, c or t
  misc_feature 381: r=a or g
  misc_feature 439: m=a or c
aggcggctctcggtggcagtgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccnnntaccgattcccaccctattctcccccacccccaccccaggcatcaatattatggtttcttgtgcactgrgtgattttttaaattattattatttttttatttttgagacagagtctctctctgtcamccaggctggagtgcagtggtgcgatctcagctcactgca

SEQ ID NO: 11947 - DNA, 442 bp, Homo sapiens
  misc_feature 134: w=a or t
cctggtttttttgttttttgtttggggtatttttggtgtatgtatgtttatgtatgtgtgtgggtatgtgtgtatacagtggagagcaaattggaaaacagttctatttatcctcctccctccccagtagaaawaaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgcttagattaacttacctagtcagacccagaagaacttcttttactagcttgcttcctaaatgcttttttcctc

SEQ ID NO: 11948 - DNA, 468 bp, Homo sapiens
acttttaaattccccacctgtcagagagaagcaggacttcctgtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataatttattgtaagaagaaagtaaaatatta

SEQ ID NO: 11949 - DNA, 523 bp, Homo sapiens
acttttaaattccccacctgtcagagagaagcaggacttcctgtactttttagagcgactgccggaagtgactgcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagcccacccccgccgcaaccgccgcagcagccgccacccctgcttcaaaatgtagcagcttcttagttactttggaacactactcttacatgtataaagtgattgacttgactttctagcttcccttgtccggaggatattaaaatgcttgggtgaggtttagccatcttacttggctttttactattaacatgatgtactaaagt

SEQ ID NO: 11950 - DNA, 343 bp, Homo sapiens
  misc_feature 57: r=a or g
  misc_feature 87: r=a or g
  misc_feature 188: r=a or g
  misc_feature 310: n=a, g, c or t
  misc_feature 327: y=c or t
tcttaaaaacatcagagggattttacattgcccagtttctccaccaacaagccttarggtggacccaaccctttccgcaagtggtargaacgaatgcatcttagcaattacctgatttccaaagtccttttgtagcaaatgtcacctcattcgtggtctttttacctatcctaagcttatgatgatgrgttatgaatgccaaatatttatctgaagagtttctcctcattgtgaatgtgtatgtaaaatatgaagacaagaaagggtgctttcatctgaggaaccaaggggtgggagtatcccaaaggangacaccagcatcatctyttcttcgtactccagg

SEQ ID NO: 11951 - DNA, 431 bp, Homo sapiens
  misc_feature 12: s=g or c
gcgcatgcgcasaccccggcccggaaacagcgcggggtccgctatggcggcggcagcgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagcttatctggatcagatcaatgtcattgaagagcaggtagcagctcttgagcaggcagcttacaagttggatgcatattcaaaa

SEQ ID NO: 11952 - DNA, 455 bp, Homo sapiens
  misc_feature 250: y=c or t
agatggagaatggagccgacttgatggaatgaaggcaagtggagggatgtcggaacaggctgctttggctggattagcaccgggtgtaggcgggacacttagtcattctcccttggcccagacgatgccgccgtggagacagctgaggaagcaaaggagcctgctgaagctgacatcactgagctctgccgggacatgttctccaaaatggccacttacctgactggggaactgacggccaccagtgaaygctataagctcctggaaaatatgaataaactcaccagcttgaagtatcttgaaatgaaagatattgctataaacattagtaggaacttaaaggacttaaaccagaaatatgctggactgcagcttatctggatcagatcaatgtcattgaagagcaggtagcagctcttgagcaggcagcttacaagttggatgcatattcaaaa

SEQ ID NO: 11953 - DNA, 453 bp, Homo sapiens
  misc_feature 248: s=g or c
  misc_feature 383: m=a or c
acacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcagtcagcaagaggtgtggcatgtttgggatgcaaggggacgtgttcgggcttcgagccacattcatggagsaaaatatgcaagtcttgcaaatgcagccaagaggaccactgcctaacatctgaccttgaagacgatcggaaaattggccgcttgctgatggacaccaagtattccaccctcactgctcgggtgaaaggcggggamggcatccggatttacaagaggaccggatgatcatgaccaaccctattgctactgggaaagatcccacttt

SEQ ID NO: 11954 - DNA, 239 bp, Homo sapiens
accgcctgcgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgca

SEQ ID NO: 11955 - DNA, 290 bp, Homo sapiens
  misc_feature 56: s=g or c
aatgtccaatgggaaagcagctcggtgtcacgcacctcctatcccggcgggcaccsctacgccgcggcgagtgaggcgtcgtccgtactggaggctagctcttgtcgcggccgcggcgagttaacatcgtttttccaatctgtccgcggctgccgccacccaagacagagccagaatgttcaggatgctgaacagcagttttgaggatgaccccttcttctcgtgagttacgggagccaggagtccggggtcgcgcgggaattaagacatacaggtggtcttactctgca

SEQ ID NO: 11956 - DNA, 229 bp, Homo sapiens
  misc_feature 22: w=a or t
  misc_feature 23: n=a, g, c or t
  misc_feature 24: r=a or g
atgattttatcagtatacctgwnrgaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgttatgttggaggagggcttactgatgcgtgctaagaccgatttctgattgagggatgaaccct

SEQ ID NO: 11957 - DNA, 200 bp, Homo sapiens
  misc_feature 116: w=a or t
tttcagaattttattatgccatatttcccttcattatagtaaaatatatgctcacgaatcaatgctgatttttaaaatatgtataatctgaagtggaaattgtttgcttagagttwaaacctagtctttgaaagtttgtgctatacttttcccccaaccctccaataaatcttaaatttaaaacctacaatgtagtgtct

SEQ ID NO: 11958 - DNA, 181 bp, Homo sapiens
  misc_feature 48: n=a, g, c or t
  misc_feature 67: r=a or g
  misc_feature 123: s=g or c
gcgctcgttttctgtctagctccgaccggctgaggcggcgcggcagcngagggacggcagtctcgcrcggctactgcagcactggggtgtcagttgttggtccgacccagaacgcttcagttstgctctgcaaggatatataataactgctgctttatttttccacagattggtgtgcccg

SEQ ID NO: 11959 - DNA, 531 bp, Homo sapiens
gcgagactttcaggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaatagga

SEQ ID NO: 11960 - DNA, 206 bp, Homo sapiens
gcgagactttcaggggtcggagcgcgggggccggccgagaggaagctggaggcgcgggtggggaacatgtctgagtcggagctcggcaggaagtgggaccggtgtctggcggatgcggtcgtgaagatagaatcctggtattgatgtccacccgagaaatccctgcagatgttccagcctctgtctagtccagatagccacaggaa

SEQ ID NO: 11961 - DNA, 188 bp, Homo sapiens
ttgtgttctaggatacggatgtcctctacatcgtgtctcagttctttgtagaagagtggcggaaatttgttaggtagaaacaaaatatgttttatttcctttattgttactgatttggttgactctggtattttttaagatatcgtggattctgtttgttgtacccttccttcatggttactttcacc

SEQ ID NO: 11962 - DNA, 203 bp, Homo sapiens
tattcggttccgatttagtttgtatcagatctcctttctgttctctacagaaacaacttgtctctgttagtggttgaacctgtttttgtgatagcgcattacgcataatgtactttttcggtatctcaaaatattaacttagacttatggagcagatattttactaatttttatgaaattttttgcaaactagaaatttacac

SEQ ID NO: 11963 - DNA, 79 bp, Homo sapiens
gctaaaatattacacatttggtaagtaatcagtaaaatgaaaagtaaaattggttggaaatacatcttttttttttttt

SEQ ID NO: 11964 - DNA, 156 bp, Homo sapiens
  misc_feature 7: n=a, g, c or t
aaatagngagccaaagcattgtactgatttatgaggtcataattgtgatctgtagctacattatgaaaatattattttgctaggatagttataaaatctcatacctatggtaatatatttggataatttgttggcatgatacatgaacaatacacc

SEQ ID NO: 11965 - DNA, 325 bp, Homo sapiens
  misc_feature 117: w=a or t
  misc_feature 210: m=a or c
  misc_feature 268: w=a or t
aaaaaatattcaaaatggcggacggaggagcagcgagtcaagatgagagttcagccgcggcggcagcagcagcagactcaagaatgaacaatccgtcagaaaccaggtaaaccatcwatggagagtggagatggcaacacaggtaagagttttctgatctagctttttaattaactctagtagagcacaaagaagaaagtttccatgtamctaggacttggttatttggcaaatacagaccaattttgagtattgagttgtcaaatawgattcagtcctttaggaactgggagggattaatgtttgtttaagattacttaacttt

SEQ ID NO: 11966 - DNA, 324 bp, Homo sapiens
gataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaa

SEQ ID NO: 11967 - DNA, 429 bp, Homo sapiens
  misc_feature 134: s=g or c
  misc_feature 139: n=a, g, c or t
  misc_feature 370: r=a or g
ttcactccaacaatttgatttcttgattttgctcaacattacattgaatgcatgaaattaaaatattccacgcccccaagttctgtatgacaccttgtgtgttttctcagatctatgtcagtcgaaaataaagsccagncaagggggaaaaaaaaggcaaactgaatcaatggaaaactatgtagagcacttttcttttctccaagtcatgctttccttaaaatcagttgaaaaattgaatcaaggatggttcattattctgtacccatcctacgtctaagttggtacatatggcatatgggaaatttcaccatatgtgttcctatctccaatctattctgtcattgacgcctactatgattttgttgtragcacatacctcttaacataagaggacaggatgcagaactcacagcagaataagaggaa

SEQ ID NO: 11968 - DNA, 163 bp, Homo sapiens
  misc_feature 105: y=c or t
cagttttacctcagtgttgaatttaattatataggaacaaaatattcctcagtaaatttgcttgctaaatattctgtcacatttacttcccctttgagaaatggyttaattatagaaatctacctgcatctaggaattttttttcccttttcttttttgaccg

SEQ ID NO: 11969 - DNA, 401 bp, Homo sapiens
  misc_feature 43: s=g or c
atttttctcgccgcgcagggagtactgactaacgtgggcggastctagctcgcgtatcctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaccctttacctttcctgtaaaaggcatctgtgggaaaactagaattgca

SEQ ID NO: 11970 - DNA, 153 bp, Homo sapiens
gcaaggtttctggcactcagaaagtaaatgtttttagaatattgggagagatagatgtaaaataatttgtaaaatcaatttccttggcttgatatttactcagtttattagaataaattaaacattttattgaaaatatttaagaatttggga

SEQ ID NO: 11971 - DNA, 335 bp, Homo sapiens
ttgtattagtccttggtctctgctagacctcatgagtttcatcatttagaaaaggggtagaggatgaactaatgtctccttcagatgtaaacatgaaatacctagagttttacttgcttttcaatacactgaataattttaaatgattctgacactgatgtagaccctttgacttataaattctgaggaaacaactgacagcataaaatatttacattcttataacacagcacagtgactttcttctttcaagattgtagctcagagaaaagatacaggattcaattgggggttcaataggatagaaatggagagattcctttgtgttgtagtag

SEQ ID NO: 11972 - DNA, 335 bp, Homo sapiens
  misc_feature 134: r=a or g
  misc_feature 138: n=a, g, c or t
  misc_feature 140: r=a or g
  misc_feature 141: r=a or g
  misc_feature 149: m=a or c
  misc_feature 249: w=a or t
  misc_feature 250: m=a or c
gcattggggcaaaataatcccttcatttttgtgaaggtaccgtggaaaatatttcatttttcttctcaccggagcaattgtaaatgctatgcggtaagaggagttacctgtggaaaggtggttaaagagattargtanarraaaaggamaggacaccaaaataaagtgctgcggaagaaattttgtccagctgtgagacgacgagtgcgtgaagtgaaggcgattgagaggggctgagggaattgtccwmtgtggaagggactttcttttggccctaggccccttcctgcccctgtcgtcagcagagagatggaaaacttgatgactagctccac

SEQ ID NO: 11973 - DNA, 592 bp, Homo sapiens
  misc_feature 327: w=a or t
tcatgagtgtaagcattaaggacattatgcttcttagattctgaagacaggtccctgcccatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattawctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacat

SEQ ID NO: 11974 - DNA, 258 bp, Homo sapiens
  misc_feature 77: n=a, g, c or t
  misc_feature 174: n=a, g, c or t
cccatggctcatttcagactcactgaactttttttatatgaatgcacagtcgtcatattttgggcagtctgtgagtncttggtaactcatccccttactacaaaagcactaagtgaacaatacaaaagtataaaagcacaaatttgaacttacatagtttagtttaagtatgtntcactagaaaatcaaatatttagatttctcacattgaaaatgcttaggattgaggtttagctgcttcctttaaaaaaaaaaaaa

SEQ ID NO: 11975 - DNA, 378 bp, Homo sapiens
  misc_feature 261: r=a or g
  misc_feature 274: r=a or g
  misc_feature 319: r=a or g
  misc_feature 336: k=g or t
agagttgacttccggcggcttgtgggagtgctggttctgtcctccttgcgggtgcggagatggttgtcttggttacgggtcctaacggtcccctgccttgaaatcccttgttgagggcctgcaaccttgtgcttccgactggagacgcctttggtccctcggtgtctgcactggctgctggtcaaggcttcagtgtggagtaattgacactttcgagaatattaaaatcaaattagagaagaaaactgatccataataatraaaatgtctcgaraaatttcaaaggagtcaaaaaaagtgacatctctagttctctggratctgaagatattagtktagaaacaacagttcctacggatgatatttcctcatcagaag

SEQ ID NO: 11976 - DNA, 328 bp, Homo sapiens
agcagctacagggctgtgggtgaaggagggcctgaggattgtgagctcagtgcttttaggcttgagctgcccttggggatcccccctggaggcagagctggaccttggggagggaccctgtggcggacgtccttctatggccgcttcaggcacttcttggatatcatcgaccctcgcacactctttgtcactgaggctcacagctggaggaaaatttgcctcaggatgaatcacacctttgggtctcatccatacctaatttagaggattctggatgagactctgacttcagacttttgagttgctgctggaatgactgacttttggg

SEQ ID NO: 11977 - DNA, 371 bp, Homo sapiens
ctggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggct

SEQ ID NO: 11978 - DNA, 524 bp, Homo sapiens
  misc_feature 449: n=a, g, c or t
  misc_feature 450: m=a or c
  misc_feature 451: r=a or g
agaggagggggaggaagccggcggccagaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttggtagcctggatggttattgcattgatcttgttcttactgagacctcctaatctaagaggatccagcctacctggaaagccaaccagtcctcatnmrtggacaagatcaccagctcctcctgtggactaactttgtgatatgggaagtgaaaatagttaacaccttgcac

SEQ ID NO: 11979 - DNA, 362 bp, Homo sapiens
  misc_feature 327: r=a or g
aagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatgtaccagcaggaacagtggaggaatgtgtacagaagttcatcgaaattgatcaagcatggaaaattctaggaaatgaagagacaaaaagaragtatgactgcagcggtgtgaagatgatctaagaa

SEQ ID NO: 11980 - DNA, 139 bp, Homo sapiens
tttttcctccagctagaggagctcaactgatctgttttctttcgcccagccaaaatcacagaatgaaggcggtgaagagcgaacgggagcgagggagccggcgaagacaccgggacggggacgtggtgctgccggcggg

SEQ ID NO: 11981 - DNA, 239 bp, Homo sapiens
actcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacgtgagtatcgggtgttctgcggagggtgggagaacttcgggtttgactttcttagcgg

SEQ ID NO: 11982 - DNA, 196 bp, Homo sapiens
  misc_feature 196: n=a, g, c or t
tagataagtgctatggagaaaatcagatccagcacatggttagggagtgctggaggtgatggtgggagggttggtcaggaaggttttacatggtggaagtaaggttttgcatggtggcttgtaagcatagtcgtaaaggaagtgaaagcttgagtcagaggacacccgagggaggagcattccaggtggagggacn

SEQ ID NO: 11983 - DNA, 356 bp, Homo sapiens
  misc_feature 178: r=a or g
  misc_feature 258: s=g or c
agcggcaggcccttcgataaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgrggcagggatctgaccgactcggagcccggctggatgttacaggcgtgcaaaatggaagggtttcccctcgtcccccctcsatcagaagacctggtgccctatgacacggatctataccaacgccaaacgcacgagtattacccctatctcagcagtgatggggagagccatagcgacc

SEQ ID NO: 11984 - DNA, 259 bp, Homo sapiens
  misc_feature 7: n=a, g, c or t
gactagncgggagaccagagatctagcgactgaagcagcatggccaagccgtgtggggtgcgcctgagcggggaagcccgcaaacaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccg

SEQ ID NO: 11985 - DNA, 450 bp, Homo sapiens
  misc_feature 10: y=c or t
  misc_feature 105: s=g or c
  misc_feature 128: k=g or t
  misc_feature 277: y=c or t
actttctttycctctccgttttggtgggctggttgaagatgaaatccactgaggagggaagtccagcaccctgtgtgccagtccagaactggcccatctgtagascccctgaaaatcatatgggcttkgatttggatattctcaacagaaagggttaaaggctgatggtacctaaagcctggtacttgaattttgatcaagataagctgccttaagttctcttcattacacaaatgatcctagataattgatagatcctgtggttcaactggatttytagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctc

SEQ ID NO: 11986 - DNA, 168 bp, Homo sapiens
aaatatggggcccctggcgcttaaagttcagtttgtctctcttgagcttggagaaaatcatccgtagtgcctccccgggggacacgtagaggagagaaaagcgaccaagataaaagtggacagaagaataagcgagactttttatccatgaaacagtctcctgccctc

SEQ ID NO: 11987 - DNA, 238 bp, Homo sapiens
  misc_feature 29: r=a or g
tatatagcaaaaacaataaatagattaaraaagctttgaaaccagcctaaatactcaaagtatttgatggactgactagaatacatatattaagttacaaatatgcacattagataaaatcatggaaacttacttgttaatattaaatttatgcaagacttaatgcaagacttaatgtatgttctacttattgatttgtgaagtttacctatgaagattgtacaattccatagtgaca

SEQ ID NO: 11988 - DNA, 121 bp, Homo sapiens
tatacaaaatcatgtagtaaaattcacagggcttacagataaaatgaagcaaggggtatgcacttgaaaatgtccattgatgataattaactttttgttttgttttgttttgtttttaaga

SEQ ID NO: 11989 - DNA, 378 bp, Homo sapiens
  misc_feature 277: s=g or c
gaaagagccctagagctttgctttttctctcctgcagcacttaaccgaaaccagttttgcaatcaattcctgttcaaaggccaccctactcttcctatccgtctttctccagcccagacactcacagccccctgccagaccaggggacctcggagaggcaaggacagaggttcaggatcttcctctccctcgggacccaaggccacaaaggagagctccgtggagagaagaaaatcatttgactcctggggacacagatttgctgccacagaggctsatggacaaccaggcggagagagaaagtgaggctggtgttggtttgcaaagggatgaggatgacgctcctctgtgtgaagacgtggagctacaagacggaga

SEQ ID NO: 11990 - DNA, 311 bp, Homo sapiens
ctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctg

SEQ ID NO: 11991 - DNA, 414 bp, Homo sapiens
  misc_feature 263: r=a or g
  misc_feature 373: k=g or t
tagtattagtgacatcaggtggatataaaagaaaacccttggaaagagaactgccttagccatgatttcgttagtagacctatttatgattcaattgcaattttcagataggatgtgaacatggaatttcattgaaaatagtttaattttttatataaaaggttttgtatataatgtgtgtcagtgactattttcaaaatcattttcatcaagacaccttttttctaaaataggcattgcatacacatatgcacacgtatgtrcatgtgccacacattttttgtataatgttgggtttgattataaaagtgttgtcaaatgttttatttatctgcatatagcagtggttggcttttttgaattgaaatttttkcgcattgatgcattgaaataaggaaaattatttatctctga

SEQ ID NO: 11992 - DNA, 635 bp, Homo sapiens
  misc_feature 193: n=a, g, c or t
  misc_feature 194: k=g or t
  misc_feature 204: r=a or g
  misc_feature 205: r=a or g
  misc_feature 227: w=a or t
  misc_feature 250: r=a or g
  misc_feature 275: n=a, g, c or t
  misc_feature 276: r=a or g
  misc_feature 402: r=a or g
  misc_feature 403: w=a or t
  misc_feature 405: m=a or c
cttttaaatatacatatccaagctttattagacttactgtatcaaaatcttcaggaataagcctagacttgttgattatttaaaaattttcctcaaggttactgggatgcacaattctagctgaaagctagtacaatagacaattacttcagtctcatttctcaccacccacataaccaattccctttcttanktgaagatttrrccaaaaagagtaaagagtaggwgagagacccatttgctgaaaacrccacataatttttcccggtaacacnrcaggatctagtcaactcaaaatccaacttgatcttgttactcatttatcttccaccttcccatccagacactctagatttgaaagcagagctgaggctctaattggccacttctaccagaagaagrwtmctaagtcagttaattacttgatattccccctgctcaagggtttccccttacattacccacctattcactgccaatctggttcctcagaggcctcctaaaattcatctctaggcagtttacaacccactaactccctctcccaaactgaaaactgtcattctctaaaatcaaagagaactttgtctcaccatacaaaggaaataaataaatgaacaacaacaacaacacca

SEQ ID NO: 11993 - DNA, 174 bp, Homo sapiens
cctttctttattatacaaataggcagtatacacagtgagcgcccactaagcgctgggctgggggcctccaacccggaacagaagccggccacaaccctcgctccctgtcgtcgcggccgttataggccgaaagcaaaatccaatcccgggccattgtgggcggattgccaggac

SEQ ID NO: 11994 - DNA, 253 bp, Homo sapiens
  misc_feature 1: r=a or g
raacattgatgaattgttggagttagagagtgaagaggagagaagccggaaaatccagggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccg

SEQ ID NO: 11995 - DNA, 460 bp, Homo sapiens
  misc_feature 266: r=a or g
  misc_feature 267: r=a or g
  misc_feature 269: r=a or g
attttctaaaagacatagtatttagtttataattaaatgcattcttgaagtccagtgtgaattttattaatgctatcatctcgaccaagctcaaagcctacttattagaaacaatgaagttcacaataggtcataaaggtctcttccttttctaaaattgaaagacaagaaatttagtgccaatattgtacagacagaaattccatgtatgagtctcaacaaagactacctttggctaaatgtctagaagcagagaagtaaagtgrrcraaaatccagtgttgaggagtcatgacagtactttgatctttatatactctgaagcatttcttcaaacttttctacttttgtcattaatacctgtagtaagttgacaatgtggtgaaatttcaaaattatatgtaacttctactagttttactttctcccccaagtcttttttaactcatgatttttacaca

SEQ ID NO: 11996 - DNA, 188 bp, Homo sapiens
attaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacc

SEQ ID NO: 11997 - DNA, 344 bp, Homo sapiens
  misc_feature 288: k=g or t
tcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtktttcttacctgaaacgagaaaatccattacatatcgtataccgcttcatgaaccca

SEQ ID NO: 11998 - DNA, 464 bp, Homo sapiens
tcgccgagagacttcctcttcgttaagtcggccttcccaacatggcgcagtctattaacatcacggcagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgc

SEQ ID NO: 11999 - DNA, 324 bp, Homo sapiens
  misc_feature 275: n=a, g, c or t
  misc_feature 287: n=a, g, c or t
cattacatgtgggcaattgcaaaatgataaggaaaatcccaaaatgccacctagtgacaactgctgttatttatatttcttctccctccctttctcctgcccgccactacgcctggctaatttttttgtatttttggtggagacggggtttcaccatgttggccaggatggtcttgatctcctgacctcggcctcccaaagtgctgggattgcaggcatgagccaccgtgcccggcctcccatcctgacttctaacatcctattttagttctgtntgtttctgagtntgatgtagaaggaaacacacagcacattctttctggg

SEQ ID NO: 12000 - DNA, 481 bp, Homo sapiens
  misc_feature 122: s=g or c
  misc_feature 128: s=g or c
  misc_feature 462: n=a, g, c or t
  misc_feature 463: s=g or c
gtcggtctcgcacgtctctcctgagaactaccgagtaggtcgggcctgcctgtgagcaaacgaggcccctgagagctccacctagttcacaataaaatcccacagcagaactcggagtcagsaatggstaagccccaggtggttgtagctcctgtattaatgtctaagctgtctgtgaatgcccctgaattttacccttcaggttattcttccagttacacagaatcctatgaggatggttgtgaggatatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgnsccatcatctgacaattag

SEQ ID NO: 12001 - DNA, 342 bp, Homo sapiens
  misc_feature 253: s=g or c
atagtaagaggtcaatatgttttcacacttgggaaatctcattcaagaatttttgtcaatggacaagtcataagaagcccttccattttagggctcgttgacgtcaccaagaggcgataaatatctgttgatataattggatgtgagattcagtgttgagatagcaaaattctgcccctcgttccttggcagggccctatgatttatgcaggagcagaggcagcacgcaatcgagctgtcaagagagcgtcasttattaggcaaatgctgcgtggtttttgaagagggtcgacactataaaatcccactccaggctctggagtggagaaactcagagaccaa

SEQ ID NO: 12002 - DNA, 144 bp, Homo sapiens
catgcaggcttcttgcccagctgaccactggccccggggtgcctgcctggctggtcttcatcacctgaggccaccaggctcaagccactgctgttgcattacacccatccctttgcaaaatccctatggagcctgtcaccaccc

SEQ ID NO: 12003 - DNA, 492 bp, Homo sapiens
  misc_feature 218: k=g or t
  misc_feature 270: k=g or t
  misc_feature 390: k=g or t
  misc_feature 422: w=a or t
  misc_feature 450: y=c or t
gcagtccgcgcgggttctcgcacgcagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatttggggacaagccgagtgaggggcgkccgcggcgcacggacctcaccgtgctggtggcccacaacgatgaccccacckaccagatgtttgtgttctttccagagacgggatttcgccttgttggccaggatggtctcgatctcctgacatcgtgatctgcccaccttgacctcccaaagtgctgggattacagaggakcccaaggtgggcatcaagaccatcaaggtgtwctgccagcgcatgcaggaggagaacatyacacgggctctcatcgtggtgcagcagggcatgacacccccc

SEQ ID NO: 12004 - DNA, 442 bp, Homo sapiens
  misc_feature 157: n=a, g, c or t
  misc_feature 246: w=a or t
cctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtntgttgacatgacaaattaacattcttaatagttacatctggaaatgagcatttgaaatagataatccataagccttgtggcaaaatttwtgtggcttttgtttaactttgaaaggttattatgcactaaccttttttggtggctaattagggtttaaatacagaaacaagatttcaaataaaactgtctttggcagtgagtaaatagcatattttgaaagtagagttgtaatactttttcataagatgtttgggaatttttttcctgaagtaataatttattcca

SEQ ID NO: 12005 - DNA, 353 bp, Homo sapiens
  misc_feature 67: s=g or c
atttggagcctgcgcagtcagatccgaggacatgttgacgtcgtccgagagtcttaaaatcctgctstggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggaggcagaagaggagaaccaaataaatgag

SEQ ID NO: 12006 - DNA, 249 bp, Homo sapiens
acacggactacatttctatacctcgtcaacttcaacaagaatgactggattcgagttggcctttgctatccatcaaacacaagttttcaagttacctttggctatttgcagcggcagaatggctcattatccaaaatcgaagaatatgagcctgtgcattcactggaagaactgcaaagaaagcaatccgagaggaaattctattttgactccagcacggggttactgtttttgtatctcaaagccaaa

SEQ ID NO: 12007 - DNA, 215 bp, Homo sapiens
  misc_feature 89: s=g or c
  misc_feature 90: m=a or c
  misc_feature 99: s=g or c
  misc_feature 100: m=a or c
tggaatataaaaataagcattggttgttcttaccagccacaaagtaaacttcattttcaggcagtgtttctgggggaggttatggaggsmagaaaaaasmaaaatcgatagtgagtgactgattgcttcattttatcaggcgggcccattgtgaaagagctcaggggaaatgtggaggttaaatatatttccagagttgtccagcagaaagaaag

SEQ ID NO: 12008 - DNA, 368 bp, Homo sapiens
  misc_feature 130: k=g or t
tgaaaatcgagagtctgaaaagaaaggacagagaacaagtacatttcaaataaatggaaaagataataaacccaaaatatatttgaaaggtgaatgcttgaaagaaatttctgagagtagagtagtaagkggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccaatcaaccaaagagtctgacagt

SEQ ID NO: 12009 - DNA, 174 bp, Homo sapiens
  misc_feature 12: s=g or c
acgacgcgccgsaaagcaacggcaagggccgcagccagcaccgggcggagagggctaccatggggaaaatcgcgctgcaactcaaagccacgctggagaacatcaccaacctccggcccgtgggcgaggacttccggtggtacctgaaggacagtgtgggcacttgaaggaggg

SEQ ID NO: 12010 - DNA, 271 bp, Homo sapiens
  misc_feature 83: k=g or t
gcagtaccctcaggaaggtagcgtcttgatctgcgtggcgtggttctgtgccttgggaagagatgaatgggaagcggccagckgagcccggcccagcccgggtgggaaaaaagggaaagaaggaggtgatggcggagttttcggacgctgttacggaagaaaccttgaaaaagcagaagtcattgtcatggacatggacccttttcttcactgtgtgatcccaaacttcatccaaagccaagacttcttagaagggcttcagaaggaactg

SEQ ID NO: 12011 - DNA, 217 bp, Homo sapiens
  misc_feature 108: r=a or g
  misc_feature 134: y=c or t
  misc_feature 150: r=a or g
gcggagaggcgcacagcgcggcacagcgaggcgccggcccagactccactccccagctgtgaaaggaggagctctacggtgactttgaagacttggaaacaggggacrtgcacaagggaaaatcgggccccgayactcagaatgaagatrtagagaaacaaggaagaaattgaccctgacgaagaagaaagtgccaagaaaaagcatttggataaga

SEQ ID NO: 12012 - DNA, 439 bp, Homo sapiens
  misc_feature 10: m=a or c
  misc_feature 41: m=a or c
  misc_feature 42: y=c or t
taaaggcacmgcgggcgcaggcgcccagaggccacaggagmyctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaagactctttggcagtgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccagtggaggaaactccattgacatgcatcacactccacata

SEQ ID NO: 12013 - DNA, 350 bp, Homo sapiens
ttaaaatctattttcaccatttgtccttttgaaactcaaattattccaatatggccagtgagagcccttcaagcaatattctgtttgggacagcaaaatcgtaagagaccatattgtataatcttcagcaattaaatctgaacacctagatgaaatgaactatacctggaaaacccaaaagagtcaatgttaaaacacagacagtgaaattcagtaaaggaactggataaaaaattgatacattaagtcagtagccagctgggttgtggtggttcgcgcctgtggtcccagtactttgggaggctgaggtgggaggactgcttgggcccagaagtttcagaccagcctgg

SEQ ID NO: 12014 - DNA, 210 bp, Homo sapiens
ttcagttctgcttgctgtccgcaccgctgcgttacccggaaccgccgggccgaacagcatgacgtccgctttggagaactacatcaaccgtatcctcaagctggccgcctgggcaagcctgtcctggaagacagttttttaacatgctggaaaatcgtccaacatcgattaatttagtactcatccacttttcattttagaaataaacag

SEQ ID NO: 12015 - DNA, 166 bp, Homo sapiens
  misc_feature 46: k=g or t
  misc_feature 153: s=g or c
atgttgtgggaggtccctgaggccgctgaggtcgttcgtgtctgtkgaacggctgtgggcgtcttgctgccttgggtagggggttaaaatcgttcttgagaggaacgtctctgtgcgaagagataatgagtttagctctgagaagtgagcttstagtggacaaaac

SEQ ID NO: 12016 - DNA, 515 bp, Homo sapiens
attcatttgtgcttgcgggctcagaagcgtcgcactgctttgttttgtactctaccgtgtcctgttgaaaggggtcaacaagtgccggggagggtgcagaggctgaggctggcgtcaccttccgttgctaaggtaacgtgctctggccattttatctgataaaggaagtccagtggactgtatgcattattcatcactgttctaatcaaacaatcaaaatcgtttactttcaccgggaatatttagcaagatcaaagacactctggctggaacggctcttgttttaccgctgacagatagcctttgatttttattttttgcagtgttccagtgttttctctcaaaactctgtgtttggaacatcaaggatggattatcccaaaatggattattttctggatgtagagtctgctcacagactcttggatgttgagtcagctcaaagattcttctacagtcaaggagctcaagctcgccgggcgaccctgctcctgcctcccacattaatggcggca

SEQ ID NO: 12017 - DNA, 228 bp, Homo sapiens
aaaaaaagggcttctgtcgtgagtggcacacgtagggcaactcgattgctctgcgtgcggaatcgacatcaagagatttcggaagcataattttttggtatttgggcagctggtgatcgttggtcccggcgccctttctttactgttatatgttaggcgaaatattacgcgtttggagtaagtggtgctttttgtaactgaaaagagattctgtgtgtgttttttttt

SEQ ID NO: 12018 - DNA, 394 bp, Homo sapiens
  misc_feature 76: s=g or c
  misc_feature 264: n=a, g, c or t
  misc_feature 265: k=g or t
  misc_feature 309: s=g or c
  misc_feature 310: n=a, g, c or t
  misc_feature 326: n=a, g, c or t
  misc_feature 327: m=a or c
agaggcagggagggcggggccggcagggggacctgctgctggaagagcagcggcccgagccggggccatggcgaastgctgagctgcgtcctaggcccccggctctacaaaatctaccgggagagggactctgaaagggccccggccagcgtccctgagacgccaacggcagtcactgccccccattccagctcctgggatacgtactatcagccccgtgccctggagaaacatgctgacagcatcctggcactggcttcagtnktctggtccatctcttattactcctctcccttcgccttcttctasntggtacaggaaaggtnmcttgagtttgtccaaagtggtgccgttttctcactatgctgggacattgctgctacttctggcaggt

SEQ ID NO: 12019 - DNA, 207 bp, Homo sapiens
  misc_feature 7: n=a, g, c or t
gaatcangaaacggcagagagactgagggttgcagacacatatatttttgaggctgggtgacgagaaaatctagagacatgagggacataaatgggcctggcagcctcggctctttgcggctgctggcaggactgagctgtccgggttctccccacacttccagcacagctgtgctctgtgtcctgcctcggcgctctcgcaaatga

SEQ ID NO: 12020 - DNA, 173 bp, Homo sapiens
  misc_feature 147: n=a, g, c or t
agaaacagccagaacccatctacagcaagaagacggaaatccaaaggcagacagtacgggctcccttcgccaaactcttcattttctctgcacttcaggtggcaagacagctccttcttcagcagcaacagcagcagcaagttagtnggattaaaatctcccaagaggaatga

SEQ ID NO: 12021 - DNA, 201 bp, Homo sapiens
tatatttctgtaacattagctatctcagggagggtaagagaatattataagcttttactttatatgtatttgtattgttttagttatttaaaaatttttgaataaagtagaaacaatagttcagaagtcagtccatgtctttctctaactcattcaagatagatgaattattagcttgtacctcaaaatctcccagcatgg

SEQ ID NO: 12022 - DNA, 152 bp, Homo sapiens
aggttctaaagtcccacgcaccccgcgggactcatatttttcccagacgcggaggttggggtcatggcgccccgaagcctcctcctgctgctctcaggggccctggccctgaccgatacttgggcgggtgagtgcggggtccagagagaaac

SEQ ID NO: 12023 - DNA, 477 bp, Homo sapiens
  misc_feature 437: n=a, g, c or t
  misc_feature 438: n=a, g, c or t
  misc_feature 439: n=a, g, c or t
caacttctagaatccatcgatgtggaacacttcagtttgtttaacgtaggagactccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctnnngattatcatgttaaaaatgagggcagaggctgtggctg

SEQ ID NO: 12024 - DNA, 223 bp, Homo sapiens
  misc_feature 8: m=a or c
tttgagamctaaacaaacagcttattctagcaaaatctgaactatgtaagtccctccaaaaggagtgtttggagactgataggaagacttaggaaggataggagatttaacccagcttttaatccaaaggaagaaatctctgcaaagaaggcagccattggttttggtttgcttaaggacaaggcaaatatctgaggtccatgtgagaagaaacgtcaggccc

SEQ ID NO: 12025 - DNA, 328 bp, Homo sapiens
  misc_feature 160: m=a or c
ccttccccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccmagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcg

SEQ ID NO: 12026 - DNA, 476 bp, Homo sapiens
  misc_feature 431: n=a, g, c or t
  misc_feature 449: s=g or c
  misc_feature 453: n=a, g, c or t
  misc_feature 454: s=g or c
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagggtcagcctgcttttgttatcaagccttcccagcggaacctaggggngagagacacagccaggascaansccaggttccagtaggaaggcca

SEQ ID NO: 12027 - DNA, 566 bp, Homo sapiens
  misc_feature 521: n=a, g, c or t
  misc_feature 539: s=g or c
  misc_feature 543: n=a, g, c or t
  misc_feature 544: s=g or c
ataaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagggtcagcctgcttttgttatcaagccttcccagcggaacctaggggngagagacacagccaggascaansccaggttccagtaggaaggcca

SEQ ID NO: 12028 - DNA, 239 bp, Homo sapiens
tgataaaatctgggacaatgtttttcttacccaccagtggccaatggacagtggaaattgaataaacatttaataaatgagtgtttcgatcataagaaatagggcatgtctgcctctcccttgttggctgtttgcacacttgggatttgcagtcttcaatgaatatgaaaagagttggccgtagtgtttggagggagaagagaaagatttgacaatggtactggcctggcatggtggct

SEQ ID NO: 12029 - DNA, 205 bp, Homo sapiens
  misc_feature 109: n=a, g, c or t
ttaaatgaatatgttacgttcttttgtgctgtcttcaaaatctgttatatattttacacttacaccaaatctcaattaccatggtacatttttatctgaaatgcttganctttattttgatttcataaaattcatagttggagaagtagattcacatatccaagttgttccaattatataatagttttccaaaaactgagatggg

SEQ ID NO: 12030 - DNA, 215 bp, Homo sapiens
atttaagtccagagagcaaggtgattgcagtttctttgttcggtttgcttattttttactgcttatttctgtgtgcataaattcagcgacatgctaatagacatatggtcaatggtgcttagagaaaatctgtttgtaaacctgaatctctgttttgcctacacatttgcattgtattcctgccctgctccaactcgttgtcctagaccatccag

SEQ ID NO: 12031 - DNA, 372 bp, Homo sapiens
cagaaggctgttactccacagtcactacggttgtgaagcggaaccagacaacttcccattttcgaggttctacaattggcaatatgggaaaatcttaccccattaccacccaactcgattctttcaatgcaagcttgtctaacccatagcctgcaggccacatgtgacccaggatgactttggatgtggcccagtgcaaattcgtaaactttcttaaaatattataagattgttttgcaatacatcagtatcgttagcgttagtgtattttatatgtggcccaagacaattcttcttctgatgtggccgagggaagccaaaagattggatactcctgcgtaagggggaaatgcatgtttatagtcatatata

SEQ ID NO: 12032 - DNA, 495 bp, Homo sapiens
  misc_feature 455: n=a, g, c or t
tatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagtttaggggaaagaaaagatcattgaaagtcatgataatttctgtcccactgtgtctcattatagagttctcagccattggacctcttctaaaggatggtataaaatgactctcaaccactttgtgaatacatgtgtatataagaggttattgataaacttctgaggcagacatttgtctcgctttttttcatttttgttgtgtcttataaactgactgtttttctttgcttgnatactgtgatttccaaaataaatctcatccaagcaagtta

SEQ ID NO: 12033 - DNA, 303 bp, Homo sapiens
taggaaaaaagggtatcatgatgaaattcaaaatcttattttctaaggtcagtgtgcatttgtttagttttgatgcttttcaaattacattattttcctcccctatgaacattgtggggagggactctaaataaaccagtttaggcatttgctagctttaggtgcttttattggtgcctgcccttttccttgttcattttaatttctgcaataatcctggactttcctaaactatgtaatgtatacttgtcctttttctctgcctcccccaaccccctgttgtttttatggtcagctttgcct

SEQ ID NO: 12034 - DNA, 152 bp, Homo sapiens
agagattggtgcagccccggaggaagaaaaaagggtctaccccgagccccggagcgagagcgaagtgccttaagcaacatccgcgagttcctgcgcggctgcggggcttccctgcggctggagacgtttgatgcaaatgatttgtatcaggg

SEQ ID NO: 12035 - DNA, 204 bp, Homo sapiens
gttttcgggattcgcgggaagaaggcgcactcccaggcccaactctctccccagcactttcgcgtggaaaatcttcaggaaaatgaaatgtagctccccgtatgccctctccccaaagatgtaaaggactctggagcgggcgcgaggagcagttcctgtttcattacgagcgccccctctccagcccggtcattgtagtgcgaa

SEQ ID NO: 12036 - DNA, 284 bp, Homo sapiens
  misc_feature 67: s=g or c
  misc_feature 69: r=a or g
  misc_feature 140: m=a or c
  misc_feature 159: r=a or g
  misc_feature 233: s=g or c
  misc_feature 234: n=a, g, c or t
agaggcgcagagcggagaggcctgcggcgaggatggagggcctggcagtgcggttgctgcgcggcasargctgctaagaagaaatttcctgacttgtttgtcttcttggaagattcctcctcatgtctcaaaatcttccmagtcagaagctctactcartataacaaataatggaatacactttgctcccctgcaaacatttacagatgaggaaatgatgataaagagttcasntaaaaaatttgctcaggaacaaattgcacctttggtttcaaccatggatg

SEQ ID NO: 12037 - DNA, 275 bp, Homo sapiens
ttgttttttagaaaaatgaataatttctttttatattattctgttacattttttccccacttaatagaacgtccagaaaatctttgcatctcagaatgcctgaagctgccttgttcttgttttttttattcatttttttattatactttaagttctggggtacatgtgcagaacgtgcaggtttgttacataggtatactcgtgccatggaggtttgctgcacccatcaaccatcatctacattaggtatttctcctaatgctctccttccccta

SEQ ID NO: 12038 - DNA, 318 bp, Homo sapiens
  misc_feature 83: n=a, g, c or t
  misc_feature 84: r=a or g
aagtcccagcagtctggtgttcagtgtggacgttggcctgttggctcacacaggcagagggggttaaaagatcaagtggcatnrgcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacg

SEQ ID NO: 12039 - DNA, 359 bp, Homo sapiens
  misc_feature 16: n=a, g, c or t
  misc_feature 154: y=c or t
  misc_feature 155: n=a, g, c or t
  misc_feature 212: n=a, g, c or t
  misc_feature 213: m=a or c
  misc_feature 302: s=g or c
  misc_feature 308: m=a or c
  misc_feature 309: r=a or g
  misc_feature 320: m=a or c
atgccccgccccctcnccagccccagacacggaccccgcaggagatgggtgcccccatccgcacactgtcctttggccaccggacatcatgcctcccaagaaggatgttcccgtgaagaaaccagcagggccctccatctccaaacctgctgcynaagccagcagcagcaggggctcctccagccaagaccaaagctgagccagctgtcccnmaggcccctcagaaaacccaggagcctccagtcgatctctccaaagtggtgatcgagtttaacaaggaccagctggaggagttcaaggasgccttmragctgtttgamcgagtgggggatggcaagatcctgtacagccagtgtggg

SEQ ID NO: 12040 - DNA, 207 bp, Homo sapiens
gcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccc

SEQ ID NO: 12041 - DNA, 431 bp, Homo sapiens
  misc_feature 396: k=g or t
  misc_feature 397: s=g or c
gaggcgacgggagccgagctctctaggacccgaggaggaagagctgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggagcgcacccggcggagagactgatggagaggcagaaacggaaggcggacatcgagaaagggctgcagttcattcagtcgacactacccctaaagcaagaagaatatgaggccttkstgctcaagctggtgcagaatctgtttgctgaggg

SEQ ID NO: 12042 - DNA, 423 bp, Homo sapiens
  misc_feature 276: y=c or t
  misc_feature 279: y=c or t
  misc_feature 285: y=c or t
  misc_feature 389: r=a or g
cagaaaatgaacttcttaacatctacactagcggcagcttcctagaaatcactgcactacccgctagtaacggagtcattgccattcagagtgtgcatttttttttctctttccagttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggygayttcagyaagctacagcaaagcccattggccagaaaggaaagacaataattttgttttttcattttgaaaaaattaaatgctctctcctaaagattcttcacctactttgrtctccataacttctatgttttctttccttctgac

SEQ ID NO: 12043 - DNA, 146 bp, Homo sapiens
ggacgacaaagatggcggcagggaccagcagttactgggaagatctcaggaaacaggctcgacagctggaaaatgaacttgacctgaaactagtttccttcagcaaactatgtacaagttacagtcatagcagtacccgagatgga

SEQ ID NO: 12044 - DNA, 303 bp, Homo sapiens
ttactgcttagttgcctgcaaaccacctgtatgagaataacctagaatttaaaaaataaaataaaaacatttttccagacctggaatttgcatttttttacaagctttaagagatttttcttaggagcaccacatttgtgagaagcactgcccaaaatgaacttggaggagggattgttcatacccacaaactatctacttttcctgcatctttttttcccctctttggtcatcttggatctaagcttaatatttaattaggaatcttatcatttctagattaagttcttgaatcttaaattc

SEQ ID NO: 12045 - DNA, 383 bp, Homo sapiens
  misc_feature 32: n=a, g, c or t
  misc_feature 33: n=a, g, c or t
  misc_feature 54: m=a or c
  misc_feature 56: m=a or c
  misc_feature 217: n=a, g, c or t
  misc_feature 373: n=a, g, c or t
gtactaagactagggttgggccgagagtcggnnccattactgcaggaaaaggtmcmggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccagtngccgggtgtggtggtgcatgcctgtagtcccagctgtttgggaggccaaggtgggcggatcacgaggtcaggagatcgagaccatcctgtttagcgcggtgaggccccgtttctgctaaaaatacaaaaaattggccgggtgtggtggcaggcgtngtggcgggtg

SEQ ID NO: 12046 - DNA, 409 bp, Homo sapiens
  misc_feature 32: n=a, g, c or t
  misc_feature 33: n=a, g, c or t
gtactaagactagggttgggccgagagtcggnnccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgggtctccctctccctctctttccacggtctccctctgatgccaagccgaagctggactgtactgctgccatctcggctcaatgcaacctccctgcctgattctcctgcctcagcctgccgagtgcctgcgatcgcagggcgcgccgccacgcctgactggttttcatatttttttagtggagatggggttttgcc

SEQ ID NO: 12047 - DNA, 125 bp, Homo sapiens
  misc_feature 32: n=a, g, c or t
  misc_feature 33: n=a, g, c or t
gtactaagactagggttgggccgagagtcggnnccattactgcaggaaaaggtcccggagagctgagcagtcaagatgtgtgacttcaccgaagaccagaccgcagcacccccatgagattaccc

SEQ ID NO: 12048 - DNA, 235 bp, Homo sapiens
catagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgc

SEQ ID NO: 12049 - DNA, 415 bp, Homo sapiens
  misc_feature 311: n=a, g, c or t
  misc_feature 312: n=a, g, c or t
tgcagaaacgttagagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactgacttgctcagcgtcccatggcctagccgcccgtgactctcacactgtctcctgcatgacgggtggcgcctcccgnngcttcccttctctctccagtgctgccgctgtgtctagcagcctctaggatcttgtcagagctgcactctctgtgaactggcattcctttcggtgctgctgtcc

SEQ ID NO: 12050 - DNA, 290 bp, Homo sapiens
aaatagtttaaaatgaaggaaagagaggtgcctcctacaataacagagatgggctgcaaacattggatgacctgtggcagagcacggaaagaaggcaaggatgacagctacatgcagacaaggtctccagatttgccacccatgctgagtgccgtggtgtgatcatggcttatttcaacctcaacctcccccactcaagcgatcctcctgcctcagcctctggagtagctgggactacaggcacgcaccaccacacccagccataatttgcctcttgctgtaactaaaag

SEQ ID NO: 12051 - DNA, 302 bp, Homo sapiens
  misc_feature 66: m=a or c
  misc_feature 181: w=a or t
tcttccagcctgcgcggaacgtcgttctcccggtagtactccatcgcctgctgcttcagcttctgmagctccctagtggtcccacagctgcggccgccgccttcttcctccatgatgaaaacatctgagactcagggctaagcaccttgcccaaggccacacaacaagtaggtgatggagwgtgttggcgtgtacggattctgtgggtgtaaagcaaagaacaaaatgaagtgtgattcaaggtgggaaatagccgcttcaggaccagcttggacttgtgacctgtgcagtcacacaaggcc

SEQ ID NO: 12052 - DNA, 330 bp, Homo sapiens
aaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcttgtttttaaggagattgagaagaaacttgaagagataagaaggctgactgcacaatcacaatggctgactcagacttcctggctttaatgactggtaaaatgaatcctcagtcggccttctttcaaggcaaattgaaaatcactggcaacatgggt

SEQ ID NO: 12053 - DNA, 199 bp, Homo sapiens
aaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaagtgatggatttaaggcaaatcatatagtaaactccagcaccaccgac

SEQ ID NO: 12054 - DNA, 256 bp, Homo sapiens
  misc_feature 24: s=g or c
  misc_feature 31: n=a, g, c or t
agtgagtgtggaggcgcggacgcsggcgganctggaactgctgcagctgctgccgccgccggaggaaccttgatccccgtgctccggacaccccgggcctcgccatggcagaccagctcgtctctactaaaaatacaaaacttagctgggcatggtggcatgcgcctgtagtcccagctacttgggaagctgaggcaggagaatcgcttgaacccaggagttgaggctgcagtgagtagttgtgattaaaaaaaaa

SEQ ID NO: 12055 - DNA, 419 bp, Homo sapiens
  misc_feature 373: w=a or t
  misc_feature 374: n=a, g, c or t
  misc_feature 375: n=a, g, c or t
gccggaaatgacgaacgagtcaaccggatcggtgactgtggagggcgagctgagccctggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcgggagtctttctttcgcgtggtgccgcagtttgtagtgttttatcttatctacacatgggggactgaagagttcgagagatccaagaggaagaatccagctgcctatgaaaatgacaaatgagcaacgcatccggatgacggttccctgtctctgaaagacctttctctggaagwnnagtctgcattgtagtgtctgaaagacacaataaacttcctatgg

SEQ ID NO: 12056 - DNA, 445 bp, Homo sapiens
  misc_feature 43: y=c or t
  misc_feature 55: s=g or c
  misc_feature 135: r=a or g
  misc_feature 137: k=g or t
  misc_feature 140: m=a or c
  misc_feature 153: y=c or t
  misc_feature 347: n=a, g, c or t
  misc_feature 349: n=a, g, c or t
  misc_feature 350: n=a, g, c or t
  misc_feature 435: r=a or g
  misc_feature 437: r=a or g
  misc_feature 444: n=a, g, c or t
ctgtggagggcgagctgagccctgtgcgtgagtggggtctggytgtgcagtgttsgtggaccctgggaggctaggggcgccccgctgggctgggaaaggataaggagtgcaggggcaggagtctggggttggggrtkgamcccccgcgggaaytgcgggcgcttcgcgaaagcgagccaagcgcctgtccaccctcggtcctgcagggccgccgccacaatgggccgcgagtttgggaatctgacgcggatgcggcatgtgatcagctacagcttgtcaccgttcgagcagcgcgcctatccgcacgtcttcactaaaggaatccccaatgttctgcgccgcattcnannggtctttctttcgcgtggtgccgcagtttgtagtgttttatcttatctacacatgggggactgaagagttcgagagatccaagargragaatcna

SEQ ID NO: 12057 - DNA, 99 bp, Homo sapiens
acaaaatgacacctttcacacactctgactttccacatgttcagggtcagtttctggacttcctaatcctgccctgatctccattctatttctgcatcc

SEQ ID NO: 12058 - DNA, 173 bp, Homo sapiens
taaaatgacagggtagcataatgaacctaaatgttcccacccagcttcagcagtcatcatctcatggccaatcttatttcatctatacatctactcatttctactaaattatttttgatgcaaatttcaagcatcatataattttatctataaatatttcagtatgtacatgc

SEQ ID NO: 12059 - DNA, 339 bp, Homo sapiens
  misc_feature 276: y=c or t
agactgtgcggtcacttccggcccgggagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacaccgggttgtagttttgtttcgttttgtttttaagagatgagtcttgaaggcagagtttagtaattaagttagaattaagagttttgcgaggttaaaaaaatgtgcytcgtggatctccctgttttagtaacatggagagaaaaagtctacacgaaaaagtgaacaattt

SEQ ID NO: 12060 - DNA, 664 bp, Homo sapiens
  misc_feature 11: r=a or g
  misc_feature 12: r=a or g
  misc_feature 121: r=a or g
  misc_feature 122: k=g or t
tagagacccarrtatctttcacagaattttgttccataaatgtttttcttaattattaagaagtgttaccttattaaaatgaccaccattctaaaccatttttcagtggtctggatacgarkttacagtttcataccaactatctaaaacctaattgcaaattgaccacagacctctaacctcctacttttatagacttgaatacttaagtaatttaaattagggttggtatttcatttttttcttatctaaatcttagtttcctggaataataaagtttgatgttcagcaagagaactgcttgagtttaagccattttcaaaagaaacttgccttttacattattgtgttccagaacattaagtgactgtaggtactgggtattagtgatggtaaactttgtgttgctctttatgaaatgatccatataactgttgggtgcatcagtgcttttcaaaggggctgcttactatagggttaactatgtatattcattgttaagagttaacttgtggtttggctgtttcctggattttataacatacatgtgcagaaatgtattcaaatgaaaggaagcatacctttatcaagatgctattaaaattgaacatcaagtataatatttcatttggattctcttttttggttaatgcctaaaaatgcc

SEQ ID NO: 12061 - DNA, 81 bp, Homo sapiens
catgtgagggggcagcaggacacccagggatctagcgtgggggaggagaggagcctaatgagaaaatgaccatccaaagcc

SEQ ID NO: 12062 - DNA, 393 bp, Homo sapiens
  misc_feature 100: s=g or c
  misc_feature 324: n=a, g, c or t
  misc_feature 325: n=a, g, c or t
  misc_feature 351: w=a or t
  misc_feature 389: n=a, g, c or t
  misc_feature 390: n=a, g, c or t
  misc_feature 391: n=a, g, c or t
agagggaaagcgagagggagacggacgttgagagaacgaggaggaaggagagaaaatggcgtccacggattacagtacctatagccaagctgcagcgcasagggctacagtgcttacaccgcccagcccactcaaggatatgcacagaccacccaggcatatgggcaacaaagctatggaacctatggacagcccactgatgtcagctatacccaggctcagaccactgcaacctatgggcagaccgcctatgcaacttcttatggacagcctcccactgtagaagggaccagtacaggttatactactccaactgccccccanncatacagccagcctgtccaggggtawggcactggtgcttaatgataccaccactgctacagtcnnnac

SEQ ID NO: 12063 - DNA, 356 bp, Homo sapiens
  misc_feature 103: s=g or c
aaaagagttggcagatcacggatggagggcagcatctcccaacagcctgggcggccgctgagacccagagaacccaaggactcccctgggctcatccagcagsctctgcttcccaggagagaggtgctgaagtccacgaagagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtc

SEQ ID NO: 12064 - DNA, 170 bp, Homo sapiens
tgttaaaacaatggttttgtgaccttaaagtctgtgttagtcccttagcaccaccgctgagattttgctgaaagggacgttttgtgtgttgggcttcactgaaggaagcccctgaaagtgttcagaaatagggaaaatgagaaactgttccagctgaaaatacgggcaag

SEQ ID NO: 12065 - DNA, 412 bp, Homo sapiens
  misc_feature 14: s=g or c
  misc_feature 15: k=g or t
  misc_feature 297: n=a, g, c or t
  misc_feature 298: k=g or t
  misc_feature 360: n=a, g, c or t
atgaacaacgtcaskagttttctcctaaatcttatgagccccgcctcccacagtagtttcacttctcagtttaatccggtctgagttaacttcctgacccaggaagtggcagcaacagaagggggactagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccankgaatacacgtcttcagaagaaattctgtgtggcttcaagagactgatcaaattgtgagaggnaaacagcctacccggtcctcttttcttcaatacaaaatgagataataggggt

SEQ ID NO: 12066 - DNA, 364 bp, Homo sapiens
  misc_feature 96: w=a or t
  misc_feature 275: m=a or c
  misc_feature 306: n=a, g, c or t
  misc_feature 307: y=c or t
ctacacacacacacacacacacacacacacacgtgcaaaaaatatgatcaagaatgcaattgggatttgtgagcaatgagtagacctcttattgtwtatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagamccccactatctctgagaccctatagccaaanyatgaggacttggagagctactaaaatgattcaggtttacaaaatgagccctgtgagg

SEQ ID NO: 12067 - DNA, 449 bp, Homo sapiens
  misc_feature 371: n=a, g, c or t
  misc_feature 372: y=c or t
gaattccatgcgggacagcttcccaagaaccacagactccaacctcctaaagcaaagatctctctctcttctgaagccccatgaagcttaagagaacgctgctcaaggggggacttaatgagacaggaagaaggtgaacttttatattatttcttcagaagaactcactgcaggcatcagcaatgcttgaaccctgggagaatgtgtgtttttgctctggggaaagcctgtgagagaggggacagcccctgcagtgacttctcaaattgcttctgttaggaaaaaaggtcttcctccttatgatatctaagacaacaaaaagtgtgattttgaatacctgcttagggagtctgccaatgaaaataaccaanygcagaactagtggtttaaacttaagggcacttttattattttagaaaatgcttacttccagttacaatgtaatccag

SEQ ID NO: 12068 - DNA, 191 bp, Homo sapiens
tcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccac

SEQ ID NO: 12069 - DNA, 169 bp, Homo sapiens
aaaatgaggcggaaggtggttggctgagggttggcaggataacccggagagcggggccctttgtcctccagtggctggtaggcagtggctgggaggcagcggcccaattagtgtcgtgcggcccgtggcgaggcgaggtccggggagcgagcgagcaagcaaggcggga

SEQ ID NO: 12070 - DNA, 151 bp, Homo sapiens
taaagagaaacaaaataataaaggcattgatagagatgagaaggccacaatagctctaaaggtagatttagacagagtagggaacaggttgtgtcttaaaatgaggctgaggagttataattttacttggagttaatggggatgccactgg

SEQ ID NO: 12071 - DNA, 150 bp, Homo sapiens
caaatgtgccttgatatttaaataatatactgaatgcagaatttatgttatgtgaaccattatggaaaatgttaatgttaacaaaatgaggtgtattgacttttcaacaatgtaaattaaagatggtacatctactgtttaagggcagag

SEQ ID NO: 12072 - DNA, 360 bp, Homo sapiens
  misc_feature 4: m=a or c
agamaagtgcccctgcctcggcgctttcggttttggctgggatcatccgcggcggccgggctcgtggggcgcctggagtgagggttctggttcccgccggcgaggattgttaaaatgagtcttcggaagcaaacccctagtgacttcttaaagcaaatcatcggacgaccagttgtggtaaaattaaattctggagtggattatcgaggggtcctggcttgcctggagggctacatgaatatagccctggagcagacagaagaatatgtaaatggacaactgaagaataagtatggggatgcatttatccgaggaaacaatgtgttgtacatcagtacacagaagagacggatgtgaaga

SEQ ID NO: 12073 - DNA, 222 bp, Homo sapiens
  misc_feature 114: r=a or g
ctcagtgaggctgatgccgtgcagcaagcagtaggtaatgagtctttgtgcagagtgaagctcttgttgctgaacaataaagcatatggtacaagcaataaaacacagggctgraaatttaagaagattcctctgaaccaggaagaactgtgtcttcggtgatgctgacacatatgataaaatgatcatttattttggatcctaatgaataaagagtgcaag

SEQ ID NO: 12074 - DNA, 287 bp, Homo sapiens
aaattcgaacggctttggcgggccgaggaaggacctggtgttttgatgaccgctgtcctgtctagcagatacttgcacggtttacagaaattcggtccctgggtcgtgtcaggaaactggaaaaaaggtgactgaatgacatcggattaactttgtttctgcagagctgttctggaggaagaaagtgatggcgccaatgacttaaatttagaggtcctgaggcgatgttttggtgtttgtttgctgttgggagaagcctcgaggccaaaactgtgcgaggcgctggt

SEQ ID NO: 12075 - DNA, 434 bp, Homo sapiens
  misc_feature 79: k=g or t
  misc_feature 83: y=c or t
ctggagctggaatcccattgatcttctagctaccattcattttcttcactgttcacaaaagaagagtgtgaaattcagkgaaygctgttactaatcctgttacgagatgaatctcatttcaccaaaattaaattatgtttttccgctaaaatgatgatacaagttgaagacacatcactctgaaattggaagacctcaccacttaaggctccacagtggcttactcagctgaactctaggttactactctttactttgttcacccattggggggtgcagtttttttaaaatgttgggagatggccattctaactactgttgaatgtctctgttttgggaaggtataacaagaaataaaaaagaatatatatgaagggagagactggttatctcctcccatatggttgtgcttatcctcttacggcttacaaatg

SEQ ID NO: 12076 - DNA, 396 bp, Homo sapiens
  misc_feature 347: k=g or t
  misc_feature 376: k=g or t
tttttaaggtatgttgagtaagaatctatagagcaatgaaaatgcaagagcaatagctatgggcaccaaatggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcagctgagtgagggttgcatcggtgtttatttgataacacgttckaggggctgggcaagatggctcatgtttgkggtctcagtactttgggagg

SEQ ID NO: 12077 - DNA, 222 bp, Homo sapiens
ggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaaccagggggatc

SEQ ID NO: 12078 - DNA, 429 bp, Homo sapiens
agtcgtccgatgagcccgagcagctgagtcccttccctgtctttcactcttctggcatcggtggttttacttcttcgattgaaccctgcttcctcgacccccctgggaggccgccttcttcaggcgcctcccttctctccacgagctcgccctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaa

SEQ ID NO: 12079 - DNA, 75 bp, Homo sapiens
aaaatcattaaacttctgcttttccctatcttgaagtaaaatgcatatgtatagttaatttatcgaaaacacagg

SEQ ID NO: 12080 - DNA, 171 bp, Homo sapiens
attatctattcagtgatattaaatacataactctaaacatcatccccgaacaaattaccttttatcaattgaaacaaaccaattaaaaatttcaaaatgcaaccatgtaatcaacggcttactacacgataattatgaccaaaatgccaattaatgtgttaatatatgacc

SEQ ID NO: 12081 - DNA, 232 bp, Homo sapiens
tacagaaaaaaaaaaataggatcttgactgtggtggtctccaagtatggccaatacagtacacttttccaagaaagtgattcttgaaaatgccacttaaaggtcagtgttggagcactaattaaatgccatgatgtcccttttgcctgtgatggctgtctgatctgagaacagggcgttgggtgatttggtgttctcacagtaagcctttattgacctctctccctcacccc

SEQ ID NO: 12082 - DNA, 241 bp, Homo sapiens
  misc_feature 18: s=g or c
  misc_feature 20: n=a, g, c or t
acgctccaggccgcgagscnaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgt

SEQ ID NO: 12083 - DNA, 386 bp, Homo sapiens
  misc_feature 123: n=a, g, c or t
cataacccacaaggcacttaaatacttataaactatgcacacttgagttaaatgggcttttgtgagcggaacgggcatccaaactgccatttatggcagccctttatgggaagctttgctgtnagctcaggaaagttataaattttttgtatgcccaaaatgccattgaaacatggaccctctgcttctgtttgtgggatattagttgatgaatgcatttgactgtcttccgagatcctcaagggaaagggcgctcctgccaggttaagcttggtattcaaactaagaggagaacacgggagcactggatgggcttgtaggtggtgacgttgtttccaagacgaccttgagtatcaggggaaaggccgtcggtagccttctctccc

SEQ ID NO: 12084 - DNA, 221 bp, Homo sapiens
agaccagccagccctgggttgaactatgccgaccctgaattgcctcttgaaggcagaaggagcttaggaggcacctgagtccccaaaggagacatcgtggagtcagagccctgtacccagctaaggccagcatccagctgccctgtgacttgggaatgtttgatgagtcagaggaaaatgcctagagtgacccagcatgctcactttccctctatcttacc

SEQ ID NO: 12085 - DNA, 213 bp, Homo sapiens
ttacaaagaaaaaaattccagtgaattgtgcagaaatgctggtttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttt

SEQ ID NO: 12086 - DNA, 224 bp, Homo sapiens
  misc_feature 119: y=c or t
gggatctcggactccctggaccctccctccagcccagcctcgctagctccgcctgcggtacgtgctcccgcctccgactcaaaatgcctgtctggggaggtggaaacaagtgtggggcytgtgggaggaccgtgtaccacgcagaagaggtgcagtgtgatggcaggagcttccaccgctgctgctttctctgcatggtttgcaggaaaaatttagatagcaca

SEQ ID NO: 12087 - DNA, 335 bp, Homo sapiens
  misc_feature 80: s=g or c
attttccttctgttttcacccattctggcacaatctggcgccatcgtccttcttgtgaggccaagcctgaaaatgcgaasagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggaataaaattgaagg

SEQ ID NO: 12088 - DNA, 363 bp, Homo sapiens
  misc_feature 13: n=a, g, c or t
  misc_feature 146: s=g or c
  misc_feature 158: m=a or c
  misc_feature 165: s=g or c
  misc_feature 174: m=a or c
  misc_feature 182: r=a or g
  misc_feature 246: n=a, g, c or t
  misc_feature 247: s=g or c
  misc_feature 272: n=a, g, c or t
attccctacccancagccctcgcgcggtccggcacagcggacaccaggactccaaaatggcgtcagttggtgagtgtccggccccagtaccagtgaaggacaagaaacttctggaggtcaaactgggggagctgccaagctggatsttgatgcgggamttcagtsctagtgggmattttcgragcgtttcaaagagagcacgagcggctccgcaaataccactgaagaggacacgctctgcacccnsccaccccacgaccttggcccgagcncctccgtgaggaacacaatctcaatcgttgctgaatcctttcatatcctaataggaattaacctccaaataaaacatgactggtacgtgtg

SEQ ID NO: 12089 - DNA, 502 bp, Homo sapiens
  misc_feature 13: n=a, g, c or t
  misc_feature 49: r=a or g
  misc_feature 154: r=a or g
  misc_feature 381: k=g or t
  misc_feature 382: k=g or t
  misc_feature 414: s=g or c
  misc_feature 432: n=a, g, c or t
  misc_feature 433: k=g or t
attccctacccancagccctcgcgcggtccggcacagcggacaccaggrctccaaaatggcgtcagttggtgagtgtccggccccaggtaaggctgtttggactccgtggtggaagcaggagccagggtccagggtccagagccacactgggaragaaggaagctgcggactggcctgccctttgctcaggcacttcgccacgacctcacttgaggcgcgccagaccccgctccgcctgcccaggcgcgccttcctgctgcccagggcctgcgccaaccgggttaggcgtggagggtgaaggcatctggggcacgcgcttctgggcctgggaatgcgccgccttgggccactgttcctctttccgctaagaaatagccgckkccctctcccgctgcgacccagttgctttgcgsgtgaatgttaggcgcagnkttgcccttttttcccaaggcttaagctcagatgaagctccaggagggagctcaggactaggactgtacc

SEQ ID NO: 12090 - DNA, 167 bp, Homo sapiens
cttcaaattatttcttaaaatgcgtgtgtatccagagtttaaactgaaagagttgttttcttaattccaactgtatttttaaagtatcattcaacttcaagtaataattaaatttttcatgttttgtttataagtgaatgtatgtaaatgataccaatttttggcca

SEQ ID NO: 12091 - DNA, 125 bp, Homo sapiens
aagaaaaacacatggcagctgggttcagcacagcaagcaagagagaatgtgtaagaaaatgctagcaagatgagagccatggtgttttggtaacctagtcgtaataccagcatttttaatattac

SEQ ID NO: 12092 - DNA, 434 bp, Homo sapiens
  misc_feature 127: n=a, g, c or t
  misc_feature 309: s=g or c
  misc_feature 310: w=a or t
  misc_feature 311: w=a or t
  misc_feature 312: k=g or t
  misc_feature 373: n=a, g, c or t
  misc_feature 374: n=a, g, c or t
  misc_feature 375: n=a, g, c or t
tcgattgttaacgtgtttttgtttgggaagtaattttgtttgaaaatgctctcacatacaggaattagggcctagattgtaagctcttgcagcagtcacatttgttcccgggctttggtggttattnctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcswwkggggagtgtggatgggccgacctggctgggactcgtgaatctggagaagagctggagaatnnntagtattgtctgtatttggagactttaatttctgtgtgagaccaaaggaggagagatgt

SEQ ID NO: 12093 - DNA, 273 bp, Homo sapiens
caggatctaattcttttgataagttctagctctaaaagtgatagtgggactgtatgttttctgatactggtggcttatgttattaaaccttttttaaaaaaggttcactctaaaagctgaactacatccttagttttcagtctacttgactctatcaggagctttttaaggaaagtaagtataacatgcaaaggaagctttttttgtattcattttggactcctgtcaataaaaatagaagtttgttgactcgttttatgtttcaatgtgtgt

SEQ ID NO: 12094 - DNA, 490 bp, Homo sapiens
  misc_feature 420: w=a or t
caacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgwgccctggcagttagcaagagcggataagtgcccacttagacagtatgcatgagacgttgcgacgcactgg

SEQ ID NO: 12095 - DNA, 420 bp, Homo sapiens
  misc_feature 220: n=a, g, c or t
  misc_feature 316: k=g or t
actagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcatnatcagttgaactgtaaatacaaaatgcttcttccaattagtctctatgatgattaagtttctaaaatttatctgaacaccattcagaaacttgttktggggaatttgatagttattgatgtgcatctgttaaactgatgacagacataactcatcattccccagaaaccttttttgattacagtatctaacattttgcct

SEQ ID NO: 12096 - DNA, 227 bp, Homo sapiens
  misc_feature 226: k=g or t
  misc_feature 227: w=a or t
tagaatgctcatctctgaggactgctgtcttggcaagttgttttgttttctggcacctgcctgactgtaagaaaatggaattaacaattctaaagtaaagaacacatgtcctaagagagggtattgtccccatttcataagggctctcagtacaactctttatataactttgtaacagggactttaacctattgaatttgtcactacatacttgccagaatgaggkw

SEQ ID NO: 12097 - DNA, 147 bp, Homo sapiens
taaactattatttatccttgtgtaatattagtttttaactttaacatctgtttctttttaatctataatgagctagttttatggaaaatggaatttcttactatataaagaatacagagactcattgtattagagaatcaagtcagc

SEQ ID NO: 12098 - DNA, 212 bp, Homo sapiens
gtctgccgcggtggccgggtgccggtaagggtttccagcgcccccggcctaggttttggaggcgcgggaatgcgttcgttgctcagtgtcggacttccccctattcccatcggccgaggctgtcactttacgctcataaccgtttttctttactgcactcgtgtcgggaggaaagggacttgcgtggcacccccagacctccccgtctccgc

SEQ ID NO: 12099 - DNA, 444 bp, Homo sapiens
gctggcattttctcctggacaaggagagagtgcggctgctgagagccgagcccagcaatcccgatcctctgagtcgtgaagaagggaggcagcgagggggttggggttggggcctgaggcaagcccccaggctccgctcttgccagagggacaggagccatggctcagaaaatggactgtggtgcgggcctcctcggcttccaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctagctaagtcagcctttaaagtccagaatgccaccacaaaaggccaaatggtgtctatgatttctctcag

SEQ ID NO: 12100 - DNA, 120 bp, Homo sapiens
ctgaatctttacttattcatcagtaaaatggacttaataatcacttatgtctatttcactgattgcagcgacttcataaatgaaataattcatgtgaaactattttgtaacatgtaatgc

SEQ ID NO: 12101 - DNA, 85 bp, Homo sapiens
  misc_feature 20: w=a or t
gcggtcggtcggcgcctgtwctcgggctgtttggcggcatacagaaactgctgtaaaagaagaagttgtgggtattttttttttt

SEQ ID NO: 12102 - DNA, 242 bp, Homo sapiens
gaaattgtttttctttcagtacactaaggtgtgtgttttcaaaaccaaacacaaacctgtcaagagtatttgttggctagtttcttaaaaggccaagagaaaaaaaatgatatatctttggaaaacttttaatttgggagttatgtgagttgtctttctcctggatcacgattcacatttaattgcttttccagttgcaacaagtccttcttgagagttttgtggaaaatggtgcttccctg

SEQ ID NO: 12103 - DNA, 205 bp, Homo sapiens
tggaaaggctcttactcgcaatttaaaacacaaaaatgaaaaaaagatacagacagcccaactaaatccttgaaatgcagcgtggcgtgaaaatggagcggcattttagttaacgagggtctggatgccattcacaggaatgcagtttctacagggttctgctttgcagagacctctcctgataataataataaatttactcaga

SEQ ID NO: 12104 - DNA, 564 bp, Homo sapiens
  misc_feature 21: y=c or t
  misc_feature 33: y=c or t
  misc_feature 57: s=g or c
  misc_feature 187: n=a, g, c or t
acttttccggttgtgctaggygcctgctcctgycgacgtgttcttccggtggcggasggcggattagccttcgcggggcaaaatggagctcgaggccatgagcagatataccagcccagtgaacccagctgtcttcccccatctgaccgtggtgcttttggccattggcatgttcttcaccgcctgnttcttcgtgtatcctttcactgagcagccagaggaccagcattagtgatgtgggaagctcagggagaaaccacgctagattgccgtgggctgggctctctgcactccacagtccaccccttcgctttgccttaactgctgtgcccagttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatg

SEQ ID NO: 12105 - DNA, 203 bp, Homo sapiens
tattgtagtgagttagaaaagaaaaaaagcagaattttggatcaggggaaacagattaattcccccttgggacctagacaaattattatagagagcctcagcttccccatcagcaaaatggaggtagagtctcgtgacaccttcccggtggttgggaaatgctttgagttcctgcaaacagaggtatatgatagtataattac

SEQ ID NO: 12106 - DNA, 350 bp, Homo sapiens
  misc_feature 135: n=a, g, c or t
  misc_feature 136: n=a, g, c or t
  misc_feature 344: r=a or g
acgtgcctccgatcacgtgaccggcgcctctgtcattctactgcggccgccctggcttccttctacctgtgcggccctcaacgtctccttggtgcgggacccgcttcactttcggctcccggagtctccctccanntgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagatgaccaaaatggatatccgaggtgctgtggatgctrctgtcc

SEQ ID NO: 12107 - DNA, 284 bp, Homo sapiens
  misc_feature 7: m=a or c
  misc_feature 8: n=a, g, c or t
cacaggmnaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataa

SEQ ID NO: 12108 - DNA, 303 bp, Homo sapiens
taatcaaaatttttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaaga

SEQ ID NO: 12109 - DNA, 308 bp, Homo sapiens
  misc_feature 79: y=c or t
aacccttgctctgaagtcacaggcctgacttccagactaggctctgccctaaggaaatcacctttctggtcttagtctycccatctgaaaatggcataaccaacctacctgcctcaaatacaagaccctgcttgtgaagcgtctcctggctcagaccagtgctagaagtgtccagtctagcagctcctggaccaagactccgtggccattcccttcctcctgccttccatccacccccttacgatacagaagttgagatacagagaggtgaaggaacttgtcccaggccctacagctaatcaaaaaaa

SEQ ID NO: 12110 - DNA, 388 bp, Homo sapiens
agaatgtaaacttgccagcttagacagggatcagtcctgagactgctggcagtagcaaatggctattagagtaactgtataatggttttgcctgcactttctctatgtatatacaaatgtacatgtataaatataaaaattaagtgatcatggttcttggtaacctgtcccaagtgctgtgattcacacgcctgacactaaaaggttcttcctagtccagtcagccagctgtgaccaccagcagcacagctgagtgctgagaatctggctggaaagagaaacgtggctcaagtgctggctcaccttctagctgtgtggccctgggcaggttactgaggctcttccaacctcacttttcacatgtaaaatggcatttctaaaagtacct

SEQ ID NO: 12111 - DNA, 379 bp, Homo sapiens
cctgttcttcatgttttgaggttactcgtcaaagtgtactttgccttccaaaatggccctttggggctttcttgtaaaccacagattgaagaatgtggttatcatgttaaacatgcaagagtctgggcgcagtggctcacacctgtaatcccagcactttgtttgtttgtttgtgactgaatcttgctctgccgcccaggctggagtgcagtggcaccatctcagctcaatgcaacctccacctcctgggttcaagcaattctcctgtctcagcttccagagtagctgggattacagaagcccgccaccatgcccggctaatttttgtatttttagtagagatggggtttgaccatgttgcccaggctggtctcaaact

SEQ ID NO: 12112 - DNA, 474 bp, Homo sapiens
acgccccgctcgcgtcaagtgactgaggcctgtggtggagaaggacgtgccgtgccgctgggttctgagccggagtggtcggtgggtgggatggaggcgaccttggagcagcacttggaagacacaatgaagaatccctccattgttggagtcctgtgcacagattcacaaggacttaatctgggttgccgcgggaccctgtcagatgagcatgctggagtgatatctgttctagcccagcaagcagctaagctaacctctgaccccactgatattcctgtggtgtgtctagaatcagataatgggaacattatgatccagaaacacgatggcatcacggtggcagtgcacaaaatggcctcttgatgctcatatctgttcttcagcagcctgtcataggaactggatcctacctatgttaattaccttatagaactactaaagttccagtagtagggccattcatttaatgtg

SEQ ID NO: 12113 - DNA, 245 bp, Homo sapiens
  misc_feature 120: r=a or g
  misc_feature 166: r=a or g
  misc_feature 220: w=a or t
  misc_feature 221: m=a or c
  misc_feature 222: w=a or t
  misc_feature 223: m=a or c
acgccccgctcgcgtcaagtgactgaggcctgtgtggagaaggacgtgccgtgccgctgggttctgagccggagtggtcggtgggtggcgatggaggcgaccttggagcagcacttggargacacgtgagtagtgcgcgcctcttcggcctgtcctgaggtcgcarcggaggaacttgagcggaacgaaaagcgcgagctgcgagtaccggccagggcgwmwmggggacgtcgcgcgacccccgg

SEQ ID NO: 12114 - DNA, 149 bp, Homo sapiens
gtttgtttccggaatttcaataaagctcgattcggctcgaagaagaccccgttcttccgggaaaatggcgactcccgctcgtgccccggagtcaccgccgtccgcggatccggcgctagtagcggggcctgccgaggaagccgagtgcc

SEQ ID NO: 12115 - DNA, 327 bp, Homo sapiens
  misc_feature 109: n=a, g, c or t
  misc_feature 113: r=a or g
  misc_feature 114: s=g or c
  misc_feature 187: k=g or t
  misc_feature 295: k=g or t
agagactgaacagccggcgagcaaatcaacggcatccagaaagccatgtcggactcggcgcccagcgcccaagcgctaacccgctgaaagtttctcagcgaaatctcangggrsgatctgggaccccgctgagaggaactgcttttgagtgagatggtcccagaggcctggaggagcggactgcaakccccgcccaacacggactggcgtttctctcaggcccagagacccggcaccagcggctcccaaaatggcgatgacaccggcacctggcccaacaaccagtttgacacakagatgctgcaaccatgatcttggcgtccgcca

SEQ ID NO: 12116 - DNA, 332 bp, Homo sapiens
  misc_feature 210: s=g or c
agagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcttggagaaggggcgcgattgcggtgaggggcggastggaacctcggggcctgaggtgctgaggatacctgaaagcgggctgagagtgtgctggaggaggcgggtcccgcgggggcggagctaggctgcctgggcggggccggaatcctgacaggcgg

SEQ ID NO: 12117 - DNA, 466 bp, Homo sapiens
  misc_feature 250: n=a, g, c or t
  misc_feature 253: m=a or c
  misc_feature 264: s=g or c
  misc_feature 394: n=a, g, c or t
  misc_feature 395: r=a or g
aaaaaaggcgggagcgtcaatcccgggttgagcaaaatggcgcgggagaaggagatgcaggagttcacccgtagcttcttccgaggccgcccggacctcagcacgcttacgcattccatcgtgcggcggaggtacttagctcactcgggccgcagccacctggagcccgaggagaagcaggcactgaagcggctggtggaggaggagctgctgaagatgcaggtggatgaagccgcttccagggaagacnaamctggaccttascaagaagggcaagaggcctcccaccccttgtagcgacccggagagaaaaaggttccgcttcaattcagagtcggagtccggctctgaagcctccagcccagactactttggacccccagcaaagaatggnrtggcagcagaagtcagcccagccaaagaggagaatccaaggcgagcctcaaaggcagttgaggagagcagt

SEQ ID NO: 12118 - DNA, 148 bp, Homo sapiens
  misc_feature 48: y=c or t
cctcagcttccagccaaaatggcggagaacagcgagagtctgggcacygtccccgagcacgagcggatcttgcaggagatcgagagcaccgacaccgcctgtgtggggcccaccctccggtctgtgtatgatgaccaaccaaatgcgc

SEQ ID NO: 12119 - DNA, 383 bp, Homo sapiens
  misc_feature 2: r=a or g
  misc_feature 72: s=g or c
  misc_feature 168: w=a or t
  misc_feature 169: s=g or c
  misc_feature 191: m=a or c
  misc_feature 205: w=a or t
  misc_feature 303: m=a or c
  misc_feature 313: m=a or c
  misc_feature 314: m=a or c
  misc_feature 325: y=c or t
  misc_feature 350: w=a or t
artcagttccggcgggtgacggtgcggacgggtcaggagcgtagaggcggcggcaaaatggcggcgcctgasgagcgggatctaacccaggagcagacagagaagctgctgcagtttcaggatctcactggcatcgaatctatggatcagtgtcgccataccttggawsagcataaactggaacatagagmgacaaggtctcgtwtcatttgccctggctggtctcgaaatttctggtctctgggctcaagcaatcctctcacctcggcctcccaaagtgttgggattacaggtttgagccamcgcgcctgammctgaggctcayacattgagcaacttttcagagagawggagcttggatcagaccgaagtttctctgcatg

SEQ ID NO: 12120 - DNA, 481 bp, Homo sapiens
  misc_feature 2: r=a or g
  misc_feature 72: s=g or c
  misc_feature 84: r=a or g
  misc_feature 85: r=a or g
  misc_feature 100: k=g or t
  misc_feature 456: r=a or g
artcagttccggcgggtgacggtgcggacgggtcaggagcgtagaggcggcggcaaaatggcggcgcctgasgagcgggatctrrcccaggagcagacakagaagctgctgcagtttcaggatctcactggcatcgaatctatggatcagtgtcgccataccttggaacagcataactggaacatagagatggagtcttggtttgttgcccaggctggagtgcagtggcctgatcatagctcactgtaaccttgaagtcctgggctcaagaagccttcctgcctcagcctccctgacacctcagactacaggctgctgtacaggacagattgaatgagcaagagggcgtacctagtgttttcaacccacctccatcacgacccctgcaggttaatacagctgaccacaggatctacagctatgttgtctcaagacctcaaccaagggggctgcttrgatggggttattacttgataatgct

SEQ ID NO: 12121 - DNA, 446 bp, Homo sapiens
  misc_feature 372: n=a, g, c or t
  misc_feature 373: n=a, g, c or t
actgaggatgaaatggtaacccagtagcccaaaagacaaagtccttctcaacaaagcctaaccaacaggcaatggattatagtgattcagaggaaagataagaaggttcctttgtcttggacctccactagacatcaaggaaacatgccaaaaaagtaaacaacaaaggcccccacacctttccaaactacaacccaaaataagttgatctgagaaacaaattgcaatgccgcatgcaaagcagatgtgtccaaattcatgtaggaccagacacatcctgaacctttcagtgcaacagctgttcaagactttcttcaaaatcatccaagcacaagggttgataaaatacacacaaaatggctgatgctcaanncaaccaaaacaccaggctctttgctgaaacctctgagaagggttcctggctccaggtcagcctcaatggaata

SEQ ID NO: 12122 - DNA, 243 bp, Homo sapiens
  misc_feature 12: s=g or c
ctttatagaatsagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagta

SEQ ID NO: 12123 - DNA, 365 bp, Homo sapiens
  misc_feature 42: m=a or c
agcctgcgctggctgcccggcaggcggcagaaggaaggaggmagagcggaggccagggcgggctctaggccgtggaatctggggccttaaagccccttcgtctccccagcacccactctctgggggcaggtgggcccggtgacagtaaccttcagggagccctgaagaccatggaggactactgaccaacaacctctgaccttcacccctctggatgggggacgaatcactaggcaaaggggaacaatgggaaggagacaaaatggctgcctttacagctgcagcaagatgtggaaacactggttccctaggcacctccattgtcttcccgccttgggagcatgaaataaataaagtgtgaaggg

SEQ ID NO: 12124 - DNA, 326 bp, Homo sapiens
  misc_feature 219: m=a or c
  misc_feature 320: w=a or t
aaaatgggagggggagacgcaagatggcggcagcgcgaactccggctctagcctcccgctgttcgactgcccaacctgggcaggtaagccccctcccggtttacatctggatgtagtcaaaggagacaaactaattgagaaactgattattgatgagaagaagtattacttatttgggagaaaccctgatttgtgtgactttaccattgaccaccagtmttgctctcgggtccatgctgcacttgtctaccacaagcatctgaagagagttttcctgatagatctcaacagtacacacggccataatttctgaagtgaawgtggat

SEQ ID NO: 12125 - DNA, 237 bp, Homo sapiens
aggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgca

SEQ ID NO: 12126 - DNA, 370 bp, Homo sapiens
  misc_feature 316: r=a or g
  misc_feature 317: s=g or c
ggatcgctttgctcacggcgctatctctcgataaagttgttgttgcggcttccgccgcgggtggaagaagatggcgtcgggtggtggtggctgtagcgcttcggagagactgcctccgcccttccccggcctggagccggagtccgagggggcggccgggggatcagaacccgaggctgggggacagcgacaccgagggggaggacattttcaccggcgccgcggtggtcagtaaacatcagtctccaaagataactacatcccttcttcccatcaacaatggctccaaagaaaatgggatccatgaagaacaagrscaagagccacaggatctctttgcagatgccacagtggagctatccttggacag

SEQ ID NO: 12127 - DNA, 117 bp, Homo sapiens
tgaatattcgaactcaggtcttgggaggcatcattccgtctccttcccgtgtgtcattaactgtgagttgctactggctggaagactttctctgtatctaaaaaagtaaacacattg

SEQ ID NO: 12128 - DNA, 388 bp, Homo sapiens
ctggcctcatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaattgaactgacactttttggggggtctaaagaatcaattcaaaatctattcattaaaaaaaaaccctcatttcttctagttttatcataaaactaagataatcagtccatgcaaactgtgatatgatatgaaacaaaacaaaccaccaccactaaaaaacccgcagttcaagacatgcttaattataacttgacataccccacaac

SEQ ID NO: 12129 - DNA, 255 bp, Homo sapiens
aatttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaaga

SEQ ID NO: 12130 - DNA, 404 bp, Homo sapiens
  misc_feature 365: n=a, g, c or t
  misc_feature 366: n=a, g, c or t
  misc_feature 367: n=a, g, c or t
  misc_feature 399: w=a or t
agcactgcagggctctgcgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcnnncacctatgttccctggctaagaagtcagaggwagcca

SEQ ID NO: 12131 - DNA, 284 bp, Homo sapiens
  misc_feature 193: m=a or c
taacttaaaagaagtaaaacgtaattgcactactgttttccagactggaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgmgcttttattatgggaagcttcttgaactgcatttactattgtgaagtttcaagtcccgctgtaaagatcatgttgttttgttttccccagg

SEQ ID NO: 12132 - DNA, 179 bp, Homo sapiens
tcttaattttggttttgacattcatttaattttttccatgttaaatatgtagtttaattatttactcaaaataaacattgttcatgcttttaggcctttgggggaattgatttttatccacaggtagaaaatggtctttgcacacactacacttatttcaaatatacaatgtgctcccg

SEQ ID NO: 12133 - DNA, 387 bp, Homo sapiens
  misc_feature 335: r=a or g
tttacattagagtgaaaaataaatggtttgtttctgaagttagtttcttaagtgagttttcaggtgtctctgaaaaatttataacaatcatgtattatatgtgctgtaacatcatgtacgttacctccatctattttaggatattttcctcacctatatattatagggagaataatttagatacacatgctcagagctgagatatttctctgataaatcaggtaacaaaatgtatttgattgatggaattttgaagtaaatgtgtttttatccatcagtttctgagtaacaaagagcaccaagttttaatttaaataggagatttaacactaggratcagggagtttagtatgaagagttaaaaaaatttaaaaaacagtgtaagct

SEQ ID NO: 12134 - DNA, 423 bp, Homo sapiens
  misc_feature 372: n=a, g, c or t
caatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaaccacgancttcatggagatttgaataatctatttgatgagatttctatttcaataacc

SEQ ID NO: 12135 - DNA, 251 bp, Homo sapiens
  misc_feature 59: r=a or g
agacaaagcccatgacggtcatccaggattcctgtgatcagctattaccaaagtccccrggctttctctacggatgaaaatgtcaatgtcaggaaacatgtctgccacagcttcttgaaacacagaggacaaaggaagttgaaggaagattttttaaaaatcaaaattatttttagataattgattatgagcattagtaaggaacttgcaaaggtctggggactgttataacacttgttctctcacctatc

SEQ ID NO: 12136 - DNA, 204 bp, Homo sapiens
  misc_feature 11: y=c or t
gtggttcgggyccgctttcgtctccgcctgctgccgtccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaactctagcctccggaacttcatcgccatgg

SEQ ID NO: 12137 - DNA, 207 bp, Homo sapiens
  misc_feature 207: y=c or t
attctcaggagatatattttttttgacatttatgtctgaaaatgtctattctttactcatgctttattacaaaggtttgaaattctaggttgaagtcattctctttcagaattttgaaggcagtatgctattattttcagttttcagtattattgttgagaaggccacttttacctgccttgacctccaagcctctgcattttcgcy

SEQ ID NO: 12138 - DNA, 470 bp, Homo sapiens
  misc_feature 196: w=a or t
  misc_feature 293: y=c or t
  misc_feature 340: y=c or t
  misc_feature 418: n=a, g, c or t
atctcttttctcatctcttgaaaaaaaccaacagagaaaaaagtaccttgagaataaaggtaatgattaatctgtcaggcacaaaagggattgttttggggatttcgggttctaagtcgcagattcaaacaaatagcagcgaacagggaatgacagttccaccagaagacgattaagccacagcctctaattggawcggcatttgtacagtcagagactcttaccagacatctccaggaatctgtgagccattgtcaaaacgtccattttcatctggctgtgaaagtgaggaycacaacaggtaggtattggtagaaacaggagtcctcagagaagcccyaagatgcagcctgagggagcagaaaagggaaaaagcttcaagcagagactggtcttgaagagcagcttagcgaaaganaccctctctgagttcttgggcacgttcatcttgattgtccttggatgtggct

SEQ ID NO: 12139 - DNA, 338 bp, Homo sapiens
catcccagtgtcatcccagttagtcatactctagctgtgtgattttaggcagtttacttaatctctccgtggctcagtttccttctttgtaaaatgtggattattataatacttagctcatgatgattggaaagattaaatgttatttcatataaagtgaacagaacagtacctgaaacataacagttaatagctcaataaatgttagcaattataggatcacagtccaccattcaaactcttagggtctaataggttatggaattaggaattttttttttatatgggcaaggtagtaatgtgtagccttccaatagagtccagtgcaatatccccct

SEQ ID NO: 12140 - DNA, 275 bp, Homo sapiens
gctgtaaggagcgagtgctggagggaacctccgcaccgttagcctccaactgggagggcgaggccaggcccagggacccaacgttttctcttagcttgcttctgcctggtctgggttaccatcctggttgcaggcacctgtgcaccccacaggccctgagcctgtgcaattatttcgagagtcaaaatgtggatttccgaggcaagaaggtgatcgaactgggtgcggggacaggcatcgtggggatcttggcagcgctgcagggtgcgtgagct

SEQ ID NO: 12141 - DNA, 385 bp, Homo sapiens
  misc_feature 4: r=a or g
  misc_feature 242: r=a or g
  misc_feature 295: n=a, g, c or t
  misc_feature 323: w=a or t
  misc_feature 336: s=g or c
  misc_feature 359: r=a or g
  misc_feature 370: k=g or t
  misc_feature 385: r=a or g
tcaraatttataataaaagcacattaacttaatgacatttcatttaacttctgtagacatgaaaaaactgcttcgtaacatgtgaagtccagatccaagggaacctcagaaatccattgaagttccattgttaagaagttctgtttgtttggcaactgctttaaacccgatagaacaagatcagaagtggcagtctataactgaaaatgtggtaaagtacttgaagcaaacatcccgcatcrctattggacctctgagactttctactttaacagtttcacagtctttgccagtnctaagtaccttgtagctgtattgctcgwttgctttggagascacagtttctaacagactttcarcagaggtctgkatatttttacaagcr

SEQ ID NO: 12142 - DNA, 86 bp, Homo sapiens
atgtcactccagtctctgccttgagatctcataaactttcagatcaaaatgtgtaacatctgcaacatctaaacttaacaacaacc

SEQ ID NO: 12143 - DNA, 190 bp, Homo sapiens
tgcgcaattgctattttccccagagcggctttgtctttggatttagcgtttcagaattgcaattccaaaatgtgtaagacgggatattctcttctgtgctgtcaagggtaagagttgcgagtgtagattagaatttctgttgcttttagtctgttagtaattttttgctttcagctattatttctcccct

SEQ ID NO: 12144 - DNA, 483 bp, Homo sapiens
  misc_feature 352: k=g or t
  misc_feature 371: k=g or t
taaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggtkgttttcttctgtttatttkctgagactcctacaggagccaaatttgtaatttagagacacttaattttgttaatcctgtctgggacacttaagtaacatctaaagcattattgctttagaatgttcaaata

SEQ ID NO: 12145 - DNA, 305 bp, Homo sapiens
cagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgtatagagcactcgaacttttgtatttgctgcttaacctcaatattacagccacaaacaaggggtaccaagacaaagtataactgagcataagcagaaaatgttaaccctccaggtttctttcttaagcacaataaaagtgg

SEQ ID NO: 12146 - DNA, 441 bp, Homo sapiens
  misc_feature 179: k=g or t
  misc_feature 357: k=g or t
atgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatatkcttcctctagcatcatgaaatttgacctcttcagccgtgcatggttaacactcttagagtgatgtgagaccaagttttcttcaatggcatcagataacccatctccttgagaagaacccctgatgaaaaagaaatcctctccaaatcaatatcttcattcatcactacactacatgtkctattttccttcctccatttctcagaggaaggagttctattacttgccattgatcttaaaattatagttatcctccactgtgct

SEQ ID NO: 12147 - DNA, 398 bp, Homo sapiens
  misc_feature 180: y=c or t
  misc_feature 307: r=a or g
  misc_feature 308: n=a, g, c or t
tattagtaaaatgttattagattaaaattatggagtaagcatttggcaaactgattgactcttcactggaaagaccaggctttttagcacacatttctgttcatgcttaaggtcagaagtcaatcaaaggcaaccagaaaaaaaaaaggcaaataaatgaattagggacataattatttyctgttataaataatcaggatcttttcaagtttaattatggggagttgttgaataggctagttttatgccatgcaaataaaatgtgaatttcaaaaatcttagtgaaactcaaatttatttttacttrncgataataaaatcacaaatacttcttgagctcttgctgtaggccaagtgctgtgctcagtacttaacatggataaactcgattgagtatc

SEQ ID NO: 12148 - DNA, 181 bp, Homo sapiens
ccttgaggctggagcaattcttattcacatctagtcctcaacacagtaggcacaaagtgttgatagtatgtggatagaaaggaatagaaagaatgattggtaaagtatttatgggtaaagaaatgagtcaacatttctctcaaatgccttgaaaatgttattatgatttgcattcacagag

SEQ ID NO: 12149 - DNA, 150 bp, Homo sapiens
gtatctggatgttcattctattattttgctttgaatttaaaatgttccaaataattgttgtatgtaataattaatatattaaagataagctataatctgaagtcataatttaggagacatgtcattaattctgcctactctctactgcca

SEQ ID NO: 12150 - DNA, 170 bp, Homo sapiens
aaggaaaatgttggcaacagtctctgaatccagcctttctgggtatgactttgggcaagttacttgacctctccaggcttctatttcctccgtcatacgagactaattattgtaccgtgaggcaggattaactgaattactccatttaaagctcttagaacagtaaccag

SEQ ID NO: 12151 - DNA, 63 bp, Homo sapiens
aaaatgtttaaatttgcttttagggtcagttgctctgttatcagtagtctcttatgaagaatg

SEQ ID NO: 12152 - DNA, 156 bp, Homo sapiens
ctctataataaaaaagtaggagaaagactgaagaacccgagcagaacaggcctctgagcccaagccaagccatcgcatcccctgtgacttgcccgtatatatgcccagatggcctgaagtaactgaagaatcacaaaagaagtgaatatgccttgc

SEQ ID NO: 12153 - DNA, 74 bp, Homo sapiens
agcttttggttctctgcatcaacacagccagcatgcctatgatttctgtgctgggcaaaatgtttctgtggcag

SEQ ID NO: 12154 - DNA, 299 bp, Homo sapiens
  misc_feature 135: n=a, g, c or t
atcaacattcgcttctagtaaaattaaagtcaattaagaaatagaacttgggtcaaaattctgttacaaagcttcataatttgtcccgaagcatatggtggagcattctgagaaatttgctttttgtgtgtttgnacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagc

SEQ ID NO: 12155 - DNA, 155 bp, Homo sapiens
tggtttagcatagttaaaaaagtagtgatccatcagatagagtttgctgggccagaaatactgcagtgcagcagagaccttggaaaaagtgagatagcatatgcttaagcaatactgcactagtgttgcataaatggtggaggctgcggctcccc

SEQ ID NO: 12156 - DNA, 87 bp, Homo sapiens
ttaccaaacataatttctccaaattgtacaaagttaaaattaacctcaaattcaagggtatttattttcttttataaattaagaggg

SEQ ID NO: 12157 - DNA, 139 bp, Homo sapiens
acatgacatgtagctgttgaagatgattttgatgtatgtaaaattaagcatattaatctaagaatctctctccacattcgtaggatgtaatccctgttcattactacttaatacctccaccaacaaagactaagaatgg

SEQ ID NO: 12158 - DNA, 175 bp, Homo sapiens
  misc_feature 148: k=g or t
ttaaagggaaacgactttggactcacgtaggcataggagaacgaaacttctgtacattttaatctgaataattcttcaggatttaaaattaattggctctggcttggttggaccgtactcggatctcgccacctctgcgtttcccgaktcactggcgaagaggtgattttttttt

SEQ ID NO: 12159 - DNA, 149 bp, Homo sapiens
  misc_feature 135: k=g or t
  misc_feature 145: m=a or c
ccccaacatacagagattacagctaaaattacgaccagagctgttaatcaaatcccatcttcccttcctattcacacagtagagatgttataagtcatacaggtttgagacagaaaattgagagcagaggagcakgtgttttaamccag

SEQ ID NO: 12160 - DNA, 309 bp, Homo sapiens
cctgcaaaatgtatactcgggttgtttttctttttaaaaatattgtaaaacaggcaagtgaggcttagcagcattatggttcattactgggtttggatatatacctttttcagcttctgtaatgagcaagttgtgttttcaatccccactttcaatgtctattggagggctgctttttgttttgttttgttttgttttaatcttttttaaacagggacagaatgatgctgctaaaattagaacaggagattctggaatttattaatgacaacaataatcagttcaagaagttccctcagatgacctcat

SEQ ID NO: 12161 - DNA, 469 bp, Homo sapiens
  misc_feature 397: r=a or g
  misc_feature 399: m=a or c
  misc_feature 419: r=a or g
  misc_feature 425: m=a or c
atcgccgccatattgtctgtgtgagcagaggggagagcggccgccgccgctgccgcttccaccacagtttgaagaaaacaggtctgaaacaaggtcttacccccagctgcttctgaacacagtgactgccagatctccaaacatcaagtccagctttgtccgccaacctgtctgacatgtcgggacccgtgccaagcagggccagagtttacacagatgttaatacacacagacctcgagaatactgggattacgagtcacatgtggtggaatggggaaatcaagatgactaccagctggttcgaaaattaggccgaggtaaatacagtgaagtatttgaagccatcaacatcacaaataatgaaaaagttgttgttaaaattctcaagccagtaaramagaagaaaattaagcgtgarataagmttttggagaatttgagaggaggtcccaacatcatcacactggca

SEQ ID NO: 12162 - DNA, 424 bp, Homo sapiens
  misc_feature 345: r=a or g
  misc_feature 350: r=a or g
  misc_feature 379: r=a or g
gtaaacaaacggagctgcggaggagcgggtcccgggatgtgaccggggctctgcttgtggctgcggcggtggcttctgaggctgtcgggtctttgcgggttgcggaagggggccccaatacccttcttcttcaggtcttaagaagctggccgtggtgcaataaggaacttaaaacaatggaagagcggaaagtgaagaggaggagtcctaagtcttttagtgcccactgtactcaggttgtcaatgccaaaaaaaatgccattccagtgagtaaaagcacagggttttcaaatcctgcatcacagtcaacttcacagcgaccaaagttaaaaagagtgatgaaargaaargaccaaacctcagggtggagagggcaaargcgctcagtcaactccgatccagcactccttcctcactgatgtct

SEQ ID NO: 12163 - DNA, 245 bp, Homo sapiens
catgaaaaatcaaaaacatgtcatgagttgtgtttccataagtatttggaaaattagtcttcttactttaatagcatctcacaggggacagtaggtgccgagagtaaagttggcaggaaggagtacagtgtgaaggcccagagaagtaccctgtgaggtcacaaccgccactgaggggatgacaggcttgagccaccgcccatggtctcatttgtttttctttctttctttctttcttttttttt

SEQ ID NO: 12164 - DNA, 379 bp, Homo sapiens
  misc_feature 335: w=a or t
  misc_feature 361: m=a or c
tgtaaatgttgctgttgttctaagctctgttaatgttaagcattctttgtatataaaattacaataaaatgttaaaactggttgcttgttttgtggatgaatgtaaagacaaaccccaatgaatggctgatatgagtgctaaatgcctgaagattcaacttaactagaaatcactcccttagaccctgcttacatctagaccttgtatatcatacctcaaagatgaaattcataaaacttatctgaagagtttaatttaaaattataatgctcaatgcacatcttttgcacttgagttgaaactaacatcactacctaaagagccttctacttcwatatctgctgcataatacgttcagtmattctacccccatcccta

SEQ ID NO: 12165 - DNA, 125 bp, Homo sapiens
aacttagatacactagtttgtttaaaattatagatttactgtacatgacttgtaatatactataatttgtatttgtaaagagatggtctatattttgtaattactgtattgtatttgaactgcag

SEQ ID NO: 12166 - DNA, 185 bp, Homo sapiens
tgaaacgaatgccaaggcaacctaaaattataggaattcactacacaaataaaccacattgcagatagaaatattttggatattgtgagccaggtttctcattattgaagaagagagttacaagtgtagaaagtgggaaggcagctgggtgcaatgggtcacacctgtaatcccagcactttggg

SEQ ID NO: 12167 - DNA, 382 bp, Homo sapiens
  misc_feature 219: r=a or g
  misc_feature 373: m=a or c
tagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccrccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgmagatcagag

SEQ ID NO: 12168 - DNA, 660 bp, Homo sapiens
  misc_feature 345: r=a or g
  misc_feature 349: m=a or c
  misc_feature 352: m=a or c
  misc_feature 386: k=g or t
  misc_feature 387: n=a, g, c or t
  misc_feature 570: n=a, g, c or t
  misc_feature 601: r=a or g
  misc_feature 610: r=a or g
  misc_feature 611: r=a or g
cactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggcattcttggacttgagacaagaacattgttgtgtagaaatttcattgactgtgttaaaattattctccatgggctggragamcamataacatggcctttagaatgagacgggcattgaknggatgcaaggtctccacacttactagctgtgtgacattggacagagtgcttcatcattccgagactcagtttttaaaggaaaaacaactaactaccttgcaagcttgctagcaggtttaagtgtaataatgtgtgggaatgactgcaccgtgactaacatgcagtgacagcttaattaaatgngaacccttatcattatcatataagaatgtgrgttacatarrgaggagtctgtcagttcgttctctgctgtgtccccaagaccatgaatca

SEQ ID NO: 12169 - DNA, 380 bp, Homo sapiens
  misc_feature 331: s=g or c
  misc_feature 377: n=a, g, c or t
  misc_feature 378: n=a, g, c or t
cgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcacsccaccctgcttttaaaaattctaatctatcccctctaaccatagcnncc

SEQ ID NO: 12170 - DNA, 134 bp, Homo sapiens
ttcttctttcattgacccctatcatatgtttcctacactcaaaattatttcccctacctttattccatcagttagagattcaccgattcatttaacagcaagcgctttctctcgtcaccttcctcccgccaccc

SEQ ID NO: 12171 - DNA, 248 bp, Homo sapiens
ttaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaaccta

SEQ ID NO: 12172 - DNA, 332 bp, Homo sapiens
cttttcctagagagttaattcagttcggtgagttcagtgagcagtatgggctgagagagccctcaaaattcaacgtagcactggctctcccagcagcaggcattgttcaggtgagacagaatggttgcctgaggaagtagtgtgctggggaactgcagggattaaggtcatcctcttccagattttcattaagtctgaaatgctctccttggctccacaagagatcctcttgctattcctactgtggtgtacggacagcttatggtttacttcttacagtttcctgtttcagataaggggaagcatggccaagatggttctgtgagtcaggc

SEQ ID NO: 12173 - DNA, 236 bp, Homo sapiens
gaacattcgaccagcttctcagttgtagtttgtgtatgttctttataactcacacttagagccatggggagacccataccgataagcaggccagcagttgctggctgcacattgctgtcactgccgcggcagtacagaaaccatctgcttatactctgaataaaattcaagaaagcatagattctacataaacaggcccaagattacatggcaaactgagatgaagaggatgctgg

SEQ ID NO: 12174 - DNA, 445 bp, Homo sapiens
agatttgccatgagtgtctcaatgaagacgtgataatgtgggctctagtcacagggtctaactcagacatggaaaaaagtccatttcattaatctttatcggcacttgaattcctggctaagggagaatgtggaacattgaaggactctctgggaataggatggagttataccagattagggggacttaaatactgtggtagctggtggtagaagggaggactgagtgaccccttgaacccctcctccctgctacagtgggttaggcagtgagcggtacatcagcattactggcatgggagtctggcgcattgccaaggaggtgtaaaggggaaatgcaaaggaattgaagtggtgtgggcaaagtgaatgccagtgcttgttaataggtctagtggtatctgtattttcatgatcatgtgtgtcacctgtttgggggtggggca

SEQ ID NO: 12175 - DNA, 201 bp, Homo sapiens
gcaaaacaacaaatcaggaaaaaaaataatttttgcttcagtcatacctatttatatgttatgcaacaagtaatagatttttattaaaattcaattatcatgaatgggtataaaggagactttcattatgaaaaagctagtttaatatctgaatattttaggaagtttaagttcaaccagctaatgacaaaaatggccaac

SEQ ID NO: 12176 - DNA, 346 bp, Homo sapiens
  misc_feature 138: s=g or c
  misc_feature 141: n=a, g, c or t
  misc_feature 144: s=g or c
  misc_feature 146: m=a or c
  misc_feature 163: w=a or t
  misc_feature 165: k=g or t
caatccttttagaaaacctttatactaagcctcctcttcaaaattcacagtggcgattagcggactggagtctggtggcgattagcggactggagtctggggacatccgtggcaaagacaccagctcaactttagtgsttnccsamctttatttagaatgacwtkgggtgggtgtctggtgtgtgtgttttccctacgcacctcccatagctattaacaactgaggaaggccagtgcagaatatttttggagaacgattttttttttttaaataatatatcattcctatggggggaaagccttttttttctttttggctgagttattccctccctcccctcaatac

SEQ ID NO: 12177 - DNA, 280 bp, Homo sapiens
  misc_feature 258: m=a or c
ataagcccctctcagcgctctctctccatctctcccctctctttctctctcgctgctcccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcmcttcctcctcctcctcagtcca

SEQ ID NO: 12178 - DNA, 257 bp, Homo sapiens
  misc_feature 32: r=a or g
gacgccagggggcggggccagcggcgcgggcrggtgagaggccgcggcggcaggtccacctgggcttgcgaaggcacagattccccgtccacagctcacgaccagatgcaccagcaggagtccacatcgaggacgtcctccgggcactcccacgaccagtgaccaggagttaaactttgggatgtgcccgtgatgttggaccacaaggacttagaggccgaaatccaccccttgaaaaatgaagaaagaaaatcgca

SEQ ID NO: 12179 - DNA, 359 bp, Homo sapiens
gaattgctgtcaaatgcccagcgtgttcttggtggtgacacagccacattgtgtaaatacatttcttaagtcatttgtgtgtatagcagctggatttggggacaagcatttgggcacactcgctacaagattggttagtgattatggatgatgaagtctgtcggaaaattcagatcttgattgtccacctgggcttgcgaaggcacagattccccgtccacagctcaacgaaccagatgcaccagcaggagtccacatcgaggacgtcctccgggcactcccacgaccagtgaccaggagttaaactttgggatgtgcccgtgatgttggaccacaaggacttagaggccgaaatccac

SEQ ID NO: 12180 - DNA, 347 bp, Homo sapiens
gtgacttcggcctccggggcgctggcgggcggggcggggtctgtagttagcggcgagagtgacaggaggacaggggttgtttcggcagtgacgcctggggagtgacgcaattgcacccctgtgcagtgatgtcacggcaggtgcggccagcgttccgagtcgaggacagttggcgacactgaaaattcagcgtctccgggagtctctctctttgtagtctttgcccagggccttgccaggcaaagggtagcccgacgaccagcagcctccgctacttctgggcgctcgctagaaatacagattctcgggccccaccccgacctacttggtcggtatctgtgatctgt

SEQ ID NO: 12181 - DNA, 167 bp, Homo sapiens
  misc_feature 114: n=a, g, c or t
cgaattgttgattctgtttaaatgaccaatactttttgaaattgatgtacttagtttcaagattcatagattctgttatctatgtagacagaatggtcatgtatattttctatnagttgagtttttacatctttagaaatgtaaaattcagtatagtttgaaagcgg

SEQ ID NO: 12182 - DNA, 505 bp, Homo sapiens
agcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatt

SEQ ID NO: 12183 - DNA, 415 bp, Homo sapiens
agtaaatctctcgagagttctctccgcacgcgggctggagaagcgggtcctacgcacgctttgttgtcgcgctttgcctccgtccttccccctactcccgccttacctgacttccttttcggaggaagatccttgagcagccgacgttgggacaaaggatttggagaaacccagggctaaagtcacgtttttcctcctttaagacttacctcaacacttcactccatggcagttcccgagacccgccctaaccacactatttatatcaacaacctcaatgagaagatcaagaaggatgagctaaaaaagtccctgtacgccatcttctcccagtttggccagatcctggatatcctggtatcacggagctgaagatgaggggccaggcctttgtcatcttcaaggaggtcagcag

SEQ ID NO: 12184 - DNA, 343 bp, Homo sapiens
  misc_feature 88: s=g or c
  misc_feature 234: w=a or t
agtaaatctctcgagagttctctccgcacgcgggctggagaagcgggtcctacgcacgctttgttgtcgcgctttgcctccgtccttscccctactcccgccttacctgacttccttttcggaggaagatccttgagcagccgacgttgggacaaaggatttggagaaacccagggctaaagtcacgtttttcctcctttaagacttacctcaacacttcactccatggcagtwcccgagacccgccctaaccacactatttatatcaacaacctcaatgagaagatcaagaaggatggtgagttctcgggatagtccggagtccagactgtcccgcacgggc

SEQ ID NO: 12185 - DNA, 160 bp, Homo sapiens
actttgtttgcatttttattatccctgagtacatatggattccatgaaataaaattcatgtgtcacagcaggagtgaacatattcaagtatctcagtgcatataaccaaataactttccagaaaagctacaccagttacacttaacacccgcagtgtatg

SEQ ID NO: 12186 - DNA, 234 bp, Homo sapiens
actgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcagacctgaaagatgtctgaaaattccagtgacagtgattcatcttgtggttggactgtcatcagtcatgaggggtcagatatagaaatg

SEQ ID NO: 12187 - DNA, 226 bp, Homo sapiens
  misc_feature 17: w=a or t
  misc_feature 27: w=a or t
  misc_feature 87: m=a or c
aattttaatttagtcgwgcgtcatttwctgattctcatcattgggagatcttaaatcttagcaagcattagcaatattaaatgccamaattccattgaaactttcaagttggagcaattgtctgtgtttgaaaagatgaaataaaaataataatcaagggcaaagctttgagtgcccagaagggaaagctgtaccagttgctaacctgtcttgtttcaggagccac

SEQ ID NO: 12188 - DNA, 267 bp, Homo sapiens
  misc_feature 76: n=a, g, c or t
  misc_feature 81: k=g or t
agattttcagtaccaccaaattgttttggattttttttctttcctcttcacataccagggttattaaaagtgtgcntttckttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgt

SEQ ID NO: 12189 - DNA, 446 bp, Homo sapiens
agtgagctcggccggcaaccgagggacccgcgtccagatcttcagtgtctattggatttttccaagagaaagtttgtaaaattccttacactgtagatgtggatcagatacgatgattcagtagaagagcacatgtcaggggcagtggaggctggctgctgaaggatgaacggagaggaagaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctggggtctctgttacactaatttgaataaactctcccctttctttgcaacttcccagcaacaataatgattttct

SEQ ID NO: 12190 - DNA, 73 bp, Homo sapiens
cccattcctcaatttttaattccctaagttaatttgaaaattctcttcaatattcctcttaacgtatgacatt

SEQ ID NO: 12191 - DNA, 101 bp, Homo sapiens
attgtctttctaaaattctgaaacacttttgggcacatgggataagagattgtgaacttgtagaaatcattccatatcaatacataaagagcttttacact

SEQ ID NO: 12192 - DNA, 242 bp, Homo sapiens
  misc_feature 29: k=g or t
  misc_feature 86: n=a, g, c or t
acttccggcggcgcgggaggcgcccagckagccagagtggtggctggtcccgcgcgaaaattctgagctgtacacctctaggaaangaaacactagttcagaagaagcctgtaaactctcttacaaatacatttggttattcaccatgaggttagcaaagcctaaagcgggtatttctcggagctcaagccggaaaggcctatgagaacaagcaaacaggccggcagcggcagaagtggggc

SEQ ID NO: 12193 - DNA, 418 bp, Homo sapiens
acatccgggtaccgactccagccgcctagacgctggcactatggtcatggcggaggggacggcagtgctgaggcggaacaggccgggcaccaaggcgcaggatttctataattggcctgatgaatcctttgatgaaatggacagtacactagctgttcaacagtatattcaacagaacataagagcagattgctccaatattgacaaaattcttgaaccttatgcgagatgtactgaggtcctgctatatgccaagcaacctgctggccactccacaagctgggttgattaaagcaagatctctgctgtcgaggaactcacctcttgtaggtaaaatatactttaatcccttgaaattgatgcatgcaacaacaaacatactttatggaaaagatcctctatgaggactgactcttgg

SEQ ID NO: 12194 - DNA, 155 bp, Homo sapiens
  misc_feature 137: k=g or t
aaataatccttgtgtaatcattattttttaaacaacagacaattcaaatttgaaggacattttgcaaaattcttgactagtcttcctcacaactgtcaaggtcatgaaaaacaaggaacactaagaaacagtcacakactagagaaggctaagga

SEQ ID NO: 12195 - DNA, 403 bp, Homo sapiens
  misc_feature 389: n=a, g, c or t
tatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagagccaaaattttctggatacctctgtctcacatgccagcagctttgcaagactttttattgttgaaacagaaagcagagctggctaatcccaaggcagtgtgactcagctaaccaaaatgtctcctccaggctatgaaattggccgatttcaagaacacatctccttttcaaccccattccttatctgctccaacctggactcatttagatcgtgcttatttggattgcaaaagggagtcccancatcgctggtggta

SEQ ID NO: 12196 - DNA, 487 bp, Homo sapiens
gagagaaaggcttccggttatgcaggaaggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagg

SEQ ID NO: 12197 - DNA, 432 bp, Homo sapiens
  misc_feature 351: n=a, g, c or t
  misc_feature 425: w=a or t
gagagaaaggcttccggttatgcaggaaggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgctggcgggccggtggtgcatgcctgtaatcccagtactgtgggaggctgagatnggtggatcacctgaggtcgggagtttgagaccaagcctggtcaacatggtgaaactccatctctactaaaaatwcaaaaat

SEQ ID NO: 12198 - DNA, 222 bp, Homo sapiens
atcaagggtgaagcatggtggctagcggagccgcatcctgacaggaaatccagttatcaaaattgactcaagaagagagaacctaacagaacaataacaatggaagaaattgggaacattatcacaaagctatcatcctgccaaactccaggctcagatgtcacagagtctcgctgtgtcgcccaggctggagagcggtggcgtggtcttgactcactggaa

SEQ ID NO: 12199 - DNA, 268 bp, Homo sapiens
  misc_feature 187: s=g or c
aggcacctcacagaggagtctgggtacctcatttctgaagtgagactaggaagagaagatgaacaattccctggattatctggcctaccctgttatcgtctctaatcacaggcaaagcacaaccttcagaaagaaactggactttggccactacgtatctcacaagaatagaatacaaatagcgaasctactgttgataccaaacctccagtggcgcacacaaatcacattttaaaattgagcaaactacagggtgaacaaaagaaaa

SEQ ID NO: 12200 - DNA, 312 bp, Homo sapiens
  misc_feature 120: k=g or t
  misc_feature 135: w=a or t
  misc_feature 141: m=a or c
  misc_feature 148: n=a, g, c or t
  misc_feature 149: m=a or c
  misc_feature 150: w=a or t
  misc_feature 151: n=a, g, c or t
tgttatttcattaggatttagtaaaatttttttttctgattctaaacttattgtgaaaattgagctgtacagatattcttttgatttcaattgggaacatttggaagaacaacagtcttkacttgcctgacaatwtagagmcatatgnmwnagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccct

SEQ ID NO: 12201 - DNA, 325 bp, Homo sapiens
ctgaagaataatatcactattgactgaaacatataatgtccttagcgaatagcttgtcaggactaatataatcaaatacaaaattgatacaaggaatcatgaccctacatctcaaacaccactctgggcttctgccacccagaggaaagtaattaattaatttcagctggagaatgtcttcttgtctgtaattaacaatatgtgcacctaccacattataatcctccactgtgctgaggaagtacaaggtgattagtgaaggcaaattgcaaacacacctcttggttgcttcttcttccacctcaaactctctcatcctcccacc

SEQ ID NO: 12202 - DNA, 132 bp, Homo sapiens
tgtttgtgaaaagtgtgctcaacttttttacaagagtgatattaacttggatttatttttcaatataatttggagaccctttgttatccaaataaaattgatgagtttctgtgcctgtaaaaaaaaaaaaaa

SEQ ID NO: 12203 - DNA, 529 bp, Homo sapiens
  misc_feature 139: r=a or g
  misc_feature 184: n=a, g, c or t
  misc_feature 485: s=g or c
tagcagaactagtagtactagtagtactgtctctagctcttcatacagttctagctcaggtagtagtcgtacttcttctcggtcttcttctcctaaaaggaaaaagagacacagtaggagtagatctccaacaatcaargctagacgtagcaggagtagaagctattctcgcagaattaaaatngagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaasaaagggaacgtgaacaggataaaagaaaagagaaacaaaaaagg

SEQ ID NO: 12204 - DNA, 283 bp, Homo sapiens
  misc_feature 8: y=c or t
  misc_feature 14: y=c or t
  misc_feature 41: r=a or g
  misc_feature 48: k=g or t
tacttggygttttytggttttgtgaaacggccgtcccaaarctggctkgattcctagaagagtctgtgttgaaggcatctttcaagccctcgctctggttctcagggcagcattttccaggcgggtttgttttgcatttcttggagcctctccgagcagcaaccagacgggagatttttattttaagctgttcatgctgggactgacagcctgcagggtttccttgggcgcggccccaaaattgccttcaaaacaaacccgggacggttgaaagccttcgaac

SEQ ID NO: 12205 - DNA, 446 bp, Homo sapiens
  misc_feature 12: r=a or g
  misc_feature 193: r=a or g
  misc_feature 391: n=a, g, c or t
aaggatataagrttgcgtgggttctgcctaaagctgaattcccagcgctttggcttctctgagttggggttgtgtataggggtcttcgaacagttccggaaccagccagcagcctttaattcttgggcggaccacggccggttctgatatcttagggtgaagagagggaggtgtcggccagccaagagagaarattgcggatcttgggctcaggaagacgggagaaggggttcggggtcccggggtggaagaacggtcgtcgtggttgcgcttatagaagtaggagcaggtggtggatcttaggaaaacggttccccgttctccaagctgttctgaagacatttatgtttcttctcttgatctgatttctagctctgtgctataccgtggnctggaatagttcaatgttttcattttcattgagcgtaaaagtggagatgttaatt

SEQ ID NO: 12206 - DNA, 426 bp, Homo sapiens
  misc_feature 150: r=a or g
  misc_feature 300: k=g or t
  misc_feature 301: b=c or g or t
  misc_feature 345: r=a or g
  misc_feature 371: k=g or t
  misc_feature 393: v=a or c or g
attttgactccagtgtctcgtttgcagtcggcgctttaggggaactgtcttcctccgcagcgcgaggctgggtacagggtctattgtctgtggttgactccgtactttggtctgaggccttcgggagctttcccgaggcagttagcagargccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggcctkbtttcccccgagggtcaacgagaaagagatcggtgaggattgggracgtgggtgggcgcatgagggccgakgagaggcagggactccccggavgaggtttgggaggaagcgactccaagtctgagg

SEQ ID NO: 12207 - DNA, 510 bp, Homo sapiens
  misc_feature 363: n=a, g, c or t
gaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgagncaaatggcattaaaattggccctcagcatgctgctaccaatgcaacacatgcaggcaatcagggaggacagcaggctgggggcggctgctgttgagtctgtttttactgtctagctgcccaacggggcctactcacttattctttca

SEQ ID NO: 12208 - DNA, 422 bp, Homo sapiens
  misc_feature 74: w=a or t
  misc_feature 348: m=a or c
  misc_feature 359: r=a or g
aacgccacgggacagccaagctagaagcctgaggagccggagagggtgctggctgccgcgcggccgagtgtgtwttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtactttggtctaggaagccatatggttcgtctcgaagtatcgtaaggaaaattggtactaatttgtctctgattcagtgtccaagagttcagtttcagattaacagccatgcaacagaatggagtccagccamccaggagaggrtgcagtggcgtcttttgctgatgttggatgggtagccaaagaagaaggagagtgttcagcaag

SEQ ID NO: 12209 - DNA, 248 bp, Homo sapiens
tttccatagtattaagtatgtctttggcccacttgtagtttctcaagaaagcatgttgatacggacagcccctactctcatatatggtgtattgaccttaggcaagagatgtggtttctctgagctccagatatgtcatctataaaattggtgttaacaccgtttatctcatagggtgctaagaagattaaagtactgcccagagtaggcactcagtcaagttctctttcctctcctgatacctaccc

SEQ ID NO: 12210 - DNA, 199 bp, Homo sapiens
acattactgtgttctgagaagttataaatttgccatctccctctgcacaagttacctttgtgtgtctttcctgaagactatcttcccgtctcaaaatggacatgatggatccacggatgtacagcagagagccaggaggtccaaccgccgtagacaggaaggaattaaaattgtcctggaagacatctttactttatgg

SEQ ID NO: 12211 - DNA, 173 bp, Homo sapiens
  misc_feature 134: k=g or t
tctacaattttttaaatgtactgaaattattctttttgaatcctcctatttatttctgtgacttctttggtgacaaagttagaaaaaagtggaggtcagtagggagatatgaagggacgcaggtggaagcagtkagcctgggcgggtgatggagtgggcgatacgtggcacag

SEQ ID NO: 12212 - DNA, 433 bp, Homo sapiens
  misc_feature 400: w=a or t
  misc_feature 401: w=a or t
tccatggtttccacattatagcagaaaatttacttagtcttgtatcttcctctctcgcctgtatgcctggtaggatgttatttaaaatttgatttcttccctcctgtctgcttcttttagtagaatgttatttataattaaacacttttataagctacagagttatttttgacttgacattttgaattatgccacttggttcagttctagtatctgttttgtttttgtttttttcctaattgagtcaaggtctcactgcctaggctgcagtgcagtggcacaatctctgcttactgcaacctccgcctcccgggctcaagcagtcctcccacctcagtctcccaagtagctgggactacaggcgtgcaccaccacagtcagctaattttttttttttttwwaatggagtttcgctcttgttggccaggctgga

SEQ ID NO: 12213 - DNA, 346 bp, Homo sapiens
gttttaatttacttagagctgtattcaagttgtttgataccagacagaaagctgacagtctgttctttgtaaactgcctttccctgtttttctgttttgttttgtttctcaagtttcattttttactaagccccttctgacacctaggcagataaagataagagtagtgcgcagtacaaatgtcagctctgaagaggaggaagtaaatcttcaatgctagggcagatcttcactatccgtgatccagtcttaatttgagcatgagagcaaaatttagtcatctacacaagaagcaaaagcaaggaatagttgttgggtttttgttttttggttgttgttttttttt

SEQ ID NO: 12214 - DNA, 199 bp, Homo sapiens
  misc_feature 32: y=c or t
caaactgacctgggtaattaacctttctgatytactctagctacaagcccataattcaaagtatcttaagccaaaatttagtgtagagttggcaaataaatatcacatatgcagcccttcctccttcccatgctcgtggcagactacgctattttctgccatgtccagacacagctccttgatacagcactctaagcca

SEQ ID NO: 12215 - DNA, 283 bp, Homo sapiens
attcgagtagcggctcttccaagctcaaagaagcagaggccgctgttcgtttcctttaggtctttccactaaagtcggagtatcttcttccaaaatttcacgtcttggtggccgttccaaggagcgcgaggtcgggatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttg

SEQ ID NO: 12216 - DNA, 448 bp, Homo sapiens
  misc_feature 152: k=g or t
  misc_feature 153: n=a, g, c or t
  misc_feature 189: r=a or g
  misc_feature 199: w=a or t
  misc_feature 209: m=a or c
  misc_feature 220: r=a or g
  misc_feature 238: n=a, g, c or t
  misc_feature 288: m=a or c
  misc_feature 339: y=c or t
  misc_feature 355: m=a or c
  misc_feature 392: r=a or g
  misc_feature 406: s=g or c
  misc_feature 408: s=g or c
  misc_feature 413: w=a or t
  misc_feature 418: n=a, g, c or t
  misc_feature 424: w=a or t
  misc_feature 425: y=c or t
  misc_feature 426: y=c or t
  misc_feature 432: m=a or c
actgcgaggcaggcagtgatgctgcggccgcttcgcactgtggctcctgccgaccgccaggcgctgttacagtggatgcgaactaaccgtaagtatgcagcagcagccggaacccacagttcaccttggtgcattcctttatgatgaagacknattgattcattatatgagaaaggaaaaatgagcagraaactactgwatgatggtgmagctcacaccrgacagcaactttagtctnactctgtcacctggctggagtttagtgacacgatcttagctccctgcaamctctgcctcctgagttcaagtgattctcctacctcagcctcctgagtagcyggaattacaggtacamcaccaccacgcccagctaatttttgtatttttagcaragacagcgtttcgscsatgtwgggcntctaawyycttgamcttgtgatccacccgc

SEQ ID NO: 12217 - DNA, 170 bp, Homo sapiens
atccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgacc

SEQ ID NO: 12218 - DNA, 134 bp, Homo sapiens
ataatataacaaaatttctagtgtatacagtgtatcattcacaatgtccaggatgtagtccaaagttgttagacatatgaagaaacaggaaaatataactcatgctaaagaaaaaagatattcagtgaaaccag

SEQ ID NO: 12219 - DNA, 233 bp, Homo sapiens
  misc_feature 96: n=a, g, c or t
tcagaaaaattaggatgtgattttggttggttttaaattactgtaagttttagattctaaggttcaagatttttaaaatttgatttaaatgaaganatggatttttctctctgcccctccctgccattcatattttctgcataacactattaataatatcaacctccacagccccttattttattatttccaataattccaagttcatatagaactgataatgtagcaagccc

SEQ ID NO: 12220 - DNA, 358 bp, Homo sapiens
  misc_feature 4: w=a or t
  misc_feature 5: w=a or t
  misc_feature 6: w=a or t
  misc_feature 7: w=a or t
attwwwwtcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaaccttgctggcaagtcgggactgtgtggcagcggctatttttcttttcccacccagcacgttttcgggctggggacatagggttcagttgagatacggaggcttccttcgggatattgggttctctgaagtgcggatggactagggcagggctgagaccc

SEQ ID NO: 12221 - DNA, 445 bp, Homo sapiens
  misc_feature 4: w=a or t
  misc_feature 5: w=a or t
  misc_feature 6: w=a or t
  misc_feature 7: w=a or t
  misc_feature 205: y=c or t
  misc_feature 379: n=a, g, c or t
  misc_feature 380: n=a, g, c or t
  misc_feature 381: n=a, g, c or t
attwwwwtcctggtttgggggcaaggtctcatgggaaaggtcatgtctctcgaagaaaggttataaaccctgagatatgagggttgggcgagacatccgagcctgtttcgttccgtgttgggaccaggaataaccctgacttctgagctttcataaccccaggatcctccagaaaatttgcggcgcgctgagggaaaaccttgcygaagctgtacattggaatgcgtttacagtcattgtaatggaagcaaaatacatgaaggaaaaactgttatttgtatccctgcttattgcacctgacgactagttgcagatggttttgtttacctaagaaaacttgtgatataaatgaaaaaaacacctgttttcctagagtcannngttacaaatatgcttcgtctaagagctatttgtccattctcctggagagtgtttcaatttcgac

SEQ ID NO: 12222 - DNA, 193 bp, Homo sapiens
aagcattggatgtggccaatcggctagaagtgattcctaaaatttggaaagatagtaaagaatatggtcatactttccgcagtgacctgagagaagagatcctgatgctcatggcaagggacaagcacccaccagagcttcaggtggcatttgctgactgtgctgctgatatcaaatctgcgtatgaaagcca

SEQ ID NO: 12223 - DNA, 207 bp, Homo sapiens
aactaactacatgtcatcttagaacaggctgcttcatagtttatagtggaacagtttccatattctaaaaaattagaaaagcttttgataaaagagaactagaaaatttgtcagtaggctatattaaaagacatccttcttggactcttactgcaataattgctttggcttttgaatatactgcattcagaagctaaatcttccccg

SEQ ID NO: 12224 - DNA, 350 bp, Homo sapiens
  misc_feature 16: y=c or t
  misc_feature 291: k=g or t
  misc_feature 325: r=a or g
gtttccactctcgctytcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattctaggtcaaatctgagaaaaggggtkgggaacaggaaggttagaagaacattcacagggrgtttagcaacagcagaaaacatagt

SEQ ID NO: 12225 - DNA, 460 bp, Homo sapiens
  misc_feature 16: y=c or t
  misc_feature 153: r=a or g
gtttccactctcgctytcctttcgttgcctgatcgccgccatcatgggtcgcatgcatgctcccgggaagggcctgtcccagtcggctttaccctatcgacgcagcgtccccactgtaagtagcgcgctgggaccggggagaatccgggggargggggttggcatttgtctcgggtgaagcgacgccagggtgaggaacttgcgtgtatgaggagcgcggttttgcggaaggagagaccgctgttctgcggcgccattcctgggttctcatcctaaggctgctttctattccataacagtggttgaagttgacatctgacgacgtgaaggagcagatttacaaactggccaagaagggccttactccttcacagatcggtgagtgtttgtgtctaacatagcctatttcgcctgtcctcgtgtgacttgtaggatctagtaggtggtaaagttattttaa

SEQ ID NO: 12226 - DNA, 447 bp, Homo sapiens
  misc_feature 140: r=a or g
cttttttttcgttgcctgatcgccgccatcatgggtcgcatgcatgctcccgggaagggcctgtcccagtcggctttaccctatcgacgcagcgtccccactgtaagtagcgcgctgggaccggggagaatccgggggargggggttggcatttgtctcgggtgaagcgacgccagggtgaggaacttgcgtgtatgaggagcgcggttttgcggaaggagagaccgctgttctgcggcgccattcctgggttctcatcctaaggctgctttctattccataacagtggttgaagttgacatctgacgacgtgaaggagcagatttacaaactggccaagaagggccttactccttcacagatcggtgagtgtttgtgtctaacatagcctatttcgcctgtcctcgtgtgacttgtaggatctagtaggtggtaaagttattttaa

SEQ ID NO: 12227 - DNA, 280 bp, Homo sapiens
  misc_feature 185: s=g or c
  misc_feature 186: r=a or g
caattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtasrcaggactttttccttctttcatttttgtttttctctgtataaaggcccagcagtgaattatattgggtcaaaggatatagacgttttcatggcc

SEQ ID NO: 12228 - DNA, 185 bp, Homo sapiens
ctgctttatccatgagaaatagacttttaatgctaaaattttaatattgaaatctacgggtggggtatattttaggaaccccatatctgttctctgtgtctctgtgcgtgcattgctttttcattttggctcctagactggggctcagcttgagcttgcacgttgctgctgcctttaaaacaccg

SEQ ID NO: 12229 - DNA, 404 bp, Homo sapiens
  misc_feature 106: r=a or g
ccacctaaatgcagtgagattgatttcatccaaactgccgactggctaatcagtggcccagttttccagccatgtgatctggcatctggcatttaccactcatcarattaaattacacagcaccaataaattaccacctcatgactgggcaaaacctttttccttaaactccttcctggttaatacttgtgcaatgtttaatagtgccacagtttatctatacagggatgtcaacaggaatgtatcaaaattttaccacaaatggagatttatgtatatgcaaattatacatagacacacacatatatgtatagatatgaatatgtgtgaatgctttattctattgatgtgaattttccagatgcctaaagctaagtgctaatcaaaaatttttgttttgtttt

SEQ ID NO: 12230 - DNA, 435 bp, Homo sapiens
  misc_feature 354: r=a or g
attttggttttgattttggtttggtgtaaactgcaaaagtgtgtgtgtgccctttttacctgttctttgttttgtggtgtgcggtgtgagcgtggtgttttgtcttgaagaagcatgggtgagaaacaaataagcccaccctactaggaactatattgaaaattttcaagaaaggatttgagggagattacggtgttactatgacaccaggaaatcttagaactttgtgtgaaatagaccggccagcattagaggtaggttggccatcagaaagaagcttggacacggcccttgtttcaaaggtacggcacaaagtaacttgtaagccagggcacccagaccagtttctgtacrtagacacttagtcacagctggttttagacccttccccccaacagtagttaagagagacagaaagtcaaagagagaagaaaa

SEQ ID NO: 12231 - DNA, 415 bp, Homo sapiens
  misc_feature 60: y=c or t
  misc_feature 266: r=a or g
  misc_feature 324: n=a, g, c or t
  misc_feature 325: n=a, g, c or t
  misc_feature 331: m=a or c
  misc_feature 338: s=g or c
atctgcggtttggagccgttagcgggagaggcagagatattcagaggtcttttaggatgygctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgraagacaggatgaagtggacacagcatgtgaagacaattctttcaagaagtttggctgnnaaggamaacagasaatgtgctaaagaacatacagacacagagcagacaggccacctttgcaaccacatggaggtttgtctgatattgaag

SEQ ID NO: 12232 - DNA, 565 bp, Homo sapiens
  misc_feature 241: r=a or g
taacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaraaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactga

SEQ ID NO: 12233 - DNA, 429 bp, Homo sapiens
attaaacagaggtctattttggagtaacctacaaaatttttacaaatgtttagtaataaacacataagcattacagaaatattttagcagcctgctgtttcttacagtcactagagctagaaatttatcttcccatgcccttgcaggaatttttggtggaaaaaattataaatcttgctagaacaatctaaaaggcagtcttagctaagcgtggtggctcatgcctgtaatccgagcactttggaaggctgaggtgggaggatcacttgaggccaggagtttgagaccagcctggccaacatagccagaccccatgtctacagaaagaaaaaagaaagaaagaaaagaaatcctaatatcttttcatgaaaactaaaaaagttaaattcaacaaagaactacttaataagacatttttatagattagca

SEQ ID NO: 12234 - DNA, 475 bp, Homo sapiens
taatagctgtgtagtattcagtcatatgaatgaatagtatgcaattttagttctttattgatagttgttttcaacaaatatacaaatgtaaaatttttcctcaaattgggtcaagctatatatattgttctaaattagctctgtttctcgcaataataatagtgtgcaggtttgttacatgggtatattgcatgaggtttggggtacaattgatcccatcacccaggtagtaagcatagcacccagcatgtagttttgtttaagttttttgagacaaggtaggtctctgtcccccaggctggattgcagtgttgcgatcactggtcactgcagttttgacctcttgggctcggccgatcctcccggctcagcctccggggtagctgggactacagtggtgggccgccataccctgctatttttttgtgtttttttgtagagactgggtttcgccctgttgcccaggctggtcttg

SEQ ID NO: 12235 - DNA, 410 bp, Homo sapiens
  misc_feature 155: n=a, g, c or t
  misc_feature 158: y=c or t
aagccatttaaaaaagttagcaagattttttatcgacttcccaactgggcttccagccttgttgaatgaaatcatctatctctgattgggcgcaacgaactgcatttctttggacttctgaatccatgtttgtgctttctctggcccgtgaacanctyggcgattctgttagggatgggatgagtgggaggaagccctttgagaagggggagccggcctgtcatgcgcaggttttccactcatctgaggaatagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgctt

SEQ ID NO: 12236 - DNA, 737 bp, Homo sapiens
  misc_feature 98: n=a, g, c or t
  misc_feature 129: r=a or g
  misc_feature 412: y=c or t
  misc_feature 416: w=a or t
  misc_feature 649: k=g or t
  misc_feature 651: s=g or c
  misc_feature 715: r=a or g
  misc_feature 722: w=a or t
cagcttttgttttacagagaacgctagatattaagaattttgaaatggatcatttctacttgctgtgcattttaaccaataatctgatgaatataganaaaaatgatccaaaatatggatatgattggrtgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgttycttwagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatktsttaagcataaaaaaaatgctcagttttgcttgcattccttgagaatgtatttatctgaagatcraaacaawcaatccagatgtata

SEQ ID NO: 12237 - DNA, 204 bp, Homo sapiens
acatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcaga

SEQ ID NO: 12238 - DNA, 291 bp, Homo sapiens
gccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtc

SEQ ID NO: 12239 - DNA, 446 bp, Homo sapiens
  misc_feature 341: n=a, g, c or t
  misc_feature 342: r=a or g
  misc_feature 343: s=g or c
gccttctccttcttcactgaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagttgtgttgatgttcctttcagctggtcctatagtacccctcctcaggaatgtctccccagtgcaagnrsaaagactgaagagactgctatattgatggactctcaagccaactatgaagttgaaacaaagaaagtgatcacctgaagacacctcctctgctaagaaacaccc

SEQ ID NO: 12240 - DNA, 256 bp, Homo sapiens
attttccccccttgctcgggatggtgccacaggaggctgtgcgggccccgctccgcttcgaatggctggtcctatagtacccctcctcaggaatgtctccccagtgcaaggacaaagactgaagagactgctatattgatggactctcaagccaactatgaagttgaaacaaagaaagtgatcacctgaagacacctcctctgctaagaaacacccccaaattgtgcagcttctgccactagaactctcagaacaa

SEQ ID NO: 12241 - DNA, 157 bp, Homo sapiens
tctggcagaagaaatttctaggcagtaaagtattcaagatgtggcctggctacttctaaaagcctgtgctcatttgcataaacaaagaaatggcctaaaactggaacttatatttaaaacggaagcagagtataaaagtttggaaaatttgcagccc

SEQ ID NO: 12242 - DNA, 197 bp, Homo sapiens
aaacaaagaatgtgttaagggatgctcccccaccccacatcttaagtcagtgtgccaagtactgagatgattttagggacattttattttaaattaaatttacaatctaatggtaaattgattacctaattagtgcctttctctttcatcacttgttctggatgtttcaatcagtttagtggaaggaaaaataaatg

SEQ ID NO: 12243 - DNA, 270 bp, Homo sapiens
  misc_feature 188: r=a or g
  misc_feature 191: w=a or t
  misc_feature 196: k=g or t
  misc_feature 199: y=c or t
  misc_feature 216: w=a or t
  misc_feature 219: m=a or c
  misc_feature 223: k=g or t
  misc_feature 228: w=a or t
  misc_feature 230: r=a or g
  misc_feature 233: r=a or g
  misc_feature 236: n=a, g, c or t
  misc_feature 250: r=a or g
  misc_feature 257: k=g or t
  misc_feature 266: w=a or t
attcgaacattcttaggaggtttttgttaaggcatgacagatgatttaaacaaataaatagcatgcaacaaaatgtctttattgaaagaagtggaagttatcttaatgccacggttcaccatcaatttaaaagtaaaaaaaacaaaaaaaaaacaaaaaatttaaaaaaaaggtttgctaatctgatrgtwaattkgtycttaccaaaaaataaawttmcttkgtaawtrgcrgtncacatttttccacrgtataakggaaaatawtggg

SEQ ID NO: 12244 - DNA, 321 bp, Homo sapiens
taagtccacgattatcattttagaatccaggctatgcttgctgctctttttatccacattttaaattacaattgcattttttacttgttcagtgcacactttgatgcaccacaagtgcattaaattttgaatcgtgtgcaatatagaaatattttgagactcacaacattgaaacaaggtgacaccctagttgactttatcactaatgtgatttgaacattatttaaacaaatctagactgaacatgaaagaaaggagttttgggcagtgacatttttcacagaatgtatatctcaaaggtgaaagcagagtttttccagt

SEQ ID NO: 12245 - DNA, 197 bp, Homo sapiens
tatgtttcatatacactttatacacatagcctgaaggcaattttatacatttgaaataatttggtgcatgaaacaaatctttgactgcattgactgcaccccatcacatgaagtcagatgtggaattttccacttgtggggtcatgtcactgctcaaaaaatttcagattttggaacattttagatttcagcttttt

SEQ ID NO: 12246 - DNA, 369 bp, Homo sapiens
  misc_feature 290: s=g or c
aaacaaatcagagatggaataagagcggtaattgcagcaagaccgccttgattcttgcagtccagggagctgagcgcaccgcgcgcatccggcgaggacaggaggcgaccgcgggcgctgccaagggctgcgggactttggcttttcctcagtaaacaaatcttttgattactttgacactgtggaataaagaagcggggagaaggatcaggctcaccttcacccgcttcagggggattccagcttggatgtcagattcctgaaccgtctttgccatcggaggaggaaasgacatccacacacgcgcgcgcacactcgcacgctcagggccacactcacacgccgccctccacgatcacacagcaccag

SEQ ID NO: 12247 - DNA, 423 bp, Homo sapiens
ctgccacgattcttcctgtgctccataggaggacccattggacccccgggctggctgcagggcccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaa

SEQ ID NO: 12248 - DNA, 762 bp, Homo sapiens
gacaccaccccagccagcatggccggcaggagcgcaccgcgctgtctccctccagggatccgcaccgccctacaatcctgctttgtgctgagattgtagtcctgcaggcgtacaactaacaagctgggtgcagataagagactacagctccccgcatcccaagcaaaggtccctcctctacggagcccctccacgcgtccactgcggttccgccgtgccaaggggagcttggctgttcacgggcctcacctgctagcgagaagatagcttggccgggcggctgatctcaccttgtaattctgacactgtgtctcccgggcttgtcggcttcatgacttgtgcccaaagtttgatttctcgcagaccaggaggacccattggacccccgggctggctgcagggccacacctgggttagacctcgcacagggacgctgctgccactgtaataaagcgtgcctacacgcttctgaaactggtgtaggaacaacctcagttctgtgaaaggcggacgcagcaggacagaatctccgtggacatctgtctggaggagcaattttactgcgacattttaaagaaacaaatttaattgatttccaagggtgtccatcgcgcttccttcactgccttgatcatgtcggggtcaccacctgcgggggtttgtcctgcagaccctgactcaacgacggatgaataatgtacactgacacagatcttatgcttgtcagtcctgctgagcatccaggccacttacagactccaa

SEQ ID NO: 12249 - DNA, 230 bp, Homo sapiens
cagtgtcagagtaatgcatggtctctgatgttatgttatggggatcagtacttgctggttgccttttcaacatttttattaggggcttagaatagagaaagacacagaaagcacacttagtgcattgcagatggtgcaaagctgagaatgacggctaataggatgagcacagattcaaggtataaaaaagttcttagaaacatggatcgaaacaaagtgaagttaatatg

SEQ ID NO: 12250 - DNA, 278 bp, Homo sapiens
ggggaccgtagcggggacggaccgacctaccgaccattcttccgggtccagaaggtgatctccgcccgtgctcagaatccaggggcccggggctgtagattccttgacaaggatatcctagcggcgaaacaacaccgtactgggagtcagaacgtctgggttctagtcttgactgccattaactagcggtatgacattggagaagcttttttgacccttctggatttccgtttccttttctgtaaaatgaggagcttggaagatccggaaaatgaggc

SEQ ID NO: 12251 - DNA, 363 bp, Homo sapiens
  misc_feature 302: n=a, g, c or t
  misc_feature 303: n=a, g, c or t
  misc_feature 304: n=a, g, c or t
  misc_feature 317: w=a or t
ccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatctgtaatgtcttgagctctattatgaatgtgaagccttccccttatcnnncctgtaacttgawccatttctaattatgtagctctttgtcagggagtgttccctatcca

SEQ ID NO: 12252 - DNA, 203 bp, Homo sapiens
ttattttaaaactaggctaaggttttcccttcccttggcacttggctgttctctggcagcagggtgtgtaacggagcagtttaagatgttaatacaaggccaaacaacagcactgtgagggcagccatgtgaacgcgcaggagcaccttgtcacgtgactctctagttttaatggaatattggctgttttagataggaaatac

SEQ ID NO: 12253 - DNA, 180 bp, Homo sapiens
  misc_feature 153: r=a or g
gtaaggaggattcggcagagggaagaaacaacagccgccatcttgtttgtgtgctaggctgggggggagagagggcgagagagagcgggcgagagtgggcaagcaggacgccgggctgagtgctaactgcgggagccagagagtgcggagggragtcgggtcggagagaggcggcagggg

SEQ ID NO: 12254 - DNA, 214 bp, Homo sapiens
gttatttgactggagtgaggtctcatgtctgcttatgcggtggctcgctgctcagaacagggaggaagagggtaatctggaagagtttcctgacctactctgctgctgtgattaaacaaccaccaggaaattttgatgacactgttctcctgagctcctccctttcctcggggaagaaaagcattgaaactacaaaaataaagtgttatttggc

SEQ ID NO: 12255 - DNA, 652 bp, Homo sapiens
  misc_feature 590: w=a or t
atatgtttatacacagaattttctttatgattaatgttttaaaacttgcttaagccttcaaaagaaaacttttttttaaccttttaatgtaggtaaaaatccacattcttatgcctccttataatccctttaccaaaggtatattttactttccttatacaccttgcacataaactgtttcttcaatagttttacattcaggaggcccaattacttttaaattatacaacatttcttgcataaattcttttttataacttttttttctctttcatgactttcacagacaattctttgacatgcgttaactttctgacttattacaaacatttctttctttaaacaaccagttaatttatttcaggataagaatttaccatataacattctttttacataaatttcgcggccccccccaactttttttcccttttttttgaagatgataaccattcttttccaaagtggacttcctttatgtctgtggactagactgtctaaggccacaagattagaagttactataatatatgttacactgttaacttttagcacactttacttttgctgaaaaccttgtaatttgggawtaattatcctttgctattaataaaacttgtttagttcaaattaacttagaattggtatagat

SEQ ID NO: 12256 - DNA, 433 bp, Homo sapiens
  misc_feature 367: y=c or t
  misc_feature 385: y=c or t
  misc_feature 387: y=c or t
atatgtttatacacagaattttctttatgattaatgttttaaaacttgcttaagccttcaaaagaaaacttttttttaaccttttaatgtaggtaaaaatccacattcttatgcctccttataatccctttaccaaaggtatattttactttccttatacaccttgcacataaactgtttcttcaatagttttacattcaggaggcccaattacttttaaattatacaacatttcttgcataaattcttttttataacttttttttctctttcatgactttcacagacaattctttgacatgcgttaactttctgacttattacaaacatttctttctttaaacaaccagttaatttatttcaggayaagaatttaccatataayaytctttttatataaattccacccgcccccttttttttcctttttttt

SEQ ID NO: 12257 - DNA, 355 bp, Homo sapiens
  misc_feature 290: w=a or t
  misc_feature 291: k=g or t
  misc_feature 329: w=a or t
aaataataaaataaaaaacagagtgaggttctgactctttaaaaaaagagaaataatgtgcccacttcatcagcacatatactaaaattggaaccatatagagatgaacatggctgctatgcagaatacagtgcaaatttgtgaagcattccatatattttggaaaataaaaaagttgaagggagtgccctagtccccttttgtctttgatcttggacttcccaacctacagaactgtgagaagtaagtattgattctttataaattacccaatctaaggtattttgttwkggtacctactaaacaaaaagataaaactcttgtgattwtgatcttaagttggaaacataaaacc

SEQ ID NO: 12258 - DNA, 432 bp, Homo sapiens
  misc_feature 177: n=a, g, c or t
  misc_feature 178: k=g or t
  misc_feature 268: n=a, g, c or t
acacggagcaccctgggtccttcccagcgctgctgggcaggccccgtctccaggccccagctgttgaaactttgaagggcaacaaacaaccatccacactgccggaccctaggctgttcagggaggcagctcatttccaccccggccccaggacacccagcctgtgccccacaaggnkctctctaaatgggagggattgaggctacttttctgccaagccctattaagtagtaatgtggggaaacccactgtgtcagtgcaggaagcnctagacaaatgttttcaaataaatttcactgcccagcctgcacagatttccatttgaagtacttcccatccaccctgacacccaaaggggtttttttgttttgttttgtttttgagacagggtcttgctttgttgcccaggctggaagtgcagtgacgtggtca

SEQ ID NO: 12259 - DNA, 140 bp, Homo sapiens
attccacctgcaactcagagcctgcaacagctggctggcctttaatttcctgaattggaaacaaccctcgctcaaggaattcggccattatgaatctcgtgctgttgcccaggctggagtacaatggtgtgatctcagct

SEQ ID NO: 12260 - DNA, 221 bp, Homo sapiens
taagggggcggggaggccgccactagcaaacaacctcagcttcataaatccagcagaaaggtccggggtattgttgaaaaggtcggaaggaccaagattatgtccgccagcctaagtgggacgaacaaccaagttgtgcgatgcagctttaaaggggctggtgattgacagaatggtgtagtagtagatggggtggagccgctgggtggggtcgagactgg

SEQ ID NO: 12261 - DNA, 436 bp, Homo sapiens
ttggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagccgatgaattacatatgccatctctccctgaaatgatgtttggagacaacgttttaagaatccagcatgggtctggctttggaattgagttcaatgctacagatgcgttaagatgtgtaaacaactaccaaggaatgcttaaagtggcctgtgctgaagagtggcagaagcaggacggagggtgaacactccaagaggttattaaaccata

SEQ ID NO: 12262 - DNA, 221 bp, Homo sapiens
  misc_feature 130: s=g or c
atacagcatttgaccttggacctttccttctgggactttgaacctcgagagagaggcacgtggttaagtgaagtttggcttggatcttgcattctggtgatccactatgagaagcacatgccctgcgtascactgcctcttcagtcccaggacaaacaactcagagttaggatccaagcccagccaacctcagtccaaagcagagccacccagctaagccc

SEQ ID NO: 12263 - DNA, 235 bp, Homo sapiens
  misc_feature 170: w=a or t
tgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattawaggagggagctctcaattttatgtattctttctgcctttaattttcttgtttgtttgagcttagg

SEQ ID NO: 12264 - DNA, 394 bp, Homo sapiens
  misc_feature 299: n=a, g, c or t
  misc_feature 379: r=a or g
tagagacattattgtactggttgggaaacaactctatcctcttctttctgctccagagagagatattgtctctgtcctccaagtgtgtttgctacacagatgtccttgagatgatagtctagaacaaaggtctcagtgtcttttgagctgaagacatgcagaccttggagagacccatggagaattatctcccaataccacttcaaagggcttcttggaggagcagatgggttcatacctgtaacatgctctgtatagttgcctggcatgtgcctggcacttaatcagtgttagcactngtcattattactctcagcttttatcacttgtcagctagtaggaactcagaggcctcctgttctgggatttccccagttargtgactaagaaaatc

SEQ ID NO: 12265 - DNA, 126 bp, Homo sapiens
gtgctcgcttcggcagcacatatactaaaattggaacgatacagagaagattagcatggcccctgcgcaaggatgacacgcaaattcgtgaagcgttccatatttttaggcgttcggctttgacca

SEQ ID NO: 12266 - DNA, 261 bp, Homo sapiens
cattcaccaaacaactggcttaagcatacatccaaaggacattttcttagatccatttctggttttctttagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggag

SEQ ID NO: 12267 - DNA, 392 bp, Homo sapiens
  misc_feature 378: n=a, g, c or t
agcggcgggttgagggcggccagagccgacgctgaggaggggcagagagcgagcgatggctgctagcacgttgtcacctctcactctcacctcagcttcccaaagtgctggtattacatgcatgagccactgtacccggccatcttctactagttttatagtataagattttgtgtttaagtctttaatccagatgatcatgccactgtactatggcctgggcgacacagcaatgtttttaaaataaataaacaaaatgaagaggaccctctgaaggaagcagattgctcccacaggatatgggagacaccccaaatactagctgggtataagtaaacaagaagagggcctgggaggagagtctgacgagcaaagggnaggtagccaaggat

SEQ ID NO: 12268 - DNA, 181 bp, Homo sapiens
actcggtctcaggctcttctgtggcgcatctcacgtgaccgcgctgcgggagagggatgaaacaagagggcggctgaagccgatcctgagtggggccccagcaattcggaatgagccttttccctccacccgcttctgccgaccggggccctcccgcgcggcctcgcaggcctccccaccc

SEQ ID NO: 12269 - DNA, 445 bp, Homo sapiens
ttaaaaaaatttaaatgttgccttgattatcagtacttaattatgttgtgcactaaaaccttaaatatttattactgtgaataaaaacaaattatctttactgtatagctggtttctttaaatgttgatagaattgtggcattacatctaaatttgtaagtcttttcatatcaaacaagcaaggctttttatgctgctaagtctgtgggtgcagaaagaaacaccccttggaagggcaaagagaagccggctggttgcatcaccccgtgcagtttctcacacacatctctttttctgattctgtgttcagaagaggctgccggcataaaacctaaatgcaaggttgacggagaacagcttgtctggcacaacaatggtgcaggcccacgagccagcatcacagcttggccatgggacgttgagtatgcacaaactagaactctcc

SEQ ID NO: 12270 - DNA, 364 bp, Homo sapiens
attttgtagagaaacaagcggagttaaccgaagagggggtcgaggagagccggagtcggggacccaggagtttcctgtgtccagcgctgccggagccgcctgaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagcca

SEQ ID NO: 12271 - DNA, 329 bp, Homo sapiens
cttccttgctgactaagaggaacagaacacagagcagcctggcggtgtcctaccaacaagcctccgtttctccttcctgtaactagggctcctgaaactcactgatgaagtctccgtctgtcacccaggctggagtgtaatggagcaatctcggctcactgcaacctctgcctcccaggttcaagcgattctcttgcctcagcctcccgagtagctggaattataggtgcatgccaccacgctcggctaattttttgtatttttagtaaagacggagtttcaccatgttggtcaggatggtctccgtctcttgacctcgagatcagccc

SEQ ID NO: 12272 - DNA, 338 bp, Homo sapiens
  misc_feature 18: s=g or c
  misc_feature 57: s=g or c
  misc_feature 90: w=a or t
  misc_feature 95: w=a or t
  misc_feature 96: s=g or c
  misc_feature 103: n=a, g, c or t
  misc_feature 111: n=a, g, c or t
  misc_feature 117: n=a, g, c or t
  misc_feature 123: s=g or c
  misc_feature 124: r=a or g
  misc_feature 133: r=a or g
  misc_feature 134: r=a or g
atttttcaaaagaagttsagaaccagagaaaccgacctaaggggattctcccatttsgcccgtcctaccctaaggtcaccacctgctgcwtttcwsgagcgcntaccagtnaccaanaggaasrgaacacagrrcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaag

SEQ ID NO: 12273 - DNA, 444 bp, Homo sapiens
  misc_feature 30: r=a or g
  misc_feature 31: r=a or g
  misc_feature 40: r=a or g
  misc_feature 74: r=a or g
  misc_feature 90: n=a, g, c or t
  misc_feature 94: y=c or t
  misc_feature 166: s=g or c
atttttcaaaagaagttgagaaccagagarrccgacctarggggattctcccatttggcccgtcctaccctaargtcaccacctgctgcntttyctggagcgcttaccagtgaccaagaggaacagaacacagagcagcctggcagtgtccaagcaacaagcctcsgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatccccaaagtggaactcacccaaatgtctatcgtctgctgaatggataagagaatatgtgatgtctccatacggtggaatattattcagccatgaaagcaaaggaggtgctgttatgcggtataata

SEQ ID NO: 12274 - DNA, 312 bp, Homo sapiens
agtttgcatgggtggtccgccattggtctgttgggcaatctgggccgtaccagctttttaaagacgccgtgtagtataaacaaggagaagtggggcggccgggccatgatgtcagcgcggtgctgcagctcttgggggtgacgtcatctccgggaaggtggccggcccagggttgttagagccagcataaccacttgggccgctctcgccccgtcagaggtcagacccattgcacttcagtatctcaggcggcaccctgtccccgaggaggggaccatgacacaggttgtgagtcccggcccagcccctcca

SEQ ID NO: 12275 - DNA, 379 bp, Homo sapiens
  misc_feature 137: k=g or t
  misc_feature 140: y=c or t
  misc_feature 267: n=a, g, c or t
tatgattaaatgaatttaaaaacttgaaaatcagaaaacccctttagtttattgttaatgtgccatatgattttatgtatttatgacatattgtgagactcactgcacccaagaaaggattgtaagtactttttttkgtycatctttaagtggttatatagttggcattgtcagtaggtggtcagagccctttcatttgccagaaggcatactttgaagatgatttcaatgttggcaggtagttatccagttctgttaccttgtatncaagtcagttttcatttctttattattttcattaaatggaaacaaggatgtatcgcttcatttaaggcttctgtgaattaaagcctttgagtaaaacgtcattaatctgcac

SEQ ID NO: 12276 - DNA, 281 bp, Homo sapiens
cttagcagaatgactctggctgcctcgtggcagatgcacggcggcggtggaagagtctccagtctgcaggcctggagagtgggagcctgcacacatgatcctgaccgtcggaaacaaggcagatggagtcctggtgggaacagatggaaggtactcttcgatggcggccagtttcaggtccagtgagcatgagaatgcctatgagaatgtgcccgaggaggaaggcaaggtccgcagcaccccgatgtaaccttctctgtggctccaaccccaagactccc

SEQ ID NO: 12277 - DNA, 319 bp, Homo sapiens
cagtaattgggcttgaggccacttataaacccccctgggctcaggtggctaattagcaagtaagaaacaaggcagcacacttttactcttcttgtgctatggttttcatcagctgagaggtcacaaatccacttacatgcagactcagagcagcaggagaacattaattattaagaagtggaaaggcacagtctcctctcctcacaccatctccctaggcctccagctcttcatttccctcctcctctcctggtaatttgtcactgaagattctaggcccagaatcctgccttggttgaaaatggttgttattattaat

SEQ ID NO: 12278 - DNA, 350 bp, Homo sapiens
acattccctaagaggacgttctggactctcgggcagagctttgtgagagaaacaaggctggcttcaagtgatctgcaaccagagtaattgggatttgacaaggactgtgaaaggctgactctccctgttctctttcatgctggcaccgggcagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagaccc

SEQ ID NO: 12279 - DNA, 90 bp, Homo sapiens
attaaattctaaacaagggtatagtaaaggagtgtggccaagagggaaagaagaaatggtggatccagatagcttcaatgggtactgcaa

SEQ ID NO: 12280 - DNA, 216 bp, Homo sapiens
aatatttagacatgatggcaaactgggcggaagaagacctctcctcattcttattgttttattagggcaatttgtctcaataaaagcccaggaagaagacgaggatggtgagtttgccatttgctttgcttgtagtgtttattgcacggtttgggaaataggtggaatgttaagcctcaggaagagcgtgaagaggaggttctggtttgaagtttg

SEQ ID NO: 12281 - DNA, 305 bp, Homo sapiens
  misc_feature 122: y=c or t
  misc_feature 202: w=a or t
actctctgctgccccaggaatgggctgatttcctgagtacacattaatctgagctccctcagccctaggggtagggggattgggggcacaagatgggtggagccagatagggaagattcccycagtgttgtcctgctcccagtccaggtttgggacaatgccggcagcgtttccctgtgtctttcccccacaaagtctccawgtctttcctcaaatgatcgtcaaggtttgggagaaacaatctcttcctctgcccgggttgcgtggatctccagtggaaagatactgcatgacattgaaacagc

SEQ ID NO: 12282 - DNA, 440 bp, Homo sapiens
  misc_feature 209: n=a, g, c or t
catattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagangtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttg

SEQ ID NO: 12283 - DNA, 365 bp, Homo sapiens
cagatcctgcccagccaacatttctaagtcctttcctttgccctctgcttccttagaacttgccccagaccccaaatcagggaggaagatttgaacctgcctcctgtctccttgctggctggtcttgcaataaagtctttcttttctcaaaggcagtaccatggtattgcttccgtgtacattgagcagtgagcctgaggcaggaaaatagggtcaggaggcagggaacataaggccaattcacacttcggctgtaacaggaaatatccactccatagggcgtatgctgtaagtgacttgtaactttacttcatcctctgcatttacgtagagggtaagtgaagtaaacaatggaatcatctagg

SEQ ID NO: 12284 - DNA, 215 bp, Homo sapiens
aaattgaataataagttagcaattaagtatatttttggggatcaaattattttgtctccaaacatcttaacaatcttgtgattcagtgaacaaaattaaaaacttacagaatctgataaatgcatccaaactagcacacgtctgtgtgtatctcctacttaatggaaaaaataaaacaagatattggataacatctactgtaaggattcaccccc

SEQ ID NO: 12285 - DNA, 189 bp, Homo sapiens
ttctagaaacagttgtaagtacaataatatatcacgacttaggaccataaaactgaggctgagatcttaagagattttgcccaaggtcgcagaggaggtaggtagggacttcatgaaggacagcaaataccattctaaagagacgagttatataatctaaacaatttgggattttagatccctttagcc

SEQ ID NO: 12286 - DNA, 182 bp, Homo sapiens
taattttcacttttataaaataagtgtaggaatcctaaaattgattatttcatttgaaacacaaattcagtaggacgtaatgcatgaaataatttaatttttgacatgtacatcgaatcataatttaaaaacaaggtctgaccaggtgtagtgcctcatgcctgtaattccagcactttggg

SEQ ID NO: 12287 - DNA, 168 bp, Homo sapiens
aatttaggaaaagtagacaaatagctagagagaaagatgcaatttcagagggatgactctgggcgcgcaggattgaacagctagctgccttgagtagggcaaggccttttggcccaaatttaaagagaggaagttgataaagaaacacaagaatatccaacactgtgg

SEQ ID NO: 12288 - DNA, 530 bp, Homo sapiens
aaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaa

SEQ ID NO: 12289 - DNA, 454 bp, Homo sapiens
caagtttagctagataaccatgaccttccaaagactctgagcctgaggtctgttctctgtttaaaatggcatttagcaaataatatagacatatgaaagaccacaattaagtctttcttcttaaggtaataagaattactgaaagggatttggaaaggaaataagcttctccttatttaattcaacattttaaaattcaataagccacatcagctatgccaaacaccatctttgtacaacctcaaaccatctaatataccaacctgaaccactgatacttccaccataggaagagggacatttgttcttgcagaagttcttctgttctcaatcccttagttgcaggtaaacacactgaacttggattgggtgatgctaatccctaagcagaaagtatgttggtactctgttttcccacactgtaattattaagttcttacctggtagctgcaca

SEQ ID NO: 12290 - DNA, 282 bp, Homo sapiens
agagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaaggtggggccttcaggg

SEQ ID NO: 12291 - DNA, 136 bp, Homo sapiens
atcattgtgcgcctgccagatccgccggccgcggaccggggctgcctcggaaacacagaggggtcttctctcgccctgcatataattagcctgcacacaaagggagcagctgaatggaggttgtcactctctggaa

SEQ ID NO: 12292 - DNA, 506 bp, Homo sapiens
  misc_feature 399: r=a or g
actggaggacagtaactattgttaatagctaagaataaatgaggtggaggggagaaaaaggggagaatagacttcaagcttcaagtgaattcctagagatggcatctggatgggactgaaagcagttatgtccaggagaatacaatatagattatgcaagagaagattttataaagaaatttctggttaaaaaaaatttttacattaacaatcatcttgcaaatgtttagatataaactaacctcggaggtgagcagtggactaggatgaggtggcctctcaaattcctttagtcccatgaatccagcaaccacagacttacatgtataaaggtagttttctccctctgaatctcattaaagggagagacagactgactaaattaacaaaatatataaracagctcaagaatatgctgtacataaactggaattctataaagctcacaaagtaacatgtctaatatacaatatattagatgtttgaggatatgcacattaaactct

SEQ ID NO: 12293 - DNA, 235 bp, Homo sapiens
  misc_feature 41: n=a, g, c or t
ttgattttgctacagctttttggccaggagtaagtgaggantgctgtttcgaaagctggtcttgcatcttaagcagtacggtgtgggtcttaggggctggagtgtatcttgcaggaaacacagagtaggcaagaatgtgaggtggtgtaagactagtttgtctggttcaaaaagtaaaaaagaagactgaaaaaagtaggaaatctaacccaaagcaatcaatctttgagaagag

SEQ ID NO: 12294 - DNA, 471 bp, Homo sapiens
  misc_feature 56: n=a, g, c or t
  misc_feature 57: m=a or c
  misc_feature 58: y=c or t
  misc_feature 71: y=c or t
  misc_feature 208: r=a or g
  misc_feature 212: m=a or c
  misc_feature 214: s=g or c
  misc_feature 386: n=a, g, c or t
aaaagcgccaacccactgcggagacagaaggccgcctaccggggaggccggagggnmytaaggtcgcggaytcgggcgaacccaccctcgcgatctgtcaagtctgtccccaggggaggtccccctttcgggaggaagtttttaaggggatttctcaaaatcacccccgcgcttccttcactccttccttagagccggagcgcggcarggamcsatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagncgcggcgctcagaaggcctgccctcagagtgcagatccgtcacagactaaggagatggcaggcattgacagcttcactccatgaa

SEQ ID NO: 12295 - DNA, 139 bp, Homo sapiens
gccgcgctaagcactctccattgtaggtcagtgtatatcaaagaaacacaggcagttcttccacaagggcaggactttaatcagacatcaagtactgagttaatgatttaaaatgcccacattgcacagccttgttgtt

SEQ ID NO: 12296 - DNA, 238 bp, Homo sapiens
agatttcaaagaaagtaattcaaacacaggtggggtcccggcttacatctgttggatttggctgccatttggcagctgctcgttggacagggagaggagaggaggtgactcagagccgggagggcagcagattgcacaaaccatgctaatggccagcatggatggagggagcgtgtgagatgtgtggggcagcgtgctgcatctcagccaactccaggagccagttgatgtgatggac

SEQ ID NO: 12297 - DNA, 151 bp, Homo sapiens
atttttgtattatacacacatctgctacaaatgagctttttttggttcacaaacacagttcctccaccaattctaaaatcatttaatattgactttaataatggtacctttttctagaaaagcactaattgtttttttttttgtggggggg

SEQ ID NO: 12298 - DNA, 430 bp, Homo sapiens
  misc_feature 148: k=g or t
  misc_feature 149: k=g or t
  misc_feature 383: r=a or g
agcatgagctccaagcttcaaacgcattctcatgctcagacgagcactttatttttcatcaagttattttttgcattgttttggagtagcttcgaataataaacacatatttctgctttaaatttttaatagttaactacattcatgkkacaaccaaagcaagaaagcctcatgttttgggggaaagtttgatatcagcaatgtccagacaagataaggaaatgaagcttagtgatgttaaataacaaggaagttcatcaactagcaagcagcaaagccgcaagtcaacccaagactgctggactccacaacctgctaactttccactctgtcactctgctttagaaaaataaggggcttttttttaacccacatgcaatacraattctatttcagcaaaggaagaatttactacgagtttttaaatgtt

SEQ ID NO: 12299 - DNA, 187 bp, Homo sapiens
cttcttaaacacatctcttgaccggggtgttctcaccatgccctttctacaaacaaaaataaagaatgaagatgtggagacttggagacaggtggcacctcgtgcttcctccgaaggagagcccatttcctaacagctggatcaaaggcatgaaatgaacatggagtccctgaagatgaagagaagg

SEQ ID NO: 12300 - DNA, 515 bp, Homo sapiens
  misc_feature 374: s=g or c
  misc_feature 425: w=a or t
  misc_feature 426: m=a or c
  misc_feature 468: m=a or c
aaatggactgcagatattaagcagtgaagacagtgagttactcagctgatttgttccgtggagagtcaggctacctggtcatcctactcaatatccaggcctgcccgaacctcaagactgggtgggcactgttcagaggcccccagcccctgcccttctcctgcgagggccgagctcaccatcaggtccctggggcttggaactaagtagccacttcataaacacatggattttggggtgccccggcccccataaagagatcaaattatgtctcctgcattctgctgtaatgaaatgaatcataaaatatgttttagaagaaaattactataaaaagtttcaaaattgttatttaaaaaggaccccgccaacasgcatattgacccaagaatcttcgggatggactctgcttttgatcacatctwmacctgctcgaggatcacctgtggcacgtcgggctctgaatgmaaccccaggacaccccatttcatgcgtctgcattcttaacctcactg

SEQ ID NO: 12301 - DNA, 151 bp, Homo sapiens
  misc_feature 9: n=a, g, c or t
attacaatnattctcccgaaacaccacctcgatggacagaagatcggaattctttactgaatatgatttgccaacaagtagaggccattaagaaagaaatgcaggagttgaaactaaatagcagtaagtcagcatcccgtcatcgttggcc

SEQ ID NO: 12302 - DNA, 424 bp, Homo sapiens
  misc_feature 108: s=g or c
tcatatcttttaaaaaataactccagggataataatagttcatatcttttaaaaaataactcttgaatatacaacaaagtgtatatgttaagttgtataatagcgcasttaaagtaggtcataaaaaaacatgaaaattcaggttgggcgcagaggctcacacctgtaatcccagcactttgggagttgaggctggtggatcacctgaggtcaggaatttgagaccagcttggccaacaccgtgaaatcccatctctactgaaaatacagaaattagccagacatagtggcgcatgcacctgtaatcccagctactcgggaggctgaggcaggaggatggcttgaaccttggaggcagaggttgcagtgagccgagattgtgccatcgcactccagcctgggtgacagagcaagattctgtctc

SEQ ID NO: 12303 - DNA, 277 bp, Homo sapiens
  misc_feature 89: r=a or g
  misc_feature 100: s=g or c
  misc_feature 112: y=c or t
  misc_feature 134: y=c or t
  misc_feature 161: s=g or c
  misc_feature 198: s=g or c
  misc_feature 227: y=c or t
  misc_feature 228: y=c or t
  misc_feature 250: k=g or t
  misc_feature 252: y=c or t
  misc_feature 255: w=a or t
  misc_feature 256: m=a or c
agagcggcggcttctctcgcgaggacggacgccattatcgcatctccccgacaaacaccacgagaattccgcagcccacacggtgaccraaagccgagcsccactgtgagtygaactctttcgtgttgaccggycactctcctgtgctctggatgaatgtsggaacacgacctggccgatgtggttcagattgcagtsgaagacctgagccctgaccacccagttgyyttggagaatcatgtagtgacakaygawmgacgaacctgctttgaaacgc

SEQ ID NO: 12304 - DNA, 248 bp, Homo sapiens
  misc_feature 26: r=a or g
  misc_feature 48: r=a or g
  misc_feature 105: m=a or c
  misc_feature 146: n=a, g, c or t
  misc_feature 147: r=a or g
  misc_feature 148: r=a or g
  misc_feature 154: m=a or c
  misc_feature 157: m=a or c
  misc_feature 166: m=a or c
ctgttctacagctatggccgggccarctgcagctttccgccgcttgargcgccttgtccggagctgcggccttaggcttcgcttcctacggggcgcacggcgccmaattcccagatgcctacgggaaggagctgtttgacaaggcnrrcaaacmccmacttcttamacagcctggccctgttaggggtgccccattgcaaaaagccactctgggtaatctttccctgcgcctaaccctgaccaagccc

SEQ ID NO: 12305 - DNA, 257 bp, Homo sapiens
ctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcaggtggttggaggcaaagtaaagaagcccggtaaacgtggtcggaagccagccaaaattgacttgaaagcaaaacttgagaggagccggcagagtgcaagagaat

SEQ ID NO: 12306 - DNA, 292 bp, Homo sapiens
ctcggcggctctccagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctcagggagggagtagagacaaagaagagaatggaagaca

SEQ ID NO: 12307 - DNA, 433 bp, Homo sapiens
  misc_feature 71: k=g or t
  misc_feature 72: k=g or t
  misc_feature 89: s=g or c
  misc_feature 368: r=a or g
agttactacctcttggaatagggtcccgccccctgccttggcgcaaggcaggtgagaaacggtcgcgcagkkgtgaaattaacgccgascgggaggggcttaatccgcagcctggagatccagccccctcaacccgggaggtggtccctgcagttacgccaatgataacccccgccagaaaaatcttagtagccttccctttttgttttccgtgccccaactcggcggattgactcggccccttccggaaacacccgaatcaacttctagtcaaattattgttcacgccgcaatgacccacccctggcccgcgtctgtggaactgacccctggtgtacaggagagttcgctgctgaaagtggtcccaraggggtactagtttttaagctcccaactccccctcccccagcgtctggaggattccacaccctcg

SEQ ID NO: 12308 - DNA, 387 bp, Homo sapiens
  misc_feature 350: k=g or t
  misc_feature 358: n=a, g, c or t
ggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgtkagtgtgancccccatggcagatacgaccccgaacggc

SEQ ID NO: 12309 - DNA, 128 bp, Homo sapiens
  misc_feature 109: r=a or g
  misc_feature 122: s=g or c
gctgtgcagttgtactggctgccgtggtcggcgccggcttggcgttgagaggtaaacgaagctaaacaccgtcgcgcttgatcgtggacccggctttggctttgtacarggtacggtatcgsctcggg

SEQ ID NO: 12310 - DNA, 141 bp, Homo sapiens
  misc_feature 43: n=a, g, c or t
  misc_feature 87: m=a or c
atgattccagccatacagagctgcttttggttccttgtctgtntcattcctccactatgcttttgacagggtagtccctcaatctamtaaattcaaacacctagttttaaacttgagatcagcacaatttcttattctttt

SEQ ID NO: 12311 - DNA, 112 bp, Homo sapiens
catagttgcgtgtttcaacaatgtccatttatccttcaccctgaggcgtgttttgggggctgcaaacacctcccggtagaggctggacctgaggacccttcccactgtgccc

SEQ ID NO: 12312 - DNA, 285 bp, Homo sapiens
  misc_feature 279: r=a or g
  misc_feature 280: r=a or g
tagaaattaaacaaaaaataattgtacatatttatagatttatacaatatgatacatgtaaactttgtggagtaaccatgttagcagatttttaaaaattcctttttatgaaaggacccacccaagggcagctcattttcgagtatctcatttgacgggatttaatgactggttgggagctatgcccccctcagtatgcagggagattatagcgtccacaacactttgcccttcagaggtttcagagtgacttacaaacaccttgtatccctagggtgrraccaa

SEQ ID NO: 12313 - DNA, 362 bp, Homo sapiens
  misc_feature 12: s=g or c
  misc_feature 263: k=g or t
gatcgctgtgtsaatcgtgggtgggatggccgcgggccgcctctttctaagtcggcttcgagcacccttcagttccatggccaagagcccactcgagggcgtttcctcctccagaggcctgcacgcggggcgcgggccccgaaggctctccatcgaaggcaacattggctccactttgaggctctgatgaacattccagtgctggtgttggatgtcaatgatgatttttctgaggaagtaaccaaacaagaagacctcatgakagaggtaaacacctttgtaaagaatctgtaaccaataccatgatgttcaggctgtgatctgggctccctgactttctgaagctaaaaaaatgttgtgtc

SEQ ID NO: 12314 - DNA, 210 bp, Homo sapiens
atacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggaggtgggagtgcggcgcg

SEQ ID NO: 12315 - DNA, 161 bp, Homo sapiens
  misc_feature 57: s=g or c
  misc_feature 131: n=a, g, c or t
  misc_feature 135: s=g or c
  misc_feature 145: n=a, g, c or t
  misc_feature 149: r=a or g
  misc_feature 155: n=a, g, c or t
agcacacacaaacacacagcacacacatgcacacacagcacacacactcatgcgcasacatacatgaacacagctcacagcacacaaacacgcagcacacacgttgcacacgcaagcacccacctacacanactsatgcgcagancatrcatgancacagc

SEQ ID NO: 12316 - DNA, 281 bp, Homo sapiens
  misc_feature 140: k=g or t
aaatcttcatccttgactttcatgagtacatcagcccgaacaaggccacttcagagtttccacaaacgaaaactgtacagattgagccctactttttattggactccacagactttgccttcaaaagaaacagcattttkaaacactacacaaatgccttgcctgcaatcagcttcaacttggagtagctatgaacacaattcggagtcttacctattaagagaacatgtatcagagttagattcctctttccattctgttctatcattgccatcagatgt

SEQ ID NO: 12317 - DNA, 243 bp, Homo sapiens
ttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatcccc

SEQ ID NO: 12318 - DNA, 129 bp, Homo sapiens
caggttattgcaaaattttgtgtgaagtcctttcttgttgaataagtaactgagtaagaatgtcacttttttggttttagaaatatattgttcactcattgacactttaaaaaataatctattaagggg

SEQ ID NO: 12319 - DNA, 335 bp, Homo sapiens
aactcactccgaagtttacctgagtggagcggcggcatgcttgcagctcggcggcagcctgtgagagctgagggtcagttcttcgagtagatctcaagctgcgttttcctccttctccaaagcagggatgggaaggtggaggctactggttgaagagaagaaaggggttgggggaatgcaacacctgcaaacactagggattgtgggtcgagcggaagagctaatgagagccgagctcaggtatcccaagtcaaccagaatcaaatgcgcagtacgccacaaggcatttaatgcccacagtaacagggctgtttgacagtggcagaagaggacgg

SEQ ID NO: 12320 - DNA, 145 bp, Homo sapiens
caggtctgtgcacaccagcattgtgtggaagagaaactcgaaacactagtcctggcctgattactcgctcacttcctgagttttcagactggcctctctagcaccttaggtggccacgtgagctgggtgctaatccttaccacac

SEQ ID NO: 12321 - DNA, 361 bp, Homo sapiens
tgcatatgtagtcgtaattgagttctgacacggcctggatgtttctgtcctaaatagctgacattgcatcttcaagactgtcattccagttggcttttgagtggatacgtgcagtgagatcattgacactggaaacactagttcccattttaattacttaaaacaccacgatgaaaagaaatacctgtgatttgctttctcggagcaaaagtgacttgagcatctgaagattttggtttctgcagagggtgggaaaggttgaaccaatcccccatggataccaaggcctctgaggaaacactacattccagtaatgaagaggaagaccctttccgcggaatggaaccctatcttgtccgga

SEQ ID NO: 12322 - DNA, 246 bp, Homo sapiens
  misc_feature 12: m=a or c
  misc_feature 41: r=a or g
gagcaggtaggmaacagcaaatgcagaagctgctgcgcggragtcggccatggactggaaagaagttcttcgtcggcgcctagcgacgcccaacacctgtccaaacactgcctgctgaagatgaagtcttactacagaaattaagagaggaatcaagagctgtctttctacaaagaaaaagcagagaactgttagataatgaagaattacagaacttatggtttttgctggacaaacaccagacac

SEQ ID NO: 12323 - DNA, 550 bp, Homo sapiens
  misc_feature 49: s=g or c
  misc_feature 315: s=g or c
  misc_feature 471: w=a or t
  misc_feature 472: k=g or t
aaagaggctgcctctgcccaccagtcctgccgcccaggacccgcagcasagacgacgcctgcagcaaggagaccaggaaggggtgagacaaggaagaggatgtctgagctggagaaggccatggtggccctcatcgacgttttccaccaatattctggaagggagggagacaagcacaagctgaagaaatcctcttccttgactcaccccatttcaattatcctgatcccttctcatcccctgcttggcttctctgcatgtggtcatctgctgtggcttggtgtttaatgggttaaaaataagccactgcctgasatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgwkatggaggaaggaaaaagggagaagctgagccacagcttaactcctacagagtgaaatgaaaacgggctgaaaatacca

SEQ ID NO: 12324 - DNA, 314 bp, Homo sapiens
  misc_feature 198: s=g or c
aaagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactsaaggagctcatcaacaatgagctttcccatttcttagaggaaatcaaagagcaggaggttgtggacaaagtcatggaaacactggacaatgatggagacggcggaatgtgacttcc

SEQ ID NO: 12325 - DNA, 366 bp, Homo sapiens
  misc_feature 231: r=a or g
  misc_feature 240: y=c or t
  misc_feature 295: y=c or t
  misc_feature 361: n=a, g, c or t
gaaaaaataatgcaaaaattgggatattacagaatcaccataaagatgatcaacaagtaataagtcttttcatggagttcatttttcttttaaattcatgatttggccacaaaaatatatatataagtgtctgatatatgataacagcccagtttctcggccactcatttgcattatcttaaatcacaaataattacttaatttgctggagtgtgtgctttgcaacttttrtaccagagyaaaatttgtatttaaaacaaaaaataagaatgcccatcactaggagaaacactcytcacagaaaacacacacacacacacacacacacaatttaaaaactgagtaaatttaaatgtatganagtac

SEQ ID NO: 12326 - DNA, 377 bp, Homo sapiens
  misc_feature 229: y=c or t
  misc_feature 232: w=a or t
  misc_feature 237: s=g or c
ctataaatcaggttgccaccactcccagatttagttgcattcatttgctggaagagctcacagcacgcagggaaacacttacatttgccgttgtattttagcggacattgcacaaagttcagaaataaatgtggggcccggcatgcggggaggggtgcactaccttccaggaagtgttatccagaagctctctgaacccagtccttttgggttttgatggagacctcaytcwatagscatgatgggttaaaccataggctattggtgatcaactccacctgaggctctccaccctccctggaaattggggttgaggctttgccattctcagtctgactaaaagaatttacccaaacggaattttaaaacagatgagc

SEQ ID NO: 12327 - DNA, 351 bp, Homo sapiens
agctctggatcggcggcgcggcgcgaactttgtaaacacttcgccactgcaggggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggactgggaggtgctggtcctagggaagctcaagtgggacctggctgctgtgattgcacatgatttcctggccttcattctgcaccggctctctctgccccgtgaccgacaggccttggtcaaaaagcatg

SEQ ID NO: 12328 - DNA, 252 bp, Homo sapiens
caattaataaaactctgactccagggagccagttctagctggggaaataggaacaggctgtttaaccaacaacaagtagtcctgttatacacagacacacacacacacacacacaatcaaacagcctgtctcaccctccccaccagacctgtgcagagacacagacactcaggggcaagtgggattaaagttttaaggcagttatattaagaagctgaggacatctaaacactttttcaaaaaccagtcgag

SEQ ID NO: 12329 - DNA, 176 bp, Homo sapiens
ccgaaaactattgaattgcactttaaatggatgaattgtgtggtatgcaaattatatcccaatgaaaatgctgaaaaaataattggaagggggaaaagtaaagacagtaatatgatgcctttgcttatgaaagtgaacctcaaactagacagtagctaacaactgaaataacagga

SEQ ID NO: 12330 - DNA, 358 bp, Homo sapiens
  misc_feature 62: r=a or g
  misc_feature 63: m=a or c
  misc_feature 100: s=g or c
aggactacgcgtgtccttgggcggagaagggaggtgactccggcggaagaggacaaggcagrmtgcaggcccttcgggtgtcccaggcgctgatccgctscttcagctccaccgcccggaaccgctttcagaaccgagtgcgcgagaaacagaagctcttccaggaggacaatgacatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcc

SEQ ID NO: 12331 - DNA, 158 bp, Homo sapiens
  misc_feature 122: n=a, g, c or t
agagcctacgtcagaggctggcgcaaacagaagtgcagcggtggcggcggctggttgcgggccggcggcgggctggcggagatggaggatcttgttcaagatggggtggcttcaccagctanccctgggaccgggaaatctaagctggaaacattgcc

SEQ ID NO: 12332 - DNA, 294 bp, Homo sapiens
taagacatggtttccctctttggggagcttccctgcagacaggaattgcagatggaagccttgtgctcacaggttttacccttatcttgttgaggatggctctcccagctggagtgggaagcgcttcactgcttgagacttttgtattggaaacagaattgacacctgggtaatgaataatacatgggataggaagatgtttcttagccataggatttaaccgatctgttttccacagctgtttttgtttgaaatgcccttaaaagttttagtaactttagaaaggaagagttt

SEQ ID NO: 12333 - DNA, 364 bp, Homo sapiens
  misc_feature 351: w=a or t
aagcacccttcagcagttccacacactcgcttctggaacgtctgaggttatcaataagctcctagtccagacgccatgggtcatttcacagaggaggacaaggctactatcacaagcctgtggggcaaggtgaatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagcctcttgcccatgattcagagctttcaaggataggctttattctgcaagcaatcaaataataaawctattctgctgag

SEQ ID NO: 12334 - DNA, 276 bp, Homo sapiens
ataatagctaccaatgtctaagagatgtagatttttaaattttgatattgctcttttttgtgctgtctagaaatgggtaaacagagagatatcaaattttgactacctcattcaaataaatacaatggcaggacgaacctataatgaccttgcacagtatcctgtgtttccctggattttacaagattatacttcggaagagttggaccttaataaccctgctgtatttcgagatctttccaaaccaattggggtagttaatgaaaaaaacgccaa

SEQ ID NO: 12335 - DNA, 271 bp, Homo sapiens
  misc_feature 241: s=g or c
agcgctcgctcaccctcctctacggccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtstctctgtctctctctcaccctcttcctcgc

SEQ ID NO: 12336 - DNA, 476 bp, Homo sapiens
  misc_feature 421: y=c or t
gcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcagyttagaacagctgttgtccagctttagccatcaagagagaaaacgactcccatagc

SEQ ID NO: 12337 - DNA, 534 bp, Homo sapiens
  misc_feature 422: m=a or c
  misc_feature 430: m=a or c
gcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaamctttagamcagctgttgtccagctttagccatcaagagagaaataaattaaaccaccattgccagactacaagccctggtgaagtcagggtgtgggagtggtggcattgaga

SEQ ID NO: 12338 - DNA, 292 bp, Homo sapiens
aacgcttggaggagagggcggggtgtcgtttcctttcgctgatgcaagagcctagtgcggtggtgggagaggtatcggcaggggcagcgctgccgccggggcctggggctgacccgtctgacttcccgtccgtgccgagcccactcgagccgcagccatgtctggggacgagatgatttttgatcctactatgagcaagaagaaaaagaagaagaagaagccttttatgttagatgaggaaggggatacccaaacagaggaaacccagccttcagaaacaaaagaagtggag

SEQ ID NO: 12339 - DNA, 237 bp, Homo sapiens
  misc_feature 33: k=g or t
cttaggtatgtgagcaagcagcttgagtatgaktggatgctgcaaacagatccatagggcaatgtggctaggccattttgggggcactcttcctccaagcatgtttcgttccatcgtctgaatcctgcaagaaggtaacttcagcctcctgccagcatccttgggaaagagattaacatctcagcatccaatgggactgtttacctaataaccctgactttctcagtacggtttctc

SEQ ID NO: 12340 - DNA, 228 bp, Homo sapiens
  misc_feature 12: s=g or c
  misc_feature 24: r=a or g
gtgacgccgggscagggccggaargagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagagg

SEQ ID NO: 12341 - DNA, 335 bp, Homo sapiens
  misc_feature 229: y=c or t
  misc_feature 230: y=c or t
  misc_feature 231: n=a, g, c or t
ttcctctttcctgagactggatctgttcaaacagcaaacgcccacagatggcccagaggtggtggtagtcagggtgtgtgggtgtttttagggttctttagtgttgtttctttcaccccaggggtggtggtcccagccagtttggtgctgacggtgagaggaaattagaatctgtttgcaaattgtccaacccaccccctcaacatgaggggcttccattttctgtgtyyntgtaagggaactgtttccttcatgccgccatgttcctgatattagttctgatttctttttaacaaatgttatcatgattaagaaaatttccagcactttaatgg

SEQ ID NO: 12342 - DNA, 261 bp, Homo sapiens
gttttcaaaccagttgctagttaaaggagcagcggatcgcgcatccgtaagaatcagctctaaccaaacagcaaacgcgttggccagagggtgacttattcccccatagcaacccctggcaaggcttatttgacaaggaagttcctgcgctgcctgtcctctgagcatccagaggccccttttgagacttcggcagcattaaagtaaatccagcaacggggaggattcgcgtggacttgcttgtggagacaggaacctcag

SEQ ID NO: 12343 - DNA, 258 bp, Homo sapiens
gttcgggttcgccattttgctaggcagcggcagtggcggcggcagcggcggctggagcctctgattgggtttcggagtccggtactggagccaatcagcgcgggcagcgaaccgggggagcgaggcacggagtgtacctcacagccttctaggatctccagagtggacaggaatctcacttggagggaccatggagcagtatacagcaaacagcaatagttcgacagagcagattgttgtccaggcaggacagatcca

SEQ ID NO: 12344 - DNA, 168 bp, Homo sapiens
  misc_feature 106: n=a, g, c or t
attcggtggtcctggcagttagctgagcacgccctctgagccgctcggtggacaccaggcactctagtaggcctggcctacccagaaacagcaggagagagaaganacaggccagctgtgagaagccaaggacaccgagtcagtcatggcacctaaggcggcaaaggg

SEQ ID NO: 12345 - DNA, 903 bp, Homo sapiens
  misc_feature 850: k=g or t
agcgatcagctgacattcctaactgaaggctgcaatgtgttgcttattcattttgtaccgtgggagctgcggggactagcagagagctaaactatgcatttcaaacagcagtgcttgtgcagaaagaggggtgagagagaggcagccggcgaggaaagagcacagctggactttctccttgtttttatccatttctgcaggatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttctkcaagcggaaaataatgatcaagcggcacgaggtggagcagcagaacattcggg

SEQ ID NO: 12346 - DNA, 372 bp, Homo sapiens
  misc_feature 12: n=a, g, c or t
agagcaaggcgnaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagcgtgaggccattgagaatgccactaccaatgcagaagtccttcgtaccatggagcttgctgcccaaagcatgaagaaggcctaccaggacatggacattgacaaggtagatgaactgatgactgacatcacg

SEQ ID NO: 12347 - DNA, 288 bp, Homo sapiens
  misc_feature 228: r=a or g
  misc_feature 238: k=g or t
tactgagtgtggcttccaagaaatgttgcaattcaaaatgcactaagtctgtgatttattggagatttggagattctaaataatatttttaaaaaacttccatgcaacttctggtttaatgtttggcaactccacatgataaaaaaataaaaacagcccaaccgagtttcggaattaagtattcttctagtaagtgattcaaacttgtaatatttgccacaggactgrcttatttatktactagctagaagctcttaagttcacttgtttatcagggcatatacagaa

SEQ ID NO: 12348 - DNA, 438 bp, Homo sapiens
  misc_feature 383: n=a, g, c or t
  misc_feature 421: s=g or c
  misc_feature 423: n=a, g, c or t
  misc_feature 430: r=a or g
aatcgaaaaaaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctggctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccancctgtcccgctactgcttacacaggccgggttccaccsanaggggargctgctcc

SEQ ID NO: 12349 - DNA, 477 bp, Homo sapiens
tgtgtatgtgtgaaaatcaggaagagccagcggggagtgtgtgttgccatcgcgtctccgcctgcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctggtaaaggcagcgggctccatcttgatccttacacaaaatgacttcacgaatcccttgcttaatttctgctctacgaattccaacatcattacaatctccagcaccccccggggttttaccatgttggtcaggctggtcttgaactcctgacctcgtgatccgcccgcctcagcctcccaaactgttgggattacagg

SEQ ID NO: 12350 - DNA, 127 bp, Homo sapiens
acagctgcgcgtctgcgggaataggtgcagcgggcccttggcgggggactctgagggaggagctggggacggcgaccctaggagagttctttggggtgactttgtataaagaaacagcctctgacct

SEQ ID NO: 12351 - DNA, 276 bp, Homo sapiens
gcggataaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggaga

SEQ ID NO: 12352 - DNA, 198 bp, Homo sapiens
  misc_feature 37: n=a, g, c or t
  misc_feature 106: n=a, g, c or t
aaataaacagcggacggaggggccggcggtggcggancggagcaagcaggggttcggcggcattacctgtacccattcaccggcggctaccggcggcggcgcgcangtgtcaggcggactttgaaaaagccaagccccgaatggatcagtatttcaaccagatggaaaaaatcattaaagaaaagaagacgtcatccc

SEQ ID NO: 12353 - DNA, 236 bp, Homo sapiens
  misc_feature 39: n=a, g, c or t
  misc_feature 40: w=a or t
cgaccaccgttgacctcgccatggccccacgactcatcnwgctctgcctggttcttcaccttctggcctccttgtctttacgtatatcgacagcatagccggcccacctttgagtatgaccgggcccgggccaaacagcggggacgtggaaccagactgctgtgctgtgccagtggagacttttggaactgaggacagctgaatgaggggtagagtggcgctagggttcaccagca

SEQ ID NO: 12354 - DNA, 442 bp, Homo sapiens
  misc_feature 155: r=a or g
agacttcctccttcacttgcctggacgctgcgccacatcccaccggcccttacactgtggtgtccagcagcatccggcttcatggggggacttgaaccctgcagcaggctcctgctcctgcctctcctgctggctattgcagttgctctacggtragcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccacc

SEQ ID NO: 12355 - DNA, 150 bp, Homo sapiens
taaaaaatacattttgtggtgattctatatacagtatcaaatagttcagttttccaaactagatcatccattttctaaatggtacgctgttctttttttaaatggagatacagttagccagcaataaaatgtcttaactgttctccattt

SEQ ID NO: 12356 - DNA, 90 bp, Homo sapiens
cctttcggccgctaccgccaccgccaccgccaccgccgccgagtgctgtctctatggcgaggaggaggaggaggagcgcgagtcagcgac

SEQ ID NO: 12357 - DNA, 361 bp, Homo sapiens
  misc_feature 330: m=a or c
aaccatcccccctatacacacacacacacacacacacacaccctgaaaggctttccttgtcttaagcctctgtgtatgaaacactctggaacccaccggcctaggtgttagaacagcaccgaagttgccagggccaggggtccagccatcctgacctctgctagccaccctgcaagggccgatgttcccacgcaggaggccccagggaggtggtactgagcaaccggccacacccaaggaaacagctcagagctcaacttcctcctgaattaggccacacccgaggcctcccgggtctcatccacgcctctgggtccatcactaaacagmaggcacaatcccactaactcttactccaacc

SEQ ID NO: 12358 - DNA, 143 bp, Homo sapiens
  misc_feature 12: s=g or c
  misc_feature 117: s=g or c
atttgtgttgastaggtacgtctacttagccatggcacgaacaaagcaaacagctcgcaagtccaccggcggcaaggcgccgcgcaagcagctggccaccaaggcggctcgcaagasgctccggccaccggtggcgtcaaaaa

SEQ ID NO: 12359 - DNA, 404 bp, Homo sapiens
  misc_feature 18: y=c or t
  misc_feature 153: y=c or t
  misc_feature 234: s=g or c
  misc_feature 403: r=a or g
acggtaggggagcagagyaactcgccgctgccggcctgacctcgctcccagccctgctgcccagattctaggctccaagctcaggacctcaggatgggagatgaggagaagcggaacagggccatcacggcccgcaggcagcacctgaagagygtgatgctgcagatagcggccacggagctggagaaggaggagagccgccgtgaggcagagaagcagaactacctggcggasactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcrg

SEQ ID NO: 12360 - DNA, 389 bp, Homo sapiens
  misc_feature 138: y=c or t
  misc_feature 219: s=g or c
  misc_feature 388: r=a or g
actttctcctcttacttctcaccctggggaattccaagacattgtccttgaaggaggctccaagctcaggacctcaggatgggagatgaggagaagcggaacagggccatcacggcccgcaggcagcacctgaagagygtgatgctgcagatagcggccacggagctggagaaggaggagagccgccgtgaggcagagaagcagaactacctggcggasactgcccgccgctgcatatcccgggctccatgtctgaagtgcaggagctctgcaaacagctgcacgccaagatcgatgcggctgaagaggagaagtacgacatggaggtgagggtgcagaagaccagcaaggagctggaggacatgaaccagaagctatttgatctgcrg

SEQ ID NO: 12361 - DNA, 277 bp, Homo sapiens
aaaggaacatggctctgaatcatgcctgtctgtctccccaggtctgtgcttaaaaccacgaagttcaagatggaaactgaagggaagagtgtcaaggggatgggagagaggacttgtccatgactttggcagcataaggaaaaaatacccagggacaagtggcgactttggaaactccattcctctgcaaaatgacatcacgaggagagtggtggggcctgcggatgaaaagatctggcttctcctcccaactctgctatgaggtcagctatggggc

SEQ ID NO: 12362 - DNA, 216 bp, Homo sapiens
aactttttcctctctccaattttgcaacgacgggcgcggaggaggaggttcccggaagccacgcgcagatgatgctggcagataaacagctgtccagaggtgcagggcccggacatgacaaacaggatgcaggaccatgtcagagctggaggacgagaggaagcagcgctcgatggcagtggccgcccggaagaagctggagatggacctgaagga

SEQ ID NO: 12363 - DNA, 96 bp, Homo sapiens
aactttttcctctctccaattttgcaacgacgggcgcggaggaggaggttcccggaagccacgcgcactggagcagcggcgaccgcagctggaggc

SEQ ID NO: 12364 - DNA, 150 bp, Homo sapiens
  misc_feature 110: s=g or c
  misc_feature 116: n=a, g, c or t
  misc_feature 117: r=a or g
  misc_feature 125: r=a or g
  misc_feature 127: w=a or t
  misc_feature 128: m=a or c
  misc_feature 129: n=a, g, c or t
  misc_feature 145: m=a or c
agggtcacagagtctggcggagtggaaacagcttggccccggcaggagactagaagggctggaatctgttttaggactgggattggagtataacgggggaacggttaagsagctgnrgaggaggrcwmnagggaatggagagaamtgagg

SEQ ID NO: 12365 - DNA, 436 bp, Homo sapiens
  misc_feature 295: n=a, g, c or t
taaaatgttcatgagggactgaatactgaaaactgtgaaatgtactaaataaaatgtacatctgaagatgattattgtgaaattttagtatgcactttgtgtaggaaaaaatggaatggtcttttaaacagcttttggggggtactttggaagtgtctaataaggtgtcacaatttttggtagtaggtatttcgtgagaagttcaacaccaaaactggaacatagttctccttcaagtgttggcgacagcggggcttcctgattctggaatataactttgtgtaaattaacagcnacctatagaagagtccatctgctgtgaaggagagacagagaactctgggttccgtcgtcctgtccacgtgctgtaccaagtgctggtgccagcctgttactgttctcactgaaaagtctggctaatgctcttgtgtagtca

SEQ ID NO: 12366 - DNA, 236 bp, Homo sapiens
  misc_feature 135: r=a or g
  misc_feature 140: k=g or t
  misc_feature 141: n=a, g, c or t
  misc_feature 149: y=c or t
  misc_feature 153: r=a or g
  misc_feature 183: m=a or c
agagagcctcggctaggtgtggaaacaggaagagaactagaactggaagtaaagcattgaagatgtgactgaattgctgcaatctcatgatcaaatttgaatggatgaggagttgctttttagggatagccaaaraaagknggtttctycgaratggaatctactggttgctccttgagggcmggacagttcttatggctttatccgttgcttaagcacagagaggtctgcgaggt

SEQ ID NO: 12367 - DNA, 454 bp, Homo sapiens
  misc_feature 129: n=a, g, c or t
  misc_feature 435: n=a, g, c or t
  misc_feature 436: n=a, g, c or t
agagagcctcggctaggtgtggaaacaggaagagaactagaactggaagtaaagcattgaagatgtgactgaattgctgcaatctcatgatcaaatttgaatggatgaggagttgctttttagggatgnagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataatccactggctgggtgtggtggctcacacctgcaatcccagtactttaggaggccgagactggtagatcatttgaggtcaggagttcaagaccagccttgccaacatggtgaaacccacctctaccaaattagccaggtgtggtgcacacctgtagtnncagctacttgggaagctg

SEQ ID NO: 12368 - DNA, 338 bp, Homo sapiens
gagtttctggagggctgaacacgtggaggcaaacaggaaggtgaagaagaacttatcctatcaggacggaaggtcctgtgctcgggatcttccagacgtcgcgactctaaattgccccctctgaggtcaaggaacacaagatggttttggaaatgctgaacccgatacattataacatcccctgagcacactcattgggtcaagggttggggatacacacggcagaattcggaaacagggtatagatcaacaaatacaagcgcagagccgaagtggttcgggagatcgagaatctaagacaggaaagggcctcagaaggctttaacttgagactcact

SEQ ID NO: 12369 - DNA, 64 bp, Homo sapiens
tgataataattaaacaggacgataaacataaattgggaacgtcccaggcaaactagaatgaatg

SEQ ID NO: 12370 - DNA, 429 bp, Homo sapiens
  misc_feature 103: r=a or g
  misc_feature 105: y=c or t
  misc_feature 106: w=a or t
  misc_feature 113: n=a, g, c or t
  misc_feature 119: n=a, g, c or t
  misc_feature 120: r=a or g
  misc_feature 230: r=a or g
  misc_feature 231: k=g or t
aaaaagaaagcttgccccagaggacttaaacaggcaagaaggacttggttaaagactattgcaatagtcaacttccaatacaacagcagctggagatttatarcywacgggcntgggtnraaggagttaaaggatgctaaattactaagaggaagttaagtatcaagagtggggggattgttactaaactggcttagctggattcttgctgaagtgctgttcgcaggctrkggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgcccaggggaatcgggatggctgggctgtagctttcggcaacctgtcgctttctgg

SEQ ID NO: 12371 - DNA, 153 bp, Homo sapiens
aaaaatgtacacgaaacagggaggaattgggagccctaagtaaaggctgaggaagtgtctggagttaggaagagagggcaggagaaggaagagctagatgttgaagaggaggaagcagagggattggctgtcctaagagggacccaagcctgt

SEQ ID NO: 12372 - DNA, 635 bp, Homo sapiens
ttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaacactagttctttcagat

SEQ ID NO: 12373 - DNA, 245 bp, Homo sapiens
  misc_feature 213: r=a or g
  misc_feature 214: m=a or c
gtgagggtactctgccggttttgctgcggaagtcacctcgtggcgtaggggagaggtaacaccgagaagaggcagcggcggtggcgccaagacgattggtgccaaacagggcagaacgcaactcagctctggggtgggttcctgtccagaggggtagagaagagtggctgagggcgcgccctgatctcagcgggaagagtgcgaccccgaggrmgcgctagtttgtgaatagcacaatggaacaa

SEQ ID NO: 12374 - DNA, 477 bp, Homo sapiens
tgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtc

SEQ ID NO: 12375 - DNA, 508 bp, Homo sapiens
  misc_feature 225: r=a or g
taatgaattatccaagattcgatgggatttatcagtgtgtagatagctctataatgcttgaattgtacacttctaagtgtgcagtgcaagagcttgtttatatttcatactttttatactttgaggaaaaaaagtcaaagaaaaattgtatttgagggaaaaaaccatgaccaagtaaaggataaattcaaaaaatagcctcatgagacttggcatacacactcrtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaag

SEQ ID NO: 12376 - DNA, 236 bp, Homo sapiens
  misc_feature 222: m=a or c
  misc_feature 223: s=g or c
agcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgmsagaccggggtgcc

SEQ ID NO: 12377 - DNA, 312 bp, Homo sapiens
  misc_feature 103: k=g or t
  misc_feature 110: k=g or t
  misc_feature 233: n=a, g, c or t
  misc_feature 293: r=a or g
gaggggtggttgtagtggtggcttaggaataccctcccggctatcgcttcagtgggtagaggggaccactgcccgagagctttaatggagctgggtcctgccktcgcgckgaggagccctcgttttcgagatcaggcctgaccgggataagctccagaaacagtattatgtctcagtcctgtgcaaagtgagatgagctgtagcctttggagacctataattttgaacatagntgttccttaaaagctaaatctttttgaacagatgatgataaacctggaagctgttcttgragactaattagttacactg

SEQ ID NO: 12378 - DNA, 360 bp, Homo sapiens
cctatcccatatgtttgatgaaaacatattttatgtgctaaattaggttaatttaccagagatttagcttagtgtttttaaactatagaacaatacccctatagaacaatgtacagctgcacccaaggttaaaaagaggtagcagggaaaacaaacttaaactctttgtatatggtgaaacccatccctctcctgccctctaatggtatgtttacattatttcgttattatacaatgtagtggtataaacagtattattaaactgaaggcataagttaaaggaagtatgttactttgagctgatgtaggctcttccacttttatctgtattttacttatttggggactttgtattgctag

SEQ ID NO: 12379 - DNA, 294 bp, Homo sapiens
  misc_feature 122: s=g or c
  misc_feature 123: m=a or c
  misc_feature 124: s=g or c
caaagtatggctttatttttagtataaacagtcaaatgaagcttagtcttgtggcattgtcagatttataaccaaatattactgaaactaatttttttaagttcaaaaacccaatctagtasmstctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatccc

SEQ ID NO: 12380 - DNA, 438 bp, Homo sapiens
  misc_feature 328: w=a or t
cagtttgattttagttatacacagagctgacagtagctcacacatccatccattcacctgctaacaaactctgctaatgcagcagaaagagataagcatactgttgttgccaagcacaacccccgccccccaacacacacccatcccgccttgttctgtttctctccctgtcgttcgccctcatcccattctgcctgagtaaacagtcattttagcaattcgggacaaatttctgtgctgatacttactttggcacttcacagttttgggtaaggtagcattgcttcaccatggctctttgctgtgtgaatggtgtttacttttagtwgtattgtgactccctttctgattcaagggttcaggtttctcatctttgcataggcctgaggaaggagatcaataagaaaggaaaaaggactggttaaatggatagggctg

SEQ ID NO: 12381 - DNA, 222 bp, Homo sapiens
gtgtaaaaatgcccatttccaaagatggagagggaatttagaatgtcgtaaatggaacatagtgttcatggcatcttttttgctatggagttgtgaactaattttaactttctaaaaggaaacagtccagctttgtgggtaactagggtagaaagcagcagtttgctttatgcaaatgaagctcgtgaccgagaacctgaaggaggaaccaatggaaagcgg

SEQ ID NO: 12382 - DNA, 358 bp, Homo sapiens
  misc_feature 44: n=a, g, c or t
  misc_feature 45: n=a, g, c or t
  misc_feature 276: n=a, g, c or t
  misc_feature 297: k=g or t
  misc_feature 352: n=a, g, c or t
  misc_feature 357: m=a or c
acatcgaccggaactccccgccccctcccgcggcccctggggcnnaggaggccgcagcgaggaggtagagggggcgggggtcgcactagggtgtccctagagaacgaggactctgaaggcgggacatttgggcgacccccgggcggggccaaccattaaacagtcccacttctgtgccagacactgaactgggctcttgacgggcatcatctcttaatcctcagaacatcccagggagctccacaggatccccatatcctgggccatgagtgagtngaaagactgccccttgcagtkccacgacttcaagtctgtggatcacctgaaggtctgtccccgctacacggcagtnctggma

SEQ ID NO: 12383 - DNA, 160 bp, Homo sapiens
gacaaacagtcgctaattggagaggaattgggatgcggcctggggctgcggggtacccggagaggtggggatggttgtagggggctgcagggaagagttccaggaggtgtctggacaaggatttgatggatgtgcaagaattggctgatgcttaggaagg

SEQ ID NO: 12384 - DNA, 303 bp, Homo sapiens
attttacgcaaataaacagtgatcctcccctatcagttctttgcctctcagcaccctgcttttcccccgagaaaaagaaattaaagttatttcttatgggctagacagtatattgccaggtattgaagacaggatttatcttctctacttcttcttttagaagcagatcaagaaactggcgattgaagagtaactgaaagaaacgcaatctgatcttactagcagtgaaagagcgagtctccctctgatgccgagcagaagctagactgtactgctgccatctcagctcactgcaacctcccc

SEQ ID NO: 12385 - DNA, 275 bp, Homo sapiens
cccaacactgtcagcaaaaacctaggagaaaacttaaaaatatatgaatacatgcgcaatacacagctacagacacacattctgttgacaagggaaaaccttcaaagcatgtttctttccctcaccacaacagaacatgcagtactaaagcaatatatttgtgattccccatgtaattcttcaatgttaaacagtgcagtcctctttcgaaagctaagatgaccatgcgccctttcctctgtacatatacccttaagaacgccccctccacacac

SEQ ID NO: 12386 - DNA, 91 bp, Homo sapiens
tacatgtttatagtctgagttaatctcctttcttttagaaacagtggtcttgattcttactatgttttcaatttaagtagtagataacagc

SEQ ID NO: 12387 - DNA, 443 bp, Homo sapiens
  misc_feature 116: y=c or t
  misc_feature 128: n=a, g, c or t
  misc_feature 133: k=g or t
  misc_feature 134: y=c or t
  misc_feature 146: m=a or c
  misc_feature 147: m=a or c
  misc_feature 167: r=a or g
  misc_feature 198: w=a or t
  misc_feature 199: w=a or t
  misc_feature 200: w=a or t
  misc_feature 235: w=a or t
  misc_feature 236: r=a or g
  misc_feature 252: r=a or g
  misc_feature 262: r=a or g
  misc_feature 306: w=a or t
  misc_feature 310: w=a or t
  misc_feature 412: r=a or g
  misc_feature 429: n=a, g, c or t
agaagtggttctcatctttttttgcagcttaagatctgccttggtatttgaagagatataaactagatcaatttctttcacaggatcaactaaacaggttgtacttttttattatyaatatcaatacntagakytttagatatatmmaatatagaatgaaaattatrtattacaaagctcttaaaaataaaatatacwwwgaccaaagtcttgattgatactttagttaattaawratgtgaagcatttaaraccttttaarataatttgttgttaaaaataatattttacatttatgtagtattwtgtwgcttattgctttaatgtaaaattacagtaccattgctatcttaaaagtgctgaatgctggacgtgttctccattttaccaagtgagaaaataaagcaaggarggtagaaggaggtagantagagattgacttt

SEQ ID NO: 12388 - DNA, 135 bp, Homo sapiens
tataaaagtaatgagaggaaattgtattctggtattatttagactttagtagataaaaaatagtgttcaaatccatctgcttctttttctgtccacttggttaaaatgtattctggcattctctgggcagacagc

SEQ ID NO: 12389 - DNA, 200 bp, Homo sapiens
caagtaacagttcttcagaggattaacttaaccaaagtaaacagttaataaagggcagaattgtgatttagattccacatttttttctagcagttcattggttttctggctgaattccacagagccctagattctgcacagggctttatatggcatgtagggcaaggaggaggctaagctccttaacttgtatcatgtag

SEQ ID NO: 12390 - DNA, 104 bp, Homo sapiens
gcaataattcattacctcattaatggatctgtcctttttctttttaaacagttccttatgttagccatgaaatctagctggggctgtgtggtttctgattcccc

SEQ ID NO: 12391 - DNA, 262 bp, Homo sapiens
  misc_feature 21: w=a or t
  misc_feature 29: w=a or t
  misc_feature 33: w=a or t
ttgcttcttatggtataatawagtatggwagawtattgagtatatgtttactctgggcctgggagaacttaactttctagagcagtttgttgacttgtgtgcaatggggagaggtaccatgatgacactcacagggagccactgttcactgacacttggaagcggtcattgttaatatcacgggcgtaacactttgaacgatatagagatgcacaaacagttgaacttagaagtagcagtattggctttatgtaataaagga

SEQ ID NO: 12392 - DNA, 283 bp, Homo sapiens
  misc_feature 177: w=a or t
taaaatttgctagtggtttgaaaataataatgtactgactacatgtatgctgttattgtcagtgtttccttctataaactgttctttggaaaaattaagttatacataaaattcatattaaactttttacagaaagcatacatgataaacagtttatggtacttctcagaatcattwcataataagcaatttatttagcttaagttccaacttactgttcttattataaattgcaaagcaacctgtcttacattcttacattatcttaaaataaatatttctg

SEQ ID NO: 12393 - DNA, 175 bp, Homo sapiens
attttcttccccctttttacagataaggatattaatataagaaaaaggcaaataaattagcatcctacattcctaagtaaagtaggctctgttagtttctgctctccttccagataccaaggtgactttataaacataaaggaatccaattcctcctgtgaatgacaaacaaccc

SEQ ID NO: 12394 - DNA, 156 bp, Homo sapiens
  misc_feature 72: k=g or t
ctagacaaattagaaacataagtcccagtagaaatgagatttccataaagttacttttagtgaatttaatakactctttcttggtctgaaattcacccaacaacatgcattccacaatttttgtggagcaaccacaatacaccatcactctagggc

SEQ ID NO: 12395 - DNA, 363 bp, Homo sapiens
  misc_feature 7: n=a, g, c or t
  misc_feature 25: s=g or c
  misc_feature 26: s=g or c
gtgccanccgggtctctcgcgcgassatttagtctgaggcgaacttcggagcggccggtactgttgaaagcgacaagtggaggcgccgctctagcggccgggactctgaactatggcggctagtgatacagagcgagatggactagccccagaaaagacatcaccagatagagataagaaaaaagagcagtcagaagtatctgtttctcctagagcttcaaaacatcattattcaagatcacgatcaaggtcaagagaaagaaaacgaaagtcagataatgaaggaagaaaacacaggagccggagcagaagcaaagagcgtgcttatgcgcgaagagactgaactgaagacgctgcagactc

SEQ ID NO: 12396 - DNA, 200 bp, Homo sapiens
ggggcggggctgagtgggtggcgacctagctgctgcgccagtgtttgtgttggaagctcagctgatgcaggccggttggagtggacgtcattgccgggaacgagcgagtcgccgctgcagccctagtgactgcggcctgcatcccgattgtcttctcctccaaggtctacatgattacctgaagtttaataagtaagacc

SEQ ID NO: 12397 - DNA, 407 bp, Homo sapiens
  misc_feature 278: n=a, g, c or t
gagtgggtggcgacctagctgctgcgccagtgtttgtgtggaagctcagctgatgcaggccggttggagtggacgtcattgccgggaacgagcgagtcgccgctgcagccctagtgactgcggcctgcatcccggtaagaccatgaattatggcatttcttaaatgaagcgttcaagaagtgagagaatgtcatagaaaataaatgatttttaagttatgtctattaatctgactgtagatatatatatttacctccttagtaatgcaagaagtgttngtgggaagcagagaagcaagcaactgtatttcttgttctcacctaagcattactggagggataagccacatcagtctacaaagaggttttcatacaaacataataagatgtaaatggaccaaaagtgaa

SEQ ID NO: 12398 - DNA, 153 bp, Homo sapiens
ccctttgagaaccattaggagcagtgtgtctcacatattgagagtgggcatctggccacatacatgtatgtcatgtgtacacattcatcatgtatgtaaacatacacactcattagtttgctagttaatgaaagagcaagataaattgtggag

SEQ ID NO: 12399 - DNA, 275 bp, Homo sapiens
  misc_feature 152: m=a or c
tactttcttagttaacataccagacccacaatgggaaagcagatgccacgtggccaaatcagtgactaagtacttccgagagagattaaagattcaatggaactctgcgtctctcatctggaacccaggacacagaacaagggagggaagamaagctcagccttaaacatagcaaggtgaaacctttgtcctggggaatagtctggcccgctccttggaaccacactcagactcaatggactctgcctcaaatcccaccaaccttgtcagcacct

SEQ ID NO: 12400 - DNA, 209 bp, Homo sapiens
tactagagaaatggggagagtataagcaaaccaggaggctttgtttgttttaaaatgtttgctttatccagatccttatacttaaagatctgacatataacaacaacagaaaagtatagttattggctccatttaaaaaatatattattataaggctctgatttcagagcctcagtcgttcattatggagttgaaggctgggagtaagg

SEQ ID NO: 12401 - DNA, 185 bp, Homo sapiens
caattattttctaaacatatcctctccagtttcagtgttttttaatcaaaccaccaggaatggtgcagcagacaatgccagtccatgtctcccccttcatggtcccttagttgtcattaatgggtgactgcagagaaccataggcatttgaggacttaacagagatatgttttatattgagagtg

SEQ ID NO: 12402 - DNA, 448 bp, Homo sapiens
acaatttgctgaaggagcaaagaacatcctcggctctaagtagggcttttagtgtgctcattgatgagtgaaagtcgccacacatgtcaagctaaaggcagttgttgggttactaacaggacccagcgccttgcaaacatatgcgctaagctgtgtatacagatggcaggcagaataatggagcaggcgccttttataaagctctagctgctgcctgtcttcagacctgggaaatgaaactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatc

SEQ ID NO: 12403 - DNA, 359 bp, Homo sapiens
  misc_feature 63: n=a, g, c or t
  misc_feature 75: m=a or c
  misc_feature 76: m=a or c
  misc_feature 83: m=a or c
atatccgtggttttgctacctccaaccatgggccttttgggaatactttgttttttaatcttncctggggaaaammtggggamaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatt

SEQ ID NO: 12404 - DNA, 107 bp, Homo sapiens
tcacctgaactggattgtctttcatttcagtcagcacttagacatttcataataactaaacatcacattccaagtgggatgaattacattaattgaatagagttacc

SEQ ID NO: 12405 - DNA, 99 bp, Homo sapiens
gtaaacatcactgtattcctgtggggaggtttacgggttagaacaaaacagaccttgagttcttagtccatggacagagttatttcccgccttgacccg

SEQ ID NO: 12406 - DNA, 212 bp, Homo sapiens
atttaacaccaactatggagttcagtatgtggatagggggttggcaatgtgtgataccattaagcttcagaccaaacaaagacctttcatatatgaagctctgttctacacagctctaaacatggccccaaacatcactttgttgtattgagcaattgcctataccttctcctggagttctaggccactggatatgtcagatagccgtaagc

SEQ ID NO: 12407 - DNA, 380 bp, Homo sapiens
taaataaataatatggattgttttaaaaaatatccaaggatcagagtctctttctaagctttgtaagctaagcaatagtttatgtcctactagatacactgcaaactacagtggggattttatctggacatcccaccatcaaagatcttgaaatagtaatagtatgaaaatactagataaaattaatgtttaaaatgtttttgtaacaataatttttaaaacccacactcttccatatatggggataaatatcacctagaaaagtagcctcactcttattcctcaagaattaatatccaatgtttatgagtcttgcaatcaattttgttcatttttaatttgcaaatcgataactgaactaatttgttcttattttttgc

SEQ ID NO: 12408 - DNA, 259 bp, Homo sapiens
atcagtgataaataagggaggctaagagtaaagaagtataacttgacatttcttctgcaagaaaaaaacaagaagatggtgactttcaagacctcagtcaatgactaaagttctgtgaccacagtgagcatattactgcggtaaccagggcagtaatgtcaagacaaaggtcagggttggctttaagaaagaagcctgagaaccggaactacatagaggccagaaaatcagtgtctacatgctaaaggcaattttcagg

SEQ ID NO: 12409 - DNA, 337 bp, Homo sapiens
attcacccaacaacatttttgatgcatgatgcatatggtgctaaatgctgggaatgcaaacctgagtaagtgtctatttcaaatcaataggagtacttgaagattctccctgcttacaatgtaaacatcatgaagaaagagatgtgttggacttgttcatcgctatatttcctggctcagatcctggcactgagtagacatcaagaaatatttaaatgaatgaaagaatgaatgaatgaatgaacgaactgtgtcctcttgtagagctgagggtgttttaccactaccctaagagctgacaccaggaggtcttgctgcaaagccaggcactgtattc

SEQ ID NO: 12410 - DNA, 417 bp, Homo sapiens
ctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagc

SEQ ID NO: 12411 - DNA, 76 bp, Homo sapiens
tgaataaacatcctggtatatggtggactattaattatataggtataagagaactgaaatatgaataatactaccc

SEQ ID NO: 12412 - DNA, 426 bp, Homo sapiens
  misc_feature 9: s=g or c
  misc_feature 10: n=a, g, c or t
  misc_feature 11: k=g or t
gaaaagtgsnkccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcagcaggcgaaaatcaa

SEQ ID NO: 12413 - DNA, 69 bp, Homo sapiens
aataagatgaatcttttggtctcatatttagtataagatttaggccacaaacatctaatggagtcatgg

SEQ ID NO: 12414 - DNA, 267 bp, Homo sapiens
  misc_feature 42: k=g or t
  misc_feature 44: y=c or t
  misc_feature 51: m=a or c
  misc_feature 224: r=a or g
gggtcaagtgactaagagcatgtggtggatgccttggcgatkayaggcgamgaaagacgtgatagcctgcgataagcttcggggagctggcaaataagctttgatccggagatttctgaatggggaaacccacctcgcaagaggtatcgcatactgaatacataggtatgcgaggcgaaccgggtgaactgaaacatctcagtagctcgaggaaaagacatcarccgagattccgaaagtagttgcgagcgaaatcggaagagcctt

SEQ ID NO: 12415 - DNA, 250 bp, Homo sapiens
ttaagttagaaagggcgcacggtggatgccttggcactaggagccgatgaaggacgggactaacaccgatatgcttcggggagctgtaagtaagctttgatccggagatttccgaatggggaaacccactgttcgtaatggaacagtatctgtacctgaatacatagggtactgaaggcagacccggggaactgaaacatctaagtacccggaggaagagaaagcaacatgcgatttcccaagtagcggc

SEQ ID NO: 12416 - DNA, 632 bp, Homo sapiens
ttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatattttataacggc

SEQ ID NO: 12417 - DNA, 93 bp, Homo sapiens
  misc_feature 70: m=a or c
gtgtatccgcggccgtagcagccgggctggtcctgctgcgagccggcggcccggagtggggcggcggagmaaacatgaacgttggagttgccc

SEQ ID NO: 12418 - DNA, 205 bp, Homo sapiens
actgaccctgctctctcctttccctgttagacatgggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagt

SEQ ID NO: 12419 - DNA, 378 bp, Homo sapiens
cagtgatgtttataccaatctgtatatagtataatttacattcaagtttaattgtgcaacttttaacccctgttggctggttttttgttctgttttgttttgtattatttttaactaatactgagagatttggtcagaatttgaggccagtttcctagctcattgctagtcaggaaatgatatttataaaaaatatgagagactggcagctattaacattgcaaaactggaccatatttcccttatttaataagcaaaatatgtttttggaataagtggtgggtgaataccactgccaagttatagctttgtttttgcttgcctcctgattatctgtactgtgggtttaagtatgctactttctctcagcatccaata

SEQ ID NO: 12420 - DNA, 567 bp, Homo sapiens
  misc_feature 455: r=a or g
  misc_feature 537: r=a or g
ggtttgggtgtggccgcatggcgtgctgtggtgcaggtggccgaaggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgctcttgggttgatagcttatggcagtgatagtcaagtgtatcacgccgtgaagtcaactgtttggaattcagctttagtacgactatcccagagagactactaaacaagttcactacagtgcacgaaaatccagctttggagaaacttctgaccagcaagtcagaagtttcaaagaaaacttctttggtttcaaagaaaaatcagctaggaaaagatactgaggagtctgtgaatagatggagtggagtragctagtagatggtgaaggcgctgctcacgaaagaaacagaggtggtgcccaggtcttcagaatctgagtgacgacactggrcacaaactactcactgactggggagcagct

SEQ ID NO: 12421 - DNA, 368 bp, Homo sapiens
  misc_feature 328: k=g or t
  misc_feature 330: n=a, g, c or t
  misc_feature 341: n=a, g, c or t
  misc_feature 347: n=a, g, c or t
  misc_feature 361: y=c or t
acgtcatttcggggcgaccctcttcttggcgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagcatccccccccccgcccaccagacctgttctgacctcatgagtktnaaacgtgcccnccagtnccttaggagatgtyatgacaa

SEQ ID NO: 12422 - DNA, 504 bp, Homo sapiens
aagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctatt

SEQ ID NO: 12423 - DNA, 192 bp, Homo sapiens
aagggtccttcaggtaggaggtcctgggtgactttggaagtccgtagtgtctcattgcagataatttttagcttagggcctggattctccattgcacttttatttgaatgtaatatttgggacaattattcaaaagggccaatatttcccaatttaatctgaggtcataataaaacaagcaacaaaaaggga

SEQ ID NO: 12424 - DNA, 422 bp, Homo sapiens
  misc_feature 340: r=a or g
aagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactgaagcaacgtgctgctgagttgaaaattaaaaccatgaaatttgaactgcgttttatttttcacctgctgaaagaacaggatcctacagcaattaaaaaacaatcacataaaaattatagcgtgtgtrcaaactcttgagggttgattatgctgcaatttagcatgttggaacgtctagggagaaggttgactttttgcacttctgtata

SEQ ID NO: 12425 - DNA, 369 bp, Homo sapiens
  misc_feature 323: s=g or c
  misc_feature 341: m=a or c
  misc_feature 350: n=a, g, c or t
  misc_feature 366: r=a or g
aagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtccccctgtactcgcaatatgscttttcaaaggagagagmgttattggntaacactttggtgtgrgta

SEQ ID NO: 12426 - DNA, 309 bp, Homo sapiens
  misc_feature 244: r=a or g
  misc_feature 269: n=a, g, c or t
  misc_feature 284: m=a or c
  misc_feature 287: w=a or t
tagttatatgtaaggttacgtggtccagtaatgtcttagattgataaattaggtatggaatccatcagtgttacgtgatgagaataggtgaacacaccttgtcagtgatgatgtaaacttctctccttggcaggacatgggcaaacatgctgattggtgcaaatgtggtgccgagctgtccatagctgcagtgaaagatgaagagcaagaccttctctaggttttctagctttcattaaatgtrtttttttccccagagctaatttganagttgattggaccamtgwggatggggtgtcattaagaatg

SEQ ID NO: 12427 - DNA, 217 bp, Homo sapiens
aacaaaacaagggcagcgggcccggcgcggtggctcacgcctgtaatctcagcactttgggaagccaaggcgggcgaatcacttgaggcccctagaagggctaactatgccctttctgagtcttccacgcggtgggggcgaaggaggatggagctagaacgaagcctcagcgcgtgccccgcacaaacatggcagcattcccagcagccctaaaccg

SEQ ID NO: 12428 - DNA, 413 bp, Homo sapiens
  misc_feature 203: r=a or g
  misc_feature 208: r=a or g
  misc_feature 215: s=g or c
  misc_feature 216: y=c or t
  misc_feature 222: y=c or t
  misc_feature 229: n=a, g, c or t
  misc_feature 235: n=a, g, c or t
  misc_feature 241: w=a or t
  misc_feature 248: n=a, g, c or t
  misc_feature 249: r=a or g
  misc_feature 263: n=a, g, c or t
  misc_feature 264: n=a, g, c or t
  misc_feature 296: r=a or g
  misc_feature 301: k=g or t
  misc_feature 316: n=a, g, c or t
  misc_feature 318: r=a or g
  misc_feature 357: r=a or g
  misc_feature 376: r=a or g
  misc_feature 377: s=g or c
acccggctcggccactgctgggcggacacctgggcgcgccgccgcgggaggagcccggactcgggccgaggctgcccaggcaatgcgttcactcggcgcaaacatggctgcggccctgcgcgccggggcgtcctgctccgcgatccgctggcatccagcagctggagggtctgtcagccatggaggtggaaagtcaggtgcargctgrcagcggsycgtcaycacaganacagcncagcawgcccagnrtgcaaaacctcaanntcaaccgcagaagaggaaagccgaaaactggratatkaatgctaaacatggnargccctgaaactcttggagatgttcacgacttccttctgrgactcttcttggaccaagrsctcatggacacttcctattcagaataagctggcacc

SEQ ID NO: 12429 - DNA, 466 bp, Homo sapiens
  misc_feature 437: s=g or c
agtcagtgcgcaaccgttcgctaactgaaatgatggcgactggaacgccagagtccaagcgcggttcggtcagtccgtgaaggggcttctcacggagaaggtgaccacctgtggtactgacgtaatcgcgctcaccaagcaggtgctgaaaggctcccggagctccgagctgctaggtcaggcagctcgaaacatggtactccaggaagatgccatcttgcactcagaagatagtttaaggaagatggcaataataacaacacatcttcaataccagcaagaagctattcagaagaatgttgaacagtcatcggatctacaggaccagttgaatcatctgttgaaatagaatgacattaactcagaggagatacgtgttttatttgtgatagcaaattcctaaatgaacattaggcaagtggtatcattatcaggcsagctgcagcctcttgccttgacctgcatc

SEQ ID NO: 12430 - DNA, 269 bp, Homo sapiens
aaatttaagcctgtggcatggaacctaaagactagaggcggttgtgtgagtcaggaagaggggccagatatctgagtgttcctctttagtttcttcaattgcaggaaagacagtggttcctgactcaggaagacagtctcagaaacatgtggaatgatattgagctgctaacaaatgatgataccggaagtgggtacctgagtgtcggttcaagaaaagaacatggaactgctttatatcaagtagatttgctagtgaagatctcttct

SEQ ID NO: 12431 - DNA, 149 bp, Homo sapiens
cttgtcctctcattccctccctgtgacatcaaacattatattaatttttccttaaaattcagatcatagtttttaaaattataaatcaatgtttactttaacttaatacaatctactggctcttttgctcaccactgtttcttatatcc

SEQ ID NO: 12432 - DNA, 142 bp, Homo sapiens
  misc_feature 120: n=a, g, c or t
  misc_feature 121: n=a, g, c or t
tgagaaggagcaattttgttcgtttgaagtcctggggtcttttgccttattgtgctacactaactgttttggaaacattcattgatgtacttgccagccaattttagtgtaaagtgcccnntttccttcagaatcttacact

SEQ ID NO: 12433 - DNA, 556 bp, Homo sapiens
  misc_feature 554: n=a, g, c or t
cattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcnta

SEQ ID NO: 12434 - DNA, 269 bp, Homo sapiens
aaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctacttaacctgccctaatatttttcggcctgatgggaattagtgcagagaagccatgtcaccatagaagccaactcctacttgtgtgtggactgagcaatcagagt

SEQ ID NO: 12435 - DNA, 152 bp, Homo sapiens
agaaggaaggcgggagtcccgactgcaaacattgaggaaagccaggcagtagaggccgctatggcgaacgttccgtgggcagaggtctgcgagaaattccaggcggcgctcgctctgtcgcgggtggaactgcataaaaatccggagaagga

SEQ ID NO: 12436 - DNA, 518 bp, Homo sapiens
  misc_feature 3: n=a, g, c or t
  misc_feature 92: s=g or c
  misc_feature 493: r=a or g
  misc_feature 494: r=a or g
  misc_feature 495: r=a or g
ctntctttcttcctgtctgcttggaaagatggcgtcccgcaaggaaggtaccggctctactgccacctcttccagctccaccgccggcgcasagggaaaggcaaaggcaaaggcggctcgggagattcagccgtgaagcaagtgcagatagatggccttgtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaagtccaatatcagatggaaatgatgcggaccttcgccatgtaaacattgatcatcttcacgtgggctggtatcagtccacatactatggctcattcgttacccgggcactcctggactctcagtttagttaccagcatgccattgaagaatctgtcgttctcatttatgatcccataarrrctgcccaaggatctctctcacta

SEQ ID NO: 12437 - DNA, 184 bp, Homo sapiens
gatgctgggatggagcaaacattgatttgtgctgggatggaatcggaattttgatttatttttcctctcccaaccataagaagaaaaaaataataaaaacaccccctcttgagagccccctccccctttgcatccagctcccagctcttcttccctatctccatccaaggcagattttttcccc

SEQ ID NO: 12438 - DNA, 213 bp, Homo sapiens
tattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatggatttttaaataacctgtctttgtttttgatgttaaacagtaaat

SEQ ID NO: 12439 - DNA, 214 bp, Homo sapiens
tctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaatacggtggtttatttcatgtttgcatactataaaatctgaattgatgtgaaatatctg

SEQ ID NO: 12440 - DNA, 132 bp, Homo sapiens
catacataaacatttcctagttctgtccattgagcgagcacagcacagatgcagttactccccagtaataatgagcatacctggtgcccagatcttcgtctgtaaacattttcttttcttttcttttttttt

SEQ ID NO: 12441 - DNA, 222 bp, Homo sapiens
ttttaaggataataagagacacttacaaactattctctctgaagcctgctacctggaggcatcatctagataatcagaaccttggcttccacatcctcctcccttgtcttaactacaaacatttctttctgctgacttcagctcctcaggtagagtttaaccgtttcaaccaattgccattaggaaatctttaaatccacctatgcacctatgacctggaca

SEQ ID NO: 12442 - DNA, 244 bp, Homo sapiens
  misc_feature 7: m=a or c
cttaaamgaagaagcatctgattaccttgaattggatacaattaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagttgaaaaactgtctggga

SEQ ID NO: 12443 - DNA, 222 bp, Homo sapiens
cctctcctggaatcaatcttccaacccccctccccacatctcagagacaatggtgaacatgaaatattataactgtaaatactgaaacattttataagagtgggaagcactattttttttcttttatcaattcaaaggtctacaaagatacagaatgatcaagtcatatgtaaccatctcttcaaatgctcagtgcttacttggaagcatgtcttgccacct

SEQ ID NO: 12444 - DNA, 417 bp, Homo sapiens
gtaatcatggagtacttgatccagtcatatttcatatcacaatgtatccaatggtggaaacattttccctctggagaccagaaatctggacttgtaaaaagaacaaattccccatgtgtgccacttgatcaatgttaagtggtcactcatttcctccccctccccttttatttctaggtgcatgtattctgcatagtagatgtagaacagataatcatcgacaggctcataattaagggtatacagtttaacctggaagatgcctgatcatcacaagttgtccttaagatggcatttcagcttcatttttaagagggcatttcaggggccaggcacggtggctcatgcctgtaatcccagcactttgggaggccgaggcaggcagatcacctgagctcaggagttcaagaccagcct

SEQ ID NO: 12445 - DNA, 200 bp, Homo sapiens
  misc_feature 124: r=a or g
  misc_feature 125: r=a or g
  misc_feature 157: m=a or c
  misc_feature 176: k=g or t
gacaaattaaaacctagagtagtgcttatgctgaaatgatacttttcattttttggttgatttttttgccttcccttcaattttaaactgaagcattttaatgtgggtagaaactctacaccarrtacactaaacattttggtgcttagtggatttmttttaggtaactggtactkacttccaaagactgaatacaagcc

SEQ ID NO: 12446 - DNA, 250 bp, Homo sapiens
atttgccaaatcttgccagcctgataaacatttttcttttgggggctggcatctcgtttcctccttcttctcttctgaaatgattatagcaatttttgtacttcaaggaattggtgagaaccgggtacctactatatactcgataaatgaataatcaaataaatgagatcactaataaggagtgacatgtaaggtcacgctggtcatggtaaagtggtggacataaaatgcgacttgtgattctgaagca

SEQ ID NO: 12447 - DNA, 511 bp, Homo sapiens
  misc_feature 404: m=a or c
catccgtgaacgagctgggcatttgatgagacagggccgaatactgcagttttcctcctagaaatcctctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatccctcaaattgtcctgttctcatgctgaggagcctgagatccctgtgtggggattagacagtggactgttatgggtgtaggtgaattggcttattttgtctgtccctgcctgaatgtattgcaggaattaaaaaggaccaagaagaggaagaagaccaaggcccamcatgccccaggtaactgagcaattgtgaacagctacttctgtgttgacatctggagactcctggttcagggaaaacagagcgggctgacattatcgattacatcttt

SEQ ID NO: 12448 - DNA, 208 bp, Homo sapiens
  misc_feature 10: n=a, g, c or t
  misc_feature 11: n=a, g, c or t
  misc_feature 33: w=a or t
gctacggtgnntgacaagatggcggctggcggwgtgtcgctgcggcgcccgagtgccggcttctcccctacgcgctacacaagtggagctccttttcctccacctaccttcccgagaacattttagtggacaaaccaaatgaccaatcttcaagatggtcttcagagagcaactatcctccccagtacttgattctaaagctcgaaag

SEQ ID NO: 12449 - DNA, 374 bp, Homo sapiens
cactgattaattttaagaaccttttagggatgcaggaacaatgaagtggccacagtatgtgctgtttttgaagcatttttaaaaacgaattgtagttttttcttcatttaaaatggatctgttggaggttatgtgtgtatgttgtagttttattggcagccacaataattttaccaaagttttcacatagggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagc

SEQ ID NO: 12450 - DNA, 419 bp, Homo sapiens
  misc_feature 303: m=a or c
aagcaaggctcagcctcaagattcacagcatctcagacgcagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggmgaggagctggttgccttgaaggagcgcattgagcggcgccggtcagagagagccgagcaacagcgcttcagaactgagaaggaacgcgaacgtcaggctaagctggcggaggaaaa

SEQ ID NO: 12451 - DNA, 245 bp, Homo sapiens
acatgagatgatgcgcttttagcacccacctggcactctgtgagtttgtcatgatttgggcataattccttcctctcctaagcaggcagcagttcaccttggttaaggaccttggaccttagaccactcagacgctaacaaaccaaggagaaacccagccgtgtcaggcctagaaatgtctgcccccacccccacccccctcaagacggtgactaggccggaattctcctggttgataaatgaga

SEQ ID NO: 12452 - DNA, 410 bp, Homo sapiens
agccttgtgactcactttgactagtagaaggtggaagtgatattatgccaggtccagacttaggccttaggaggcctggcagtttccattttcaccctcttgggatccagccactatgaaaccaagttcacctgctttattggagagagaaatgacctagaagatgaaagacagcaaagggagagcaggatgcccagccagccaccagccattctgaccccttcagctgaggcactgcatggacagcgctggggagaatgaacgcctgagtactcatgtctttatgcactgtagtattatttccttacaacagactcctgaacctggaacggcagtgtcaaaggattcacaaaatgttagacttctgaagcaaatcagatggcaccttttttgaataatgaagagtcttt

SEQ ID NO: 12453 - DNA, 246 bp, Homo sapiens
  misc_feature 191: r=a or g
ataaaccaatcgtggagctccaattgtcttggtggtgaggtgaatcaatagcccattactggatagaacagcgactacaggaagagcattgaagattttaatgcatgaattatgcatgcagcgctcattctttagtctccgaacagaatgacagggtttgtgaagtcgcctcagatagtttcttgcattargtgactgcagtgaaatgcttaatattttcaggcatagaagcagcattgactcggg

SEQ ID NO: 12454 - DNA, 361 bp, Homo sapiens
gattcaaagagacaagttgagaaagaggaaaccaatgagatccaggtggtgaatgaggagcctcagagggacaggctgccgcaggagccaggccgggagcaggtggtggaagacagacctgtaggtggaagaggcttcgggggagccggagaactgggccagaccccacaggtgcaggctgccctgtcagtgagccaggaaaatccagagatggagggccctgagcgagaccagcttgtcatccccgacggacaggaggaggagcaggaagctgccggggaagggagaaaccagcagaaactgagaggagaagatgactacaacatggatgaaaatgaagcagaatctgagacagacaagc

SEQ ID NO: 12455 - DNA, 216 bp, Homo sapiens
atgtattagtccctgccctgaccctttccagctctggaagctttcctgatctttcctgagtaggtcgcttaacccgtggaacactttcctctttctgtgtgaagtaaggggtttggattaagtaatccccgaggccccttcctggattctccctaaggattggtccagagcagaaaccaatgccccggaagataagcttgatgaccacaccaccga

SEQ ID NO: 12456 - DNA, 258 bp, Homo sapiens
tttctctatatggctcccacaacaatttcattgttgttagcatatctatttctccatacattgtaaaactgtaatccttaggtatttctaaaacataaagaggagaattaagtcagctgcagaacaatggggctgattcttctgctttctctggaaaatctttcattgcttttggtggaaatttacctagaggttacaaccacaggatgtagcttggtctcttatttgcctttttgggaaaccaattaagattaatac

SEQ ID NO: 12457 - DNA, 333 bp, Homo sapiens
  misc_feature 22: n=a, g, c or t
  misc_feature 24: y=c or t
  misc_feature 27: y=c or t
  misc_feature 67: r=a or g
  misc_feature 71: r=a or g
  misc_feature 73: s=g or c
  misc_feature 75: s=g or c
  misc_feature 83: k=g or t
  misc_feature 86: m=a or c
  misc_feature 196: y=c or t
  misc_feature 277: r=a or g
agatactctggtttctcttcanaycgyataaatctttcgccttttactaaagatttccgtggagagraacraststgagtctkaamccaattttttgaggccttgcgtttcttagcagggcttattttaagtgttttaaaaacagatgcgattccgttaaatcgcgtgtggagctatgtaaagtgtattatagaayaaatgcgagttacggtttttcagcttttcgctttgttaaggtatgtgatatcaattgtattgcatttctgagcagttatartattaagatgttggggtggcttactgcttttgaccaagaagtagggtttgttggtt

SEQ ID NO: 12458 - DNA, 217 bp, Homo sapiens
cactcctgttagatgggataaggattcttggattctggtgtcttaaaccacatgcctaccgtagtcactactcaaatatgtgttggatgaacataaatacttgctgcttttgttagcatctggctagccctgtattccaaatactgactgaagaatgatcttctctgattacacttggattcaatttctctaactaccctccccctttgaaaaaggt

SEQ ID NO: 12459 - DNA, 673 bp, Homo sapiens
  misc_feature 579: r=a or g
  misc_feature 614: w=a or t
tagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagatgatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcaaaccaccaatgtgattgtaaacttctccagacaaacttaaccttttgtttcttaattttttgttttgagtgttgcttctcagccctggtataggtctcagccccacagcaggatctcaataaatgcttattgacaggctggcatagtaaccacaggtggttatcaaaggaccaataggctggggacaaattatgcttggccccctcagaggcttatacctccaaagcagatttaaaaatcagtaactcaaaactttargaagtagttgagtctacaaaatattcaaagcagtwacctaaataaggttatttaatgtaacagattatatacttaaagtgatctgagcaatcat

SEQ ID NO: 12460 - DNA, 321 bp, Homo sapiens
  misc_feature 88: n=a, g, c or t
  misc_feature 145: r=a or g
  misc_feature 255: y=c or t
  misc_feature 256: y=c or t
  misc_feature 261: k=g or t
  misc_feature 268: r=a or g
  misc_feature 275: r=a or g
atcaacccttcttccaccaaaccacccaactcctctctactcttatccttttatccctgtctctgcttatcacctctcttgcgtattntggatctccttccctcctttctcgtccaaatcatgaaatgtttggccttagtcaatrtctatgcccgtcacataacagccgaggcaccgaggcccacagagaagcagctgggagcttggaaacctggtctcttgaatttcaaacctggtttcttacaggtggttgtyytgggktgggtgragtggcracaggatagagctgaaggactatgcaaatgaggaagtaagtcaggg

SEQ ID NO: 12461 - DNA, 208 bp, Homo sapiens
tttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccct

SEQ ID NO: 12462 - DNA, 531 bp, Homo sapiens
  misc_feature 321: n=a, g, c or t
  misc_feature 443: r=a or g
  misc_feature 517: s=g or c
acatgtgcaggatatgaaattgctgaggcatcactgctttcctacttcccttccaagtctcagctcccttattttaaaaaatatttggcctcaatgatcatttctcaacaattcctcaccgcagagcctctgaagctcccaccaggccagctctcctcccacaacagcttcccacagcatgaagatctccgtggctgccattcccttcttcctcctcatcaccatcgccctagggaccaagactgaatcctcctcacggggaccttaccacccctcagagtgctgcttcacctacactacctacaagatcccgcgtcaggnattatggattactatgagaccaacagccagtgctccaagcccggaattgtcttcatcaccaaaaggggccattccgtctgtaccaaccccagtgacaagtgggtccaggactatatcaaggrcatgaaggagaactgagtgacccagaaggggtggcgaaggcacagctcagagacataaagagaagatgccaggscccctctccaccca

SEQ ID NO: 12463 - DNA, 576 bp, Homo sapiens
  misc_feature 366: s=g or c
  misc_feature 562: s=g or c
acatgtgcaggatatgaaattgctgaggcatcactgctttcctacttcccttccaagtctcagctcccttattttaaaaaatatttggcctcaatgatcatttctcaacaattcctcaccgcagagcctctgaagctcccaccaggccagctctcctcccacaacagcttcccacagcatgaagatctccgtggctgccattcccttcttcctcctcatcaccatcgccctagggaccaagactgaatcctcctcacaaactggggggaaaccgaagttgttaaaatacagctaaagttggtggggggaccttaccacccctcagagtgctgcttcacctacactacctacaagatcccgcgtcasgagttatggattactatgagaccaacagccagtgctccaagcccggaattgtcttcatcgccaaaaggggccattccgtctgtaccaaccccagtgacaagtgggtccaggactatatcaaggacatgaaggagaactgagtgacccagaagggtggcgaagcacagctcagagacataaagagaagatgccaggscccctctccaccca

SEQ ID NO: 12464 - DNA, 561 bp, Homo sapiens
  misc_feature 191: r=a or g
  misc_feature 194: r=a or g
gtgtagcttttgtttttaagtggatcttcgctgaggactcatcaaaaacaccttgtgtaatgaaaaacccagatctataacctctccctatatattctgcatgcattgaagtaggctcaaaccctcagggacctggtatagacgcagaatctgtttcacacaacaactgctatttgaaggaaaaaaaaaargargcaaatgataccaagacaagctcataacagagatccaatcagcagatgtgtacggatgaaaatacagtgagatgagtcagaaaccggccaaggagggtcccagactctccaaaaaccagaagtactccgaacacttcagcatacactgctgcccgccgttcaccttcctcaattccaagaaggagatagtggatcggaaatacagcatctgtaagagcggctgcttctaccagaagaaagaggaggactggatctgctgcgcctgccagaagaccagattgaaaaggaagatcaggccaaccccaaagaagaagtgaccaaggaggagtttaaactgaatgaacaaccttggctcctggactcattg

SEQ ID NO: 12465 - DNA, 132 bp, Homo sapiens
ctaagaaaccaccttgtattataaattaataggagggagataggcacatgaggaattactagttaaattgagtatccagaattgtctgcaagttaaaaaaaaaagggactcataataatctgcattgttttt

SEQ ID NO: 12466 - DNA, 237 bp, Homo sapiens
gttaagactatactttcagggatcatttctatagtgtgttactagagaagtttctctgaacgtgtagagcaccgaaaaccacgaggaagagaggtagcgttttctcctgagcgtgaagccggctttttggcgttgcttcgctgcaactgccgtcagccattgatgatcgttcttctctccgtattggggagtgagagggagagaacgcggtctgagtggaaagaaaagaagataaag

SEQ ID NO: 12467 - DNA, 377 bp, Homo sapiens
  misc_feature 127: y=c or t
  misc_feature 139: s=g or c
  misc_feature 305: s=g or c
  misc_feature 366: k=g or t
  misc_feature 367: m=a or c
gttaagactatactttcagggatcatttctatagtgtgttactagagaagtttctctgaacgtgtagagcaccgaaaaccacgaggaagagaggtagcgttttctcctgagcgtgaagccggctttytggcgttgcttsgctgcaactgccgtcagccattgatgatcgttcttctctccgtattggggagtgagagggagagaacgcggtctgagtggtttttccttttcgcctcctgtttcagcggtgacggctcttgggttttctcggggtggcttttttaattttagtcttggcgcgaggsggggatgctgtgtggcacctcctattgtctctttttgcgttttctcccattctcgctccckmttttgtcgcc

SEQ ID NO: 12468 - DNA, 383 bp, Homo sapiens
  misc_feature 312: n=a, g, c or t
  misc_feature 313: n=a, g, c or t
  misc_feature 319: n=a, g, c or t
gttaagactatactttcagggatcatttctatagtgtgttactagagaagtttctctgaacgtgtagagcaccgaaaaccacgaggaagagaggtagcgttttctcctgagcgtgaagccggcaaatcgtttgtttgtttttgcagaatcttgctctgtcacccaggctggagtgcagtggcatgatctcggcgcactgtaacctccacctcctgggttcaagtgattctcctgcctcagctgcccgagtagctgggattacaggcatgtgccaccaagccaggctaatttttgtatttttgtagagacagnntttcancatgttggccaggcgggtctcaaactcccgacctcaagtgatctgccctcccctgccctttttt

SEQ ID NO: 12469 - DNA, 196 bp, Homo sapiens
  misc_feature 184: n=a, g, c or t
gttaagactatactttcagggatcatttctatagtgtgttactagagaagtttctctgaacgtgtagagcaccgaaaaccacgaggaagagaggtagcgttttctcctgagcgtgaagctggctttctggcgttgcttaaaaaaagagggaaaattacaaaaagagagaaaaaaagtgaatgcngtttgtttagcc

SEQ ID NO: 12470 - DNA, 406 bp, Homo sapiens
  misc_feature 7: s=g or c
  misc_feature 25: s=g or c
  misc_feature 44: s=g or c
  misc_feature 48: k=g or t
  misc_feature 55: s=g or c
  misc_feature 83: m=a or c
  misc_feature 146: r=a or g
gcgcgasgcagcgagccgcttctcsccatcacagcgattcccasggtkgtcatasaaaccactccctggggcttggcaaagcmggagccctccgtgggcagggcttcggtgtcggggctccgaggctccggcctgacttctccacrgggtccacaggagcgtctccggatgccaggacctgaaatgggccgaccaggatgaggaaaccacaggcagaggccggggaagcagcgcggcatcccatcctcaggcctgcccggacggtgttcgggatcaagaggaccacactccagcccaggacaaaagccccacggtagcacattgtccggcaggagaggagcagacccacgtccaagaagatggttgtacctttccacgcctcttctctgcgaaatgaagccacacc

SEQ ID NO: 12471 - DNA, 127 bp, Homo sapiens
agaactcaggaaagtctcagccaacacagaggacatgacatccgaggggagccccagggatgcgtggaatttccatcagaatgtgatggtggttccaaagctgtgatgaatggcttggcacctggca

SEQ ID NO: 12472 - DNA, 381 bp, Homo sapiens
  misc_feature 143: n=a, g, c or t
  misc_feature 148: n=a, g, c or t
  misc_feature 149: r=a or g
  misc_feature 151: n=a, g, c or t
agacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggnatggnrangatcctggcagaagcagatggactgagcacaaaccactggctgatcgggacagacaagtgtgtggagaggatcaatgagatggtgaacagggccaaacggaaagcaggggtggatcctctggtaccgctgcgaacttgggcctatctctgagcggtggggaccaggaggacgcggggaggatcctgatcgaggagctgagggacgatttccctactgagtgaaagctact

SEQ ID NO: 12473 - DNA, 241 bp, Homo sapiens
agatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgt

SEQ ID NO: 12474 - DNA, 503 bp, Homo sapiens
actttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttc

SEQ ID NO: 12475 - DNA, 339 bp, Homo sapiens
tttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattaattaaccaaacatcactccatttcaaagtaaaatattccacca

SEQ ID NO: 12476 - DNA, 293 bp, Homo sapiens
  misc_feature 142: w=a or t
agcttttctacccaaatacgcggcgggggaataggctcgagggcggtgagcagtgacaattgctaggcggagacagtgcagggaagagagaccttagaaaggatcaggactggcgggaggtatttaactgaaaggaatatcwgcttcactgttgcaaccaaaccagatgccttcttccacttcaccagaccaaggagatgacctggagaactgcattttaagattttctgacctggatttaaaagatatgagtcttattaatcccagcagcagtcttaaagcagaattagatg

SEQ ID NO: 12477 - DNA, 155 bp, Homo sapiens
  misc_feature 5: s=g or c
  misc_feature 21: s=g or c
  misc_feature 31: r=a or g
  misc_feature 32: n=a, g, c or t
ttttsaccctccgtctctcasaccccctccrntcccctgtctcctttctgacactgcactgcagctgctcctcagccctgccccctccccagtgagaacaaaccagcaacattgctttttttcctaaagagatttatattgatccgattaaaaaa

SEQ ID NO: 12478 - DNA, 193 bp, Homo sapiens
  misc_feature 72: w=a or t
  misc_feature 143: r=a or g
tcaaaaaatcaatgtgggctgtcaaagaaggtttcttgatagtcatgagtcagcctgattcttgaaaggatwtgtggaatataaaattttatttatattccttttgagaaaatactgagaaaacatcttccctggaaaagagracgtattgtaaagaaagtacatgaaattgaaggttgaatatccaacatcc

SEQ ID NO: 12479 - DNA, 541 bp, Homo sapiens
  misc_feature 65: k=g or t
  misc_feature 315: s=g or c
  misc_feature 358: s=g or c
  misc_feature 463: k=g or t
agttgccaaatgaaatctgaaacctcgagctgtgtctgagggttggccccactcagttgttccakcctcttgtactgtatatttacacattcacacacaatcaccctttctaacttctgggactctttgcgcaactgctaggatttctcaagtgcatgtggcaacacagcccagctccgggtggaaaccagcagggctctggaggggctcggagaccaggggagctgtcaaggctgcggcggggaccagagaggagcctggcgggggtggctgggtggctgggggaatccccccaacttcccatcgcaggcgcastctctcggccgcctatttcctccgaaacccgcgcgcggagcasccagtgcatagagttcaacacttccccttgttgtggaaagtaaaggagcctcactaccacctttttttctttgctttttcttactgctggtcctgggagcctttkcttcggagcagcagccctgtccggcatctgtcttgagctcccagcaaggaaagtccatcagcttgataatggaggaga

SEQ ID NO: 12480 - DNA, 103 bp, Homo sapiens
cttccggtggagatggctgcggccgtggcggggatgctgcgagggggtctcctgccccaggcgggctagagtgcagtggcatgatctcggctcactgcaacct

SEQ ID NO: 12481 - DNA, 228 bp, Homo sapiens
aattcttccggtggagatggctgcggccgtggcggggatgctgcgagggggtctcctgccccaggcgggtaaggagtggcccaggtcctcacggcgtgtcttgcggccgctctctagtcctcatctgccctcctctactactgattcttcccataatctctgaccccagctagatcgctggcctccttaccccgtccagttccttgtgactcgactggccggctgcct

SEQ ID NO: 12482 - DNA, 217 bp, Homo sapiens
agaagaagggctggtagggatcacagagaggctgtgggcaggtgagcaaaccagcctccagggagacaagtgtccttagcagccaggacctcagcacaggaccagagctcggaacgggacactttgccctgcgagcagatggagcatgacctggggtctgcgcaggagaggccacattctcccagactctgggagtgaactggagtggggccccggc

SEQ ID NO: 12483 - DNA, 345 bp, Homo sapiens
tacatttcctcagaagaaggctccttggtgctttgaagaacatcctgaagattatatcggagacaatatatcaagaatctatttattgaatcatctagaacaaaagccaggagctccctaatggaagcacattagtgtttattttgatgaagaaatatatagattttttaaaacaaccacaaagtagatagctcagtaaaaaatcaattttggaagatgtcactgaacaactcttccaatgtatttctggattcagtgcccagtaataccaatcgctttcaagttagtgtcataaatgagaaccatgagagcagtgcagctgcagatgacaatactgacccacca

SEQ ID NO: 12484 - DNA, 241 bp, Homo sapiens
gtgacttccaagactaggccagaagaggcatttgagggtttctgctttctttctctcaggtcactccctctggaggaaaccagctgccactttgtgaggatactcatagtcctgtggaggcatatcctccatatggctgagacctcctgcgaacaaccatcactgacttgccagacatgagtgtgccaccttggaagcagattttccagccccagttaagccttcagatgacatcagcccc

SEQ ID NO: 12485 - DNA, 544 bp, Homo sapiens
  misc_feature 13: r=a or g
agaagcgcttccrgcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcggtaaaggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaa

SEQ ID NO: 12486 - DNA, 396 bp, Homo sapiens
  misc_feature 334: n=a, g, c or t
actttttccacgtgcgaaagccccggactcgtggagttgtgaacgccgcggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggagatagaggcgcaccttcccaaggcaaatgtccataatagtgtttcctaggttttcttctagtatccttatagcttgaggtattacatttaaatctttaatccatcttgagtnaatttttgtatatggtgaaaggtaggagtctagtttcattcttctgcatatggttagccaaa

SEQ ID NO: 12487 - DNA, 129 bp, Homo sapiens
tctctcctttctgggttcttcctcatcaaaggcttgtctcagctcactgccctgttagagggctttagaaaccaggtcacacagagcttgttatttgctactcaaagtatgtggtttttttatagttac

SEQ ID NO: 12488 - DNA, 202 bp, Homo sapiens
aaaataattgatggagaatgaccgaacccaggacaaagctttgcaggaaaccagtgcatccgtgttcgagcggttttgggatcctctgccaagtacgggataagagaatagagcaaggagtttgagcgctgctgccaatcttccatctcgggcgtggctctggcctttttgtctctttatcccgccactccccacccccgtc

SEQ ID NO: 12489 - DNA, 101 bp, Homo sapiens
  misc_feature 49: s=g or c
aaaataagttgggaaaggaatctctactgttactgtagacaaaccagtsaacacttatgatgtatttgacatgggccacccttgggccctcagggattgag

SEQ ID NO: 12490 - DNA, 111 bp, Homo sapiens
agtgtgttctgacggagccgaagtacagaaaccatatttacaggtacatgtgacagcgttgcagctatgagtggaattttaaaggggaagtttgaagaagtcaacggctcc

SEQ ID NO: 12491 - DNA, 141 bp, Homo sapiens
gagaaaacttgcgaagtttaggatggagctgaagagactgggttccgtcctacgcctgctgccatcagactggaactaaaccatcagctctcatgggactccatcttgctgacttatcctgcagatcttgggatttaaccg

SEQ ID NO: 12492 - DNA, 434 bp, Homo sapiens
acaatgaccaacggccccctggcatctataacaggccgcagagctggcccctgactcacagcccacagagttccacctgctcacaggttggctggctcagccaaggtggtgccctgctctgagcattcaggccaagcccatcctgcaccatggccaggtacagatgctgtcgcagccagagccggagcagatattaccgccagagacaaagaagtcgcagacgaaggaggcggagctgccagacacggaggagagccatgaggtgctgccgccccaggtacagaccgcgatgtagaagacactaattgcacaaaatagcacatccaccaaactcctgcctgagaatgttaccagacttcaagatcctcttgccacatcttgaaaatgccaccatccaataaaaatcaggagcctgctaaggaacaatgccgcct

SEQ ID NO: 12493 - DNA, 560 bp, Homo sapiens
  misc_feature 24: k=g or t
  misc_feature 366: r=a or g
ataggagcctctctccctactgckgctaataagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggrccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtga

SEQ ID NO: 12494 - DNA, 279 bp, Homo sapiens
tccatcattttactgttaaaccatggatagtcatggggctgttacctgacatagcctataccatcatgaccagagacctggtaagtctgtcaatagtttagcccatggagcaagtgaaaagcaaagaaagtttcttggaaaccaagttcctgccttcctaagaactgaggttggccaggtgcagtggctcatgcctgtaatcccagcactttgggaggccgaggtgggtggatcacgaggtcgggagttcaggaccagcctggccaatatggtgaaacc

SEQ ID NO: 12495 - DNA, 651 bp, Homo sapiens
  misc_feature 84: r=a or g
  misc_feature 87: k=g or t
  misc_feature 622: m=a or c
tatgtgctggcttccaacctgatgcaatgtgtaatattgaaaaaaatgaaaattatcaacctaaatacggctactgggttatarggktaggaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagamcgctatttaggtattacttctgccagata

SEQ ID NO: 12496 - DNA, 363 bp, Homo sapiens
tgttgttgagatggagtttaacatgttggccaggctggtcttgaactcctgacctcaggtgatgcaccttcctgggcctcccaaagtgctgcgattacaggcatgagccaccgcaccaggcagttaactctttcttggagagaaataatgaaatctcatctcattaagttctcattttacacattagtaaataaggctcagagaaattaagcagtttgctcaatcacacagccaatggattggaaaccatttctgtccaattctaaagcctatgttgtccaattccaaagcctctattctaccacataccaccttccctagagtgtactccctagattaatagggccactcgaattagaagct

SEQ ID NO: 12497 - DNA, 428 bp, Homo sapiens
  misc_feature 337: s=g or c
  misc_feature 353: r=a or g
  misc_feature 354: r=a or g
ttgaaaacactagagattcaaccttcgtttttatggaaggctctgaagatgcttatgttggatatatgacaataaaggtttaaccctgatgacaaatctgcacaacaccacaatgcacaccactgcttagagattacagtaaattgtagccctattattgatcactgtatcatccgaagtacatgtacagttggttctgcagtatgtgttagtggtcaaggagcatgtcccaccatcaagcactgtaacatcagtgactgtgaaaatgttggactatatataacagatcatgcacagggaatatatgaggataatgaaatttccaataatgcgttastgggatttgggttaarratcatggaaacccaattattagacggaatcatattcatcatggacgtgatgttggtgtgttcacatttgatcat

SEQ ID NO: 12498 - DNA, 226 bp, Homo sapiens
  misc_feature 125: n=a, g, c or t
cctgaagaaacagaggaacccatcaggcctagaccacctcgacccaaacccacacaccagcctcctcagacaaaatggtacaccccaattaagggtcgtcttgatgctctctgggctttgttgangcggcagtatgaccgggtttctttgatgcgacctcaggaaggagatgagggccggtgcataaacttctcccgagttccatctcagtaaaagggaagcagga

SEQ ID NO: 12499 - DNA, 180 bp, Homo sapiens
aaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccacc

SEQ ID NO: 12500 - DNA, 387 bp, Homo sapiens
catggcttctccactcctcccctccttaacttttctttaccagttggtactcttcacctcccttcttgaactctactcaaaatccagtgtgcttttttgttgattttccttccttcctaataattcattgtcttgtttcctcttggacttcttacaaagaggcatcaccaagagttatttttaatccaaatgactctgaaatttacatctccaaccagacctaaaccctttcctctatcccccaagtgattttctttcctcttaaacccactcttcctaatgactttcctatgtctgtgatagggttacccctcatacacgaagcccccaagtcatctagcccactcctctctgcatcagtcccctattggaagagttctatggaat

SEQ ID NO: 12501 - DNA, 461 bp, Homo sapiens
  misc_feature 451: n=a, g, c or t
atgtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaaccaggagaccaccgaggagtttaatcgagagatgttctggagaagactcagaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttngtgccagcag

SEQ ID NO: 12502 - DNA, 339 bp, Homo sapiens
acagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttcgattccttacaaccttccgtaattccaggcttgtggccccaaattcagggccccacccttccaggaacaaatcattatagtaataatttgccttcatcttccatataccaactaagcatgtttaactacgaacgtccaaaacacttcaacca

SEQ ID NO: 12503 - DNA, 154 bp, Homo sapiens
  misc_feature 103: n=a, g, c or t
agagatctccagtcagaaagagactgcctgcgagggagattcctggctgctgctttgtagaccaaggaaacccaggaccctccggaaagactaagcagcgcgncctccgacccacagacctgagggctgcaccactgccctcgctctctgacgc

SEQ ID NO: 12504 - DNA, 209 bp, Homo sapiens
  misc_feature 9: s=g or c
agggcggascaaatcttaaaggatccgggagctaagccagacccgggtggcggtggcagctgcgaaacccagggagccgatgccacgtgacccaatgtggacttcttttaaacctttctaatgcccataacccagcctcagacccatggagcccacgagagactgcccgctgttcgggggcgccttttccgccatcctccccatggggg

SEQ ID NO: 12505 - DNA, 299 bp, Homo sapiens
  misc_feature 263: k=g or t
caaatcatggtttgagccacagcccagccaggcctgggagctgccaaagacagagggatccacagcccacgtttccatccaagtttggacactttatctgcacttcctctgaaactgagctgcccctggctgcagaagaaacccatgcacttgagcaataaataaagctggggctcagggagagacacgtgggacccaggggctggggcgtgaacccctgacctgctggttatgggacctgtggcctcaccaacagccctcckgacctaatccggacctggaggattgctgagcacagg

SEQ ID NO: 12506 - DNA, 334 bp, Homo sapiens
  misc_feature 270: k=g or t
aattgtatcgtatagctgtattgaatcatgtagtatcaaatattagatgtgatttaatagtgttaatcaatttaaacccattttagtcacttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcakaacaagatctgtaagcacagtcttattttcttttgttgtccagaatacttataattcttgagcc

SEQ ID NO: 12507 - DNA, 315 bp, Homo sapiens
aaaagagaaagtccagagaatgtttctatctgcaattgcagatactgttattttctactcaataacccccaatccttttccttgctaatagttaaaccccaatttgacttggcagcaatgcaccaagttctaggttaaagattggtaaattacagctacaggtcaaatccactccactgcttgtttttggtttttatgtttatttgtttgtttgttttgagacagggtctcactctgtcacccaggctgcagtgcagtggcacaatcactgctcattgcagcctcgacctcctgggctcaagttattcctccacc

SEQ ID NO: 12508 - DNA, 111 bp, Homo sapiens
cctcagaattccagtgggagcctccctctgagccttgtagaaatgggcagcgagaaaccccagctgagctgcgttccagcctcagctgagtctttttggtctgcacccacc

SEQ ID NO: 12509 - DNA, 160 bp, Homo sapiens
atctggcccctagaggctggtacttgggcccgaaacccccatctccggcggagagaccgtccgaggtaattgtctgccacgagtggtcccagctacttggggggctgaggtggctgcagtgagctgagatcccgccattacactccagactgggcaacag

SEQ ID NO: 12510 - DNA, 348 bp, Homo sapiens
  misc_feature 159: k=g or t
aaaaaaatccgccgcgccttgacaggtgaagtcggcgcggggaggggtagggccaacggctggacgccccaagggcgggcgcagatcgcggaccatggattgcactttcgaagacatgcttcagcttatcaacaaccaagacagtgacttccctggcckattgacccaccctatgctgggagtggggcagggggcacagaccctgccagccccgataccagctccccaggcagcttgtctccacctcctgccacattgagctcctctcttgaagccttcctgagcgggccgcagagcgctcacccctgtccctcccagcctgcacccactccattgaagatgtacccg

SEQ ID NO: 12511 - DNA, 250 bp, Homo sapiens
agcacttgttcgctggccgcccctggaggctagaagctccggcgccgagagtgggcatggcgacttggtctcagccggactcgggtttctctggaaacccccctggtaagtgtggaggaggcgggacactctgacccaagacgaaaggcctgtagctccagccaaagaaaataaaccttaggagggagaaggaaaaaaaaatccatcagctgttcctgagaacagcctgcattggaatctacagagagga

SEQ ID NO: 12512 - DNA, 270 bp, Homo sapiens
cagtccagagggcgatgaggatgccgattgctgggaagatcctggtccctttttgtccccatgttttcaagaggaaggaggacgctgccattttacttggtgaaagacccttcgtcacgcacgaaacccccgagggctctgggctcggtcctgctgccccgcagtgggcgggctctgtgtgtcttacggttgcatctgttgtacctgagaaacattttttaaacaaaaaaattcaacacaaaagaattttttaagaaaaaaatgctactg

SEQ ID NO: 12513 - DNA, 252 bp, Homo sapiens
aagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgtcgcctcgatctcctcgtctcccgctccgccctcccttttccctggatgaacttgcgtcctttctcttctccgccatggaattctgctccgtgcttttagccctcct

SEQ ID NO: 12514 - DNA, 418 bp, Homo sapiens
aacagccactctcgcgcctccgaacagccacaggggcaaagccctgtcacccccaggatccggtcatcagggaaagaggacagggagaccagaagagggccagctgggacgagggggcggacgccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgga

SEQ ID NO: 12515 - DNA, 146 bp, Homo sapiens
  misc_feature 30: s=g or c
atattggaggggacaaaactccggcgacasgagtgacacaaataaacccctggacccccttgttccctcagctctaagggccgcgatgttgtacctagaagactatctggaaatgattgagcagcttcctatggatctgcgggacc

SEQ ID NO: 12516 - DNA, 360 bp, Homo sapiens
  misc_feature 266: n=a, g, c or t
cccaaagtagccagatgtctagatacttttagagaaaaaatgacaagtcttaaccagtatgagaaaaacatagtgacaaccccaaaaccaacttctgtgggctggactttactaccgtcacactaagaaagtttacaaatttgtgttcgtaaacaggccgtattcagagccgtcctgggctgcgggttggacaagcttgccttagctcctcctctagaaaggttttgcagaccctgattgtaagagacacctttgctttgagagtnagggcctgcttatttatcttcattttaaagttagaaacaaggttttgtgtgcttaaaaaatcctttacattgcatttctaagttttacatgagg

SEQ ID NO: 12517 - DNA, 375 bp, Homo sapiens
gtaaaaaaacactggaataaggaagggctgatgactttcagaagatgaaggtaagtagaaaccgttgatgggactgagaaaccagagttaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacgtctacaggcaaaagtcaaatttatggggtgcatagcagcctggctggaagcattctgagtgctctgtctgccctggtgggtttcattctcctgtctgtcaaccc

SEQ ID NO: 12518 - DNA, 484 bp, Homo sapiens
  misc_feature 365: m=a or c
  misc_feature 405: m=a or c
aaacagagtgcctagctttctcagtcattcaaacacaagcacggaagaagagattgcactgaccagaggaccgccaggtgtgatgctccgtagtcgcagatgaaggaaaaccatgggcggacttgtcatggacagctcctaggtggacataaatggaaactcattggttctggggcacggcgggaagagggagacggccctggacggccgcaccaagaatttcacaacccaaacccgactagaaagcctgggttatggccacaccgtgcccttgtcagatggaggtaaggccttctgcatcatctactccgtcattggcattcccttcaccctcctgttcctgacggctgtggtcagcgcatcamcgtgcacgtcacccgcaggccggtcctctacttccacatmcgctggggcttctccaagcaggtggtggccatcgtccatgccgtgctccttgggtttgtcactgtgtctgcttcttctt

SEQ ID NO: 12519 - DNA, 272 bp, Homo sapiens
  misc_feature 132: n=a, g, c or t
  misc_feature 158: m=a or c
  misc_feature 214: m=a or c
  misc_feature 215: n=a, g, c or t
  misc_feature 216: n=a, g, c or t
  misc_feature 242: s=g or c
ggaacagcggcctctgacaccagcacagcaaacccgccgggatcaaagtgtaccagtcggcagcatggctacgaaatgtgggaattgtggacccggctactccacccctctggaggccatgaaaggacccangggaagagatcgtctacctgccctgmatttaccgaaacacaggcactgaggccccagattatctggccactgtggatgttgmnnccaagtctccccagtattgccaggtsatccaccggctgcccatgcccaacctgaag

SEQ ID NO: 12520 - DNA, 291 bp, Homo sapiens
actccgaggccaggaacgctccgtctggaacggcgcaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccgtcagcccgtgagcggccatgtccaaccccagcgccccaccaccatatgaagacc

SEQ ID NO: 12521 - DNA, 155 bp, Homo sapiens
agtgcgggctgagaaggcggtggctgcagcagcagggcggcggaaaccctaaagtccgagtccggactacgagtgcgtggcctcctaatccggatcctagtcctgagcgtgtctgtgtgcgagtggacggtcccggacgcgatgaccctgaacaa

SEQ ID NO: 12522 - DNA, 472 bp, Homo sapiens
  misc_feature 309: s=g or c
  misc_feature 312: m=a or c
  misc_feature 317: r=a or g
  misc_feature 321: w=a or t
  misc_feature 322: r=a or g
  misc_feature 331: k=g or t
  misc_feature 351: r=a or g
  misc_feature 353: r=a or g
  misc_feature 368: k=g or t
  misc_feature 382: y=c or t
  misc_feature 404: r=a or g
gaaaccctacaaatgtgaagaatgtggtaaagcctttaccaagtcctcaactcttacttatcataaggtaattcatactggaaagaaaccctacaaatgtgaagaatgtggtaaagcctttagtatattctcaatccttactaaacataaagtaattcatactgaagacaaaccctacaaatgtgaagaatgtggcaaaacttttaactactcctcaaattttactaatcataaaaaaattcatactggagagaaaccctataagtgtgaagaatgtggcaaaagctttattctgtcctctcatcttastamacatragawrattcatackggagagaaaccctacaaatrtraagaatgtggcaaakcttttaaccggtcytcaacctttactaaacataagrtaattcatactggagtaaaactctacaaatgtgaagaatgtggcaaatcctttttctggtcctcagcc

SEQ ID NO: 12523 - DNA, 202 bp, Homo sapiens
tatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccag

SEQ ID NO: 12524 - DNA, 228 bp, Homo sapiens
tttttcttttggtcagagaaaccctcagattggtgcaagcatagtaggcctacttccacaaggaagcagctgcttgtctagtttggtgtgtcaggacaggctgcctaggtgaaaaggatgtgggcactgtaggagagtgagcagaagcaggtgggtggatgcagacgcgagagctcagtgtaatgggaggacaggatgctgggaatgtggagtctcaagaaaggcagg

SEQ ID NO: 12525 - DNA, 216 bp, Homo sapiens
  misc_feature 81: y=c or t
  misc_feature 154: m=a or c
agatccctcccacagtggacctaggaaaccctcagctcagagaacaaccctgcattccccacacagcacccacaatcagcyactgcgggcgaggagggcacgaggccaggttcccaagagctcaggtgagtgacacagtggaacggcccagggmgccctcaccctgctcagcttgtggctctaacattccagaagctgaggcctctggcatccctg

SEQ ID NO: 12526 - DNA, 199 bp, Homo sapiens
  misc_feature 81: n=a, g, c or t
  misc_feature 83: m=a or c
  misc_feature 84: k=g or t
  misc_feature 88: r=a or g
  misc_feature 93: r=a or g
  misc_feature 96: r=a or g
  misc_feature 104: k=g or t
agatccctcccacagtggacctaggaaaccctcagctcagagaacaaccctgcattccccacacagcacccacaatcagcnamkgcgrgcgargarggcacgakgccaggcccaagagctcaggaacatggagctgatccaggacacctcccgcccgccactggagtacgtgaagggggtcccgctcatcaagtacttt

SEQ ID NO: 12527 - DNA, 506 bp, Homo sapiens
  misc_feature 13: s=g or c
  misc_feature 14: r=a or g
  misc_feature 50: n=a, g, c or t
  misc_feature 51: m=a or c
aaacgcccgtcgsrggcgcgtctctttcagcagccaatgggctctgccanmcttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatag

SEQ ID NO: 12528 - DNA, 510 bp, Homo sapiens
  misc_feature 6: n=a, g, c or t
  misc_feature 484: m=a or c
  misc_feature 485: y=c or t
attttncgcctccctcacagaaggcagtcactgcaacgtgcgtggcctcagttgcgtcatatccggcccttgcgatcagggcttgaggaacccgcgccatgaagtgcgtgtttgttaccgtaggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggtcmygacttcctgggcagccagtccattg

SEQ ID NO: 12529 - DNA, 219 bp, Homo sapiens
  misc_feature 149: m=a or c
  misc_feature 167: k=g or t
agtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgmtgcaggtgttcctggaakgctgcatttactgggtaggattcgcttttcgaaatcctccagggacacagcc

SEQ ID NO: 12530 - DNA, 449 bp, Homo sapiens
  misc_feature 420: n=a, g, c or t
  misc_feature 422: r=a or g
agtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagaccccggagaaagcagtaccgacantracgaagataccagatcccttcccaacc

SEQ ID NO: 12531 - DNA, 186 bp, Homo sapiens
  misc_feature 107: w=a or t
  misc_feature 169: n=a, g, c or t
agtgcgcccaacagcggactccgagaccagcggatctcggcaaaccctctttctcgaccacccacctaccattcttggaacctcccaagcccaccctactccaaaawaatgtgtcacttgatttggaactattcaagcagtaaaagtaaatgaatcccacctttactanaacactttctctgaacc

SEQ ID NO: 12532 - DNA, 210 bp, Homo sapiens
atatattgtctactgaaagctgccgctgaagctgccgccgttgcctccgccgccaagagtgagcgagcggacccgcgatggagaccatggcgagcccagggaaagacaattatcgaatgaagagctataagaacaatgctctaaaccctgaagaaatgagacgaagaagagaggaagagggcattcagctccggaagcagaagcgagagc

SEQ ID NO: 12533 - DNA, 155 bp, Homo sapiens
taattctcaccccccttcatccctaagcacacacacatacctttgttcagtactgaaagcaaatacctataattttcaaactatgtccttgaaatcattaaaccctgatttatgcacacttttaactccaattgttttcattgtatcctctctcc

SEQ ID NO: 12534 - DNA, 365 bp, Homo sapiens
  misc_feature 90: k=g or t
taaactattttgtgtttgacgcatcaaacttcaagttttttgtaagtttctctcctgaaattttctttctcttctatactttatgcaccktactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggt

SEQ ID NO: 12535 - DNA, 186 bp, Homo sapiens
actacgcgggcctggacagtcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacct

SEQ ID NO: 12536 - DNA, 140 bp, Homo sapiens
ctttttttgtggtccggcccattgcgagggtgacaggaaaccctgtgcagggagcgccgccatcttggaccagcccgaggaagatactgagggagcacaggagcagtcaccgctgccactgctactgccgctactgctgc

SEQ ID NO: 12537 - DNA, 262 bp, Homo sapiens
cgatagaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaa

SEQ ID NO: 12538 - DNA, 270 bp, Homo sapiens
acatccaagatggcgtccccaggagctgggagcgggtgaccggcggcggggaagcggcctgggttggccctcagattgcggggtctgggggcatctcgccgggcaaacccttggcccgcctacaaggacttcccccggccagagcaatggccgctgagaacagcaagcagttttggaagaggagcgctaagctgccggggagcattcagcctgtatatggagcacagcatcctcctcttgacccacggctcaccaaaaatttcattaaag

SEQ ID NO: 12539 - DNA, 149 bp, Homo sapiens
  misc_feature 61: y=c or t
gacacagaatagctcgctgcgaggatagcaatacacatcaagtctcccttcctttatttcyttccttttcccggccgcacctttggacagaaaccgaaagcagcccggcgtccgtccggagtcttatgcttccccctccccccttgcct

SEQ ID NO: 12540 - DNA, 202 bp, Homo sapiens
acacaatatcatttaatactcacagtagtacctgtgaaatatatcagatggatattcctatctctattttacagcagaggaaaccgaaattcagagaacttacatttctaaggttgtacagctgcaaaatgaccaaattgtgaagtccctaacatccaggttttcataatgccagtactctttctatgacatgtttatgacc

SEQ ID NO: 12541 - DNA, 392 bp, Homo sapiens
  misc_feature 17: y=c or t
cacaatccttcgcgctyttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggcccactacctgcaaaacattttcaattttagatttggaatgtttaatctaataactcatttctacaccaactacttttttccaatcacttttatataaagcatctgttttcagcatttgtccactaatgaaccatatcaagtatattttagtgcacaaacttcacaaaagatgaaa

SEQ ID NO: 12542 - DNA, 303 bp, Homo sapiens
cacaatccttcgcgctcttcttttccaacttggacgctgcagaatggctcccgcaaagaagggtggcgaggggttgttttcccgggtgacattctggatcagcagggatgcattggaatatactgtttctcgtccactgcctggaacgtccctttttcttctctgctctttctcatatcttactcaaagactttcccaaggtgtacctaaacattttcccctgaggtgacattttgcttcttggaattttataacattttatttattacaactttcaagatttttaaaacttttttgtgtgta

SEQ ID NO: 12543 - DNA, 368 bp, Homo sapiens
  misc_feature 200: k=g or t
  misc_feature 299: r=a or g
  misc_feature 300: r=a or g
  misc_feature 324: n=a, g, c or t
  misc_feature 326: n=a, g, c or t
ccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagckcaggcgcctacaaatcgaggacttcgaggctcgcatcgcgctgttgccactgttacaggcagaaaccgaccggaggtagcaccgcaggggccaaggttrrgaggtcactggccggaaggcccantnctgcagggcctgacctgcatccccgaaggtggccagaatgca

SEQ ID NO: 12544 - DNA, 324 bp, Homo sapiens
ccgggaccggaagtgtgggatactgcgagtatggcggcgtcaaaggtgaagcaggacatgcctccgccggggggctatgggcccatcgactacaaacggaacttgccgcgtcgaggactgtcgggtcagtatcactctgcgccggggtctcagagtctgggcactcggggctcgggggcggggttccggggacacaggcgggcctcagttttcccggcggtgtgaccggaggcggaccggggatccatcatagcttctgtaataacgctaagtgctgcagtttgttgaggtctttcccagctcctcttccttctcgtaacagcc

SEQ ID NO: 12545 - DNA, 208 bp, Homo sapiens
  misc_feature 78: r=a or g
  misc_feature 200: n=a, g, c or t
  misc_feature 201: n=a, g, c or t
aacatggcggcggttttggctgtgtgaggaagacggaagagacggcggcggagggaaaccgacttccactagtccggrtcgcttgggcggccgggggccctcagagtctcccgggcagtggtagcagttgcagcaggatcaggcgcctgtcggcttctgacgtttaaaacagggggagcggaagggagccactggccgcnntggcagg

SEQ ID NO: 12546 - DNA, 208 bp, Homo sapiens
  misc_feature 7: r=a or g
aatgtarcagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctg

SEQ ID NO: 12547 - DNA, 308 bp, Homo sapiens
  misc_feature 283: n=a, g, c or t
gacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactncaagaataaggttttacagaaggca

SEQ ID NO: 12548 - DNA, 213 bp, Homo sapiens
agtaatcagagagcaaaaaatctattcaatctcttttaagccagtgaataatgtagcagagtcagaattgtcacaaccgctgggtgcagctttggaaaagatgaaagatgagagaataggagaggaggaggagaggcccctgcagctgggatcactcagagacactctcctaaccttctccttcaccatctggtgggaagaaggagcccctga

SEQ ID NO: 12549 - DNA, 359 bp, Homo sapiens
  misc_feature 280: w=a or t
  misc_feature 282: n=a, g, c or t
  misc_feature 326: n=a, g, c or t
gcatttagttgaagctgcaggggagtgagggagaggaggataggaagcaggaaagcgggagagctcgagggacaagggggctcggtgtgtttacaccaggcacgggctacgagcgtccatcccggcccctggcttgcgctcccgaagaggagagcaaggctgttctgggatccggccgtcgtgcggcaagaggcttgtctgtccgggttgccggaaccaggagaacccagagggaaaccgagggaaaggagcggcgcgtttactagagagagcgcgaggwanagaggcgagacaggagctgcgcgagggagcatcgagcgcaggangacatgaggacctactggctgcacagcgtctgg

SEQ ID NO: 12550 - DNA, 269 bp, Homo sapiens
  misc_feature 28: s=g or c
aagagcggatgtgaggggcgccgatggsgagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacgg

SEQ ID NO: 12551 - DNA, 192 bp, Homo sapiens
  misc_feature 23: y=c or t
  misc_feature 112: r=a or g
  misc_feature 121: y=c or t
  misc_feature 140: s=g or c
  misc_feature 164: y=c or t
aagactatattttgagggataayttctatagtgtgtttctcgaggagtatatctgaacgtgtagaacgctggaaaccgcgagagggagatatttgtgttctctcacgagtgrgatagcagygtttggtgttgcgttattstaactgctgtttgctgttggtgaycgttcttctctagagaaggcagtctgag

SEQ ID NO: 12552 - DNA, 178 bp, Homo sapiens
  misc_feature 69: s=g or c
agccattttgtgcagtcgctgggaaggaaggagacgcctaaaccgcggcactgcccggtttgagcgtascaaacctgcccaccggctttgtagccccgattctctgtgttttgctcccgtctccgacgagagaggcggcgacggtggcgtctgcgacgggagacagcgcgtcggagcg

SEQ ID NO: 12553 - DNA, 300 bp, Homo sapiens
aacgtaaaccgcggcgcagatccaagtcgccggacccggtgtggagagcggtgctgaggctacgcgggctggagactcagggtgaacccgagaccccgcgaggaggcgtcgctgtccccaagtgcccaagacgcctcccctgccttcctgaggttcccacgagtgatggggcgacttcgtcccagagagggatgcgagcgggaaaggaaataaaaatagaggaacgggacaaagcgtgggcacaggcggatgggcaatcccggaggcctctctaaggaggcgacttctgagcccagacct

SEQ ID NO: 12554 - DNA, 393 bp, Homo sapiens
  misc_feature 139: r=a or g
  misc_feature 141: r=a or g
caaacagacatggtcataaaaggaaaaaatctcgttctcgatctcagagcaagtctcgggatcactcagatgcagccaagaaacacaggcatgaaaggggacatcatagggacaggcgtgaacgatctcgctccctttraraggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgc

SEQ ID NO: 12555 - DNA, 343 bp, Homo sapiens
  misc_feature 4: n=a, g, c or t
gggntttcagtggcttctggtgctctagggtgagctctgcccggctgcagggatggcggggaggggtaagctcatcgcagtgatcggagacaaggactccatcctgcgcagggccaggggcatgttcactgccgaagacctgcgctaggggactcctcatagccctcagcccttccctcgtttccaggcctctccccaggcttgccatcagccttctttactttttgagcctctgatttccaattccctgctccttcccactccattaagaggctaggtgaggcgcttctaggttgctggggctctgctggttaaggaacaggaagcctgaccatctccctcc

SEQ ID NO: 12556 - DNA, 212 bp, Homo sapiens
  misc_feature 118: y=c or t
gttgcgtgctgccagcgggaactgtgtaggggtagattttcgctgcagtgttccccgagcctgttagacgcagcgcgccgggagactgagagaggaaaggatagaggaagtgctgccytaggctgcatgagtcgaagcaagcgtgtttccttcccgccaggcaagtgcccttagaaaccgggccccgcccccttcctggcctgcattcccat

SEQ ID NO: 12557 - DNA, 247 bp, Homo sapiens
ggagttaagtgaatcgttaagggtggagtcgaaaccggggtcggggccggggccggctgagtgaaagggtgggtgattatcccgggagataggccgaaagggcagaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagg

SEQ ID NO: 12558 - DNA, 244 bp, Homo sapiens
  misc_feature 2: w=a or t
  misc_feature 8: w=a or t
gwggagcwggttgaaggaacggggcagtcccctgaggagcggggctggttgaaacgctaggggcgggatctggcggagtggaaaaccgcggcaggggccaagcctcctcaactatgacctcaaccggccaggattccaccacaaccaggcagcgaagaagtaggcagaacccccagtcgccccctcaggactccagtgtcacttcgaagcgaaatattaaaaagggagccgttccccgctctat

SEQ ID NO: 12559 - DNA, 396 bp, Homo sapiens
gcgggaggtccggacactggcggccatggaactcaccggtaatagaggacacatctcttaactgggttgctctaagaactgatgtctaaaccgtctcagcatggcctgtagaggaggagctgggaatggccaccgtgcctcagctacactctctcgggttagccctggaagtctttacacatgtagaacccgtacccataatatatgcatggtatctgactttttctacccaaatatgggaggcgtggaaagccacatttaccagctctctcagtgcctgattgaaagagcataaggttataattgtcacccatgcttatggaaatcgaaaaggcatccgttactcaccagtggcctcaaagtctattacttgcctctgaaagtcatgtacaacca

SEQ ID NO: 12560 - DNA, 314 bp, Homo sapiens
aggatggtacagtctgcagaggggcccgggcacgctggctgggctcagccgcggcaccagctgccgcaccgcgattacggggctgcccgccgggaaaccgtgcaggattggtggtgattttcatagccaagagccaccacccctgaccatgtagatgccagttccagggagcagcatgggccccactgaatggagactcctgggtctacagccctgagcccctccggcccctggacctcgtcccacaccggaggacacctcttggagctcaccaccactgtcaccagcccgcctcggccacccccaccccccgg

SEQ ID NO: 12561 - DNA, 358 bp, Homo sapiens
  misc_feature 329: n=a, g, c or t
  misc_feature 346: m=a or c
  misc_feature 347: n=a, g, c or t
  misc_feature 350: w=a or t
  misc_feature 351: k=g or t
tcctatcaaaagaatatgaaaaattactttggttaaataatttaaaaaaatttaataataaattcaagttcctcttttcccttgttcacattaattacagtactattgaacttcccagcgttttagttttatttcctcaattacagcataaatccctcatcacagtcatgacataaatcgctgttaactgattcaacaactctttaagtcaaacctactaatgacaagacattatgggatgtactagaggagcctctttttcaggtgcttagagaagtggaaggaatactctaaatcaatagttgtagtaaatgtcatttagtgctatnaaatcaatgttggaggmngcwkaagcaat
